United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 7

SEQ ID NO: 13368 - DNA, 70513 bp, Homo sapiens
agagatacagagacagagagaaacagagacaaagagacagagatcgagacagatggagacaagcagaaacggagaaacagatagacaaagagatagagacagagacagaaatagagatggagacaagcagaaacrgagaaacagagatagacaaagagatagagacagagacagaaakagagakagagatggagacaagcagaaacggagaaacagagagatagacaagarayagagaaatagagacagagagttgaagacagaaacagacagagaaagagatacagagatagagacagaaacagagacagacagatggagacagagaggcagagagtcagagggagagagtcaggagagggaggrgtgggagggggacgcttccctctgccccagggaccctggctagccaaggcacacaccagggcgcaggcagaggggatgaagccccgtgggcgtccatgaggctggaagcggctgactgtggggcctggggagttgcccttgcagtgcgggaaagccracccggatgaggggaggcctttgtcctgaggaggggcctttgcagagctgcaggtgttcccatccatgtgggacccccagccagatgtcccaaggtcggtgaggggccgggccaagctgcctccctctgaggggttctcagcccaggaggctgggttcatgggagacatttgagggtgggctcgtgggggccctggcctcgcccagggcgcagtcccaggttcctgcccaggctctggctctgcccactgggccctcctgggaagtcagattcctcctgggcttcgaggccttctggccatataaggccgtctgtgggcacctcctggagaagctcagaaccctcaccccccacccgccccaccctctatgagaaccagagctcagccaggcaaggacagaggcaggggagggcctgctggagccgtggtcctgtgggggaggagggcacaggcaggccaggccccaggggtagaggctcagggtcccgagtcaccytgcccagcatgctggggcgcccccattccgcctgtttcccctggggttcctggcccctggagctcactagggctccccagtctaggcytgaggcaagcaagtggtaagaatgggggtacggggtagggggaccgcarttaaataagattaaggtgacacgtggaagcgtaggtgcccggcctcggggtggacgctgcagccgtgtgccactgcatgtttaccccgggcgatgccttttctggggctccccagrgatctgggggcaggagtcctggactctgcctcacaccccagcaaggtgctgggaggtgccctgacaggggcccccacttgagggaggggatgggttggggtcctgggagcaaccttgttactggaccggccccttccctgccaagttgtaggtggttagatcccagggaggtcccgggccccctccctgggagttcccagggccccctactccttccctcctaaaggctggcagggtggaggctccccyacacccagctacacaggcccaggccggggcaggggcatccaggtgggatcctggactctggactttcggtcgccaygcagaccaccccacagagctccatgaggcccccccatttctgagcaccccaggtttgcctgcttgtcatggggctgggcccgcctgcacagggcaccagcccaagcgcttctccttgccacttgggaagaaaaggagctgggtgggcaagaggakcctcggggagcatctgtggagagcccaggagcccggatrctgaccctctccagatctccgacactgggcaccacctaagcctgtctgcaccccctctggcatgggggcccacytgaaaccccccaggtgtgaacccagtggcagcctttgggtcgggyctcggggagtgggcaggcgtgaggcatgtcacytgcacgggtgacttgtctcctggagccctaaggyggtggccatgctcctggcatggtgcctggcctggaaggctttgaagagccccaagtctgtggagggcytgccccgtgagtggtgcctggggctgcgtggcctgtgagctgggcacacacagcaagtggcagaggggccaggggccaggcagcrgtgggtcagagtccttcattcctggttagtgtcaacccggagcctggwctctgtgctttccaacaaccacatgtcccagaggccrtcaggagcccagcagtggcccagctggggtcacagccagggaggaaaaagcaccactccttccaaacgggctgtttccagaccctgcctaggccaggaaggccggactatccsttggccccatccttctggcagcaggaacctgcagaccctcggaggctggaggcaggtggcagccctgggggaaggcrggctccaggcctgggggaggggtctggctatggctcagggtcttcctgggctctgcctccattcctttgaggccagccccccagggtctgcaactccgggctggctcttacagcagtctgtccaggctgagggcagtgggggcctcctaggccaagaggcccagaagctctcccagtccgctgggtttatgcaatcctgatgagaccttgtcttcccggcacctgctgttctgtgtcctcctcccagaggactgagctggcccacgcgaacagttcagaaccagccttgctgcccgctcccagcttctctatttcatggacagggatggaggttcttaccagccggctccayggaagggcatcccagcagccctgagaaagggactgtggcctccgatatcccaaaccacagcgctggcgttcctccagacctcatcccgctgagacaacattcccagttctggagtgggagccacaaggcctcacccrcaggcccggccctagcaggagcccagcctccagccctccttcttgctcagcccccgcttcctcttgggggcttctcccgagggtacagcacccacttggaccctgggctctgggacaggagggtctgcagagtcatctgttactgattgtggctgcctgtgatgcagctgagtgtgggcgtgggggtgccccatgtcctcagcacagcggtgtccccaggaggctcccaaggtcaggagttcacgactcacggctgagtcagatgtgcctgtggcctaccctcagggtcccccacagctgcctgcaggtgtggccgagtagggtgggggcattctcaggaatgccactggagtagcactgggggctcaggtgaggtggctgcccccagggctccgcagcagaccttgtcccagggctgggggaggatctgagaccccttccccagggccaggagtgcccctacttctctcgggctgccactgacccctgcccccgacccacctcctytggggctccatcaccctggagctgggtgggcaggggctctggatcttggattgtccctggagggcagccagagcctggtgggacagaggctcctccacggccctcccctggcgagccacctccttttaccctcccctccactcccagactgggcagctccctyctgtggattcaggacaggacgtgtttgggggtggggtgccgtctgacctgttgcagggaggaggactacgtcacgggcgggtgcccgaaagatgcccagtaaataggagtaagaaatgaatgatggacaaacttcctcttgctttactaacttgtgtgctcttgattgaccctggcctttttggcctcagtttccccatttgtaaatagaagaggtggctgggctgcgcaggactcagaaagacaaggagacaggctcgctggtccatttggtgatgactcactggaaccatgacaaagacagcaggggtgggggtgtgcagagatgagctgcccctctccctgctcacctccccaaccccctgtgtgtagcccggctgggacagcccccccgccctccatacgctcagctcctgccccagctgcctcctycccagtccgtgcaccagcagacacagggtgggggcagagtgtgggctctttacccagmccctgggccacattctcttgtccactgcgctgcccgcctgcctgccagttgctccyggggcagctgtctgccgggaagcagtgagcccggtgattaaccctgctggtgctggcagctccggctgacacagcgcattctcagggccggcccccgctcccctcctggccagtgccgggggacagcggaggcctggcagcttggcctgatctggccgctaggaggcttaaagkgctctccccacccccacctctccccctgccccgccactcgcaatcccacccctccaaccacccgaccctccagggatcccaagaagccctcagggtctcaggagtctccacctccagtcccccaggctgtcagagccccaagctgtcaagggggagcccagagccagagcacactgcctggggccaagcccccacctggggacccgctactgcccagaggccactctctgcctcacacgggatctaaagcagctcagagccggactctgcgcctggactgcagattccttgaygtctccgccccctctccagccagcccctcccccacttggagcttctcctgccaaggggagccgcctcctctcccccctcccccaggtgggagaactaatagtgaagttatggaagaattgccgggccggaaagtaggaggagggagagagggtcccatcgccctcccgactccgtagagaaagggccatacaccctcttgggatttgagatttgcaggaggccagggcgccaggaaggtgtgcaaggaggtgcaccctccagggacagctgctagctcagaacccccaccagaaccggctggccagtgccccacaaacccacccagccccccgggactgtccagggaacccagcgagagatgagccccacagcccatctgggaccatggcccgcccagctggcctggctcagggatgggggtttgctgccagctcggcagctgcagccccaccccgccgccaccccctcggggcttccctggaggcagatttggccccggagcccaagggaagtaggagacccagggccgcagccacccaaaggcagacgaagacctgatctcggcctctaggtcctgtgctgtttgccaggcgtcctcgagccgccgatcgtggcaggaacgcgtgcgcggctgtgcagcgggttggaggccaggccgagagagctggtggagtccaccgggccccggagcacaggtgcttccaggcacccagcaggtgctcagcagctgtgaccagagcccccgacctccttaagagccaatttggcggctgtggggccatgagcaccgcccccgtcctctaaagggggctgcagctgcaggccagtccctcctgcccctatttccctatctgagagtatttttaagccctgctggggcaggcgggagccaggccgagttgaacctgacctggctgccccaggaagcagggggttcccacctaggctgccccgttcctctgcagatggtcattcgcgggtgcagagggcaccttcccgcagccagcaggacggacgctgttgggggaggagcgggggcagccgagtggtgcacccaagttaggggaacaaagagtgggcccctgggctgggaggagctggtgggcgctctgggggccagggcgtcgtggggagcgctagggtcccacccgggacccggagctacgacctgggctgggggcccggcggcgccgtcgtcccacggcctggcccgaggccagcaggtgccccttccgggaggcggccgggccggggtccgaagggttaaggccgcccggccgcccctccccctcctctctccttcccccccccaccccgcctccccggacctctccccggggctcggggctcgggcgctcgggcgggccggggcggggcctgacgtccgcgggcggagcgagccctgccggccgcctggcttcagacccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccgggtgagcgcaggggcgggccgtggggcttcctcccggggcactcggacccggaacaccggcccgaccccagggggagcgccgtggcccggggcgagtccaggtgcggactctctggttccgcattttgggggcccaagaaggcaccccgacccggccgctccgtctcggccgggaaacttcgcgtccctccgggaaggcggaattaaagtccccggcatggacccgggggcggctgggcgccggtccagttcgactgcggtgaccggggcgggaggggggccgggcccagtccctggcggccccaagtccgggatcccggggagggcgggacttggcctccgccgcctgctgccggtggggagggggcgcagctccgccctacccgggacaggctggaacctgttggcctctggatggggtgggaggggccagccacctgaggctcccactrgcccctctcggaggagtctagggactcgaggagacctccaaagtaggggagggccagctgcgaagttttgactggggctgggaacacgtggctcccaggaggggcagcatctctgcccagcaggtggtagggtccgggggcttcagtctccctgggagatgtgggttcaggccctgaagaccccctggggtgcatgtcccctccccaacaagccttaaacctgtaggcgggttctgttggtggactccatgcatggacacctcacctgaaaaccaaggctcttggggccctgtagacttaggttgggcctggggtcagccttgggtgaggagcagcaaagtcagctccaacggctcccaaccggccgctctaggcccattccccacctcagccccaccttagggagagtctaggggccctgagggcctgtgtaacctgagctgtctcctccctggtacctctgccttcccggaaggagaggctggggcaggggygagtagctggagatttgctgggtgggggcagagggccctggagcaagacgttatggggatgaatggaggagcctgggctgggcccgccccctctgcctgccccacccccttggccctggtggagggggaaggagcctccccaggcttctgggctcaccgttctctccttaagcccagcacagtcctctgagataggaggtytcaagcccacacttcagatgggggatctgagccctggaaagctgctgacacctgcttggagccccccagccagaacagggtccagcgggggttagctgtgggaacctgggtgcctcctggctgcccccttatctggtcaactcagaggggccgggtytcaggacggagggcctgtgactgtctccttacctgctgccacacctcaccacagagggcctggctgagtgtccccagctgagattttgccgttctggcaggggaggctccaggtgccctgtgaacctcagaccacccccccacagcctgcccatgctgcgtggctgggggccacaggccccctctcagatctgtctcctctgtgggggcttattacccccgtctcgtgagtaaagggccagcctgtagtcaacgcccctctcctctgcctcagctgtgtggcttccctctgtcagcctcaagctgtctttaaaatgggcacagcgtgctggcccscctcacctgagactgtgagcttggcccgaggagcctgggaagyggccacagtttcagtggcagctgtgggctgtggtgctccatgcctcagagccagcttggatgagaaaccagccggcctcgcccagctcatgtctagcaatagaggtgaacccttcgcttccaaagtctcgagctctgagcagtgagtgcccgctgaggctgccagatatgtagaaagatcagctggtagacgtgagctggacgggtatgaccttggatgcctccttcatctgagagccgcgggtctgctgaccgccctggccgcggattgggcgtgtgagaagtccttgccggccggtctggagtggagctgcggttggrgcaaggcaggcaggcacaggaggtgcccaggcgatgaagccgcagctccatctgagggggctcactaaggctatggggcctggggctgggcagtgtgttctcaaggctgcaggccaggggctctcagggaccctctgtaggagatgcacattagctgggcatcccagawgggggtcggggtgaaccctgctgggcagctggagcaggcagagggcagggggaggttgtggccctcacagccccaggtgggcatcaggggatccctggccggcccagcctgggaaggtggggactgggcagccaggccagcatggtgactcattggaaggggaagtccttatcggcccttctgctgtttcctagctctgttctcacgggaccctccgcagcggaggtgggggagcctggttttcccaaccctgtcctctgtggctcagtgagtggccgaatggggactggaactgcctcccaataactggaccaacgctggcccaggcagggactgagcaggtgcttccctgacctcctggaagagtagaggctgacccttgacccgcaaccttccacccagcttccctctgctgctcgtgtgtctgggagggtcttgaccagcaagcagccttccctgggaggtccggctgtcccagccagagggcgccgcccacacctaccttctccaggagcccctggccccaccctgagcaggacctgtgtgcgccgtgctgtcattgagctcttgagtttgggggccaccatcaaagcttgcagtgcggcctgcgggtaggggtcgtggcgcttaactgggtgtcttcagttgctctagccccatccacgagaatgcttaggtggtgagctggggacacagcgggaataaggagggtgtggaccctgccactgcagagctctgggggaccccggggaggcccccagataattccaggtctcatacatgcagtaaaggaaatacagcagtggccacactgggggctgcagagctgcatcttgggtggtctggggcaaggtctgagatggggcaatccaaacaccagggcggggtcttgggagcctgtgggaggggtaccgggtgttgccctggtgctcagtggaggcagagggcacactctgggcgagggggttgggccctctgtaggtgctgggcctgggggtggggagaaggcatctccccagctcctgcctcctcctcctaggatgaggtctggccccccaagggaggctgggcggggtagggccgctgactttctcaaactcagattgaggcctctggggcctcaatcaaccccaagcctgggagggcgcctttgtgtggacaaacagcagatctggtttcctgggggrgcgggggagcagccaggacccagctctgccccctctcctcatccctgccccggctcccagcackacccctcccctgccaggatgcaggccaggattctgctgggagcctcctctcttccccactcacccatgcaggacaggcccccagcagatggcagkcccgggacagaagcggctgccaggctgtgtgtgtgagccattactcctcacggtggccccaggcaggtgcagccttatccccactctttggatggggacattgaggctcagcagttactgtgacttggcctcttcccaggactcggaagcagcagccaggaggcccaggcccacctgcygctgtccacacgtccactctggggccggtccccacaggcctccggaacagcttaattctgtctctctggagaccctaatccagaaggctgtgggcaagatctggaggtggggsggggtctggccgcctggatcccggccctgacggtccttctgtctgcagctcccccttccgccccctggcttgctgcattttgtccaagcctctctggagcccctggcagggccagcagggaggggtagccatgctttgccttactcctgccccttcttgctccctttggctctagacacattgatccaccttgtggtttactgtgagactcttcctgcccccagggctcgttgcactggcaccccctctgcctagagcacacccccccccttaccacgtagtgctcagacgccaccccgctagagaggcccaccgagattttcccacccaaggcagatgcccctctccaccctggtcttcctcttgtccttagcgccgtgagcagctcacatgagccacatcccctgagtcggaggagcagcaggtgcttggcgcatgtttgctgagcaagtggatgaggggcgcagaggctgggcgtggaaccagctcagtgggaccaggacttgtctcggggcagcagggtgactgtggaggaggaagggggccccggcccttctcggctatctgaccctcccgttccctctgcagggccagtactgygacatctgcacggctgccaacagcaacaaggcacaccccgcgagcaatgccatcgatggcacggagcgctggtggcagagyccaccgctgtcccgcggcctggagtacaacgaggtcaacgtcaccctggacctgggccaggtagggacccttctttgcrtgctgcagcccccatctctgtgtctgtgcccgtcgggcctaccttgggccacaggaccagaaggcgaggtctccaccgtgagcgagacctggggcctgggaggctggacacgaaggacttggtggggggagtccccacagggacaaaggcacggcagtggtcaccttttgtttgtgctttcagcgtccccatgacacagggaaagcgggtgctcatgggggtgtttccaaaggccacagagtttggttgcgggtgctgagtagacagcttggggctgggagggcggaggtgctgtgagcagtgcggtggtgccccctgcgtcaggcgccctgctgtttaaggaattcctggcaggtgcgggaggggctgcaggaatgcagaggaggctggcgcaagtggacattcctgggatacctgtgccgaggtggcggccactgagggttaggtggggtcgggtgcctgctctccrgtccccagctctgggctctccttggccttggaggcccctgcacaagcaggaggctgcagctgggtgcctccaagcgaagagtgaaacccccaaggtgggcctgcctggctgccagccctgagcacccccagattgggggcgacttggcccgggtacccagccttgaggtcctggcctgtaaaatgggccagtaatcctggtgcttcttaggtcagggacagtggtggggcaggtggaggaggctgggcctgagagcagccagtgcctggagtgggggccccagggctgacccagaggcctgcatcccagccggctcygccgctgccccagtcccagtgtgtgacacatcggtcttcacccctgtctgagcctctgtccctgccattgtcccgagggtgttagagatagaggaggtctccctggagcctggctggagggccggccccaaggggcaggcacctttggcagccttggtggtctgcaggcctggcccgggctgggcaggcagtgaggggagggctcaagctccaaaagtggcctggaatttccaggggttcctgaacttgcagagccctgtggagaagggcggggagctggggaggggttgcctgtcctgggctccctgcctgcctgccaggcccctagccctgccctggcctgggtctgggtgtggctttgcctgtttaccttcatctcactgggtttccccgcatctgactcccctgtcccctggagcctgggggtccctcatctctctggcacagcagcagaggcccccaccttggctgtagcgtacgtgtgaattctcagctgctcggggcgggaagctgggcactggcgagttcttcccgcctctcctcctttgagaaactagggggctgggctgggggaggggagatggcccagtctccacrgcaaccccagggtggctgcagagccagtgggcgcagtgcccgatgtgcctgggtggggcagggaagccgggactgacactcggacccacgagcctgggctccaccaccccttggctctggggctctctcggcctcggtgcacatgtatgaactgggctggaaacttcaggcctgaagccagtttgcttttagattgttctgggccagaaatcaggttccgccatgtgagcgtcttgcctctcacagcctcagtttcaccaactgtaaaatgatacggagggaagaggaaccctttccactccacctgggaagtggtccctccacccacccacccatctatccctccacccacccacccacccatctatccctccacccacccatccacccacccacccacctacctatccttctacccacccatccacccatctatccctccacccacccaccacccatctatccctccacccacccacccacccatctatccctccacccacccaccacccatctatccctccacccacccaccacccatctatccctccacccacccactcacccatccctccacccacccacctatcctatcccatccctctgcctgctgacccacccacccacccacccccaacgtatccacccacccacccctacccatccatccacccacccacccccctacctatgcagcacccaccctttattccttgtttccatccatctgtccacctgtctgctcattcctccctccacacctgcaccgtcttccttccttctcacccactttcctgaccacgtggatgtatctaccaaggcccctgtctcggcctaggccagggggctgccagccttggtcagggtgggggcagggactccctggagtggggtggggaaatgtccttcctgggcttcagggctgatcctggggcggggctggggcctccatcaggaagccaggctgagcggcgggtgggtccgggcactccccctgcagcgggctgccagcagcctttgttctgggatctggagcggatgccctgggacgggggtgggggcggctggcactgggcatcgggaaggcttcctgctcctggaaggctraggagggyggggtgggctgcatcacggttcggatctcatacccctggtgtgcggtggggcaggggctggcgcaggggaggggagactagtccctgtggtgtccacccagaagcagctgagcctgggcccccgggagtgccagctgggctcctggcctgggtcccgctgcgcccagccgtggaggggttctctctccaagggtggggcctcaggaagaggctccagcrctggtcactggtgactcagggggcagtttccgagttccagacgtgaccttccccagggggtccttctagggggttcttgcgtatctccttgcatcctccggaagcttctggaactgagcggccacatcactggcctcaggctccttcttccgagaaccacaccccaggccccaggccccaggcccagggaagggtgagcgcgttcatgactgcccaggcacatggccagcgggtcctggcttgagctcccccaccccctggctctgccgcagggtccaggcccttgccccactacaccagcacgctagcccagcgggcccaggttgtaaggagctgggcagggtgagtggggctggctctggcctgtgtcccctccctctccagtcggcccctgggtggcctgaccgtgggggcggggctctccccagcagaggagggcattgcctcccgcctccctcagatgaggagtgaggacgcacgggcccccttccggtagggaggcccctgctttgttctctgtagagcaggccacgctgcaggtgctacaggtggggtagcggctttgtcccagtccccgaggcccagagctgcagggcaaatggggaggcccaggtgggggtcaaggtgtgggggaactggggctggcagggtataagggggcagttaggcatgaggctagaagtattggttgggggcgagcagtgccaggtgagggcctgtgcccctggggatggtggagacccatgggagggcagagtggacaggtagggccggagaggggaggcagtcagctgtcccctccaagtgggggtacaaggaggcaaagctctgctgaagtcattggccactggagtgtgagtttccctaggcacttggggaaactgaggtggggttatgagagggtcagggccagtgtggagtgcccaaggtcccagtgctggggtctggaggactgtggggttggccatgctgtctgcagtctgggttcccgggctggttcctcctctgtaaatgggaggagcaccgcaggaggaggacctgccggaggcccagcgcgcccaggctgcctcacccttcaggactgcctgctctctggctggccggcttgggccctgggcaggcctactggtccagggtgccactggcttggctccctgggcctggttgggcactcagccatgtggccagtgccccaggacggtcagtgggttgtccagggaaggacaggaagtgcagctgcggccaggctctagttacagagctcggcggccgggacaggtgcacgggctgaaccagacgcagccacttgagcagggctccctggggggtacggcgggggtcctgggaggcaccactcccctcccctggcacaggatagacggcaaaaccctccctctacgtgtcctggaaggaggacacggcccaaggggctgccatgccaaggtggggatggggccgctcctctccccgcacccccgcgccatgcttgcccttggtggctgcacggccagacctggcactcagggcacagagatgccccagcacccacctagaccccccaggccctggtggtccccaaaggcttcctgttttctgtctgtttctaaacaagagccaccacattggcctctgacaacacagctcagtgaagacgaaactgtttgggtttcaggccgaggggtccccttgggataatctccacttcctgtgtccccggctgaccatctggcctgacctgggctgggctgcagggagggagcctggagcttgggctgcagtggttggggtccctgaatccaccccaggcccagctctgttgaggtgcgggcagccccctggctgggaacccatcctctccctccagctggggagctcctgtcccccygcccactcctggaagttttcctgtcctgcttaggacatctgtagttgggcatggcggcgtccaaccccagagttgggggttctggcctcagagttgttatttttcttcccagcggtgggcttgctgtggaaacccccggcttttccactccacgtccctctgggagaggtgtctgtgtggggcacgtttccggacccytgataggttgtgtggccgccgtgcttattcacccagctgggggccagtggagatgctcccggctgccgccccgcccctgctgtggggcttatctacgtttccagatggggtctcttcgaggggaggcacacagcaggagcgggcaagggctgggctggcccaggactctgggcatcgagggggctgggtgccccggtgccctgtccgagcagtgcgrtcagggtgctggcccggacgcctggggctaggaggggcttttcctgccccgggaattggcacaacgcccttcttcctgcagggcgggggctgagtcacagaccgctgtgatccaggctgccggggaaggctgactggccctcacccagcacagcgggcacctggacctggccctggtctccccaacccaagatgggtcagggcagagctgggtttgggcacaggacagcaccgcctcccctcctctggaggttccagccacagcccaccccatggtgaggtgggtgcctcagcccaggaggctgctagccaacaaccccacgccatccccagggtccccgaaagccccaccagagtttctctgtagtcctcaccgtgctgcccagaccctagcacctactcagtcccctccgcagctttgccttcggagcgccagtgagtggggcagctccagtgggggcctctcagcgtctctgcggggtggctgctgccctccaggagcagctggcgtcctccctcccagggcgctcaaaccttcatgccctcatgaaaggcattttatcctgatgcccctctctgcagctcttcccactgccctgtgcccaggaaggggaagtgtccgctccagggccrcacaacccctgaagcctggagccggcctgggccctgggtcctgggccccgtactcctggggctcttgcccacccsctgtgaggcagtggtcaccgggcagaggcctcctctgggaaccgtggccctcccagggcaagctgggtagtggggactggagggtgcagtggctgagaggcgggtccggctgccgtcctggagacgtgcctgccccaaaatagccgatttttaaaaataactcaggcagcttttgtttggcttttgctttaaaagacttttttttttctttctgcacagaaccatgtagcagcggaaaggtcagcactggcagctgagctgagcggggcgtggagggggaagggcggtcccgaagccaggggtctgcgctcgctccgggtcatggcgagggcggccggtgtggccctgggagccgcgaccaggtcagagacagatgggagtcctccagcgcgggcttcccttcctgtgaccatctgtgcagccaccaggccctcgaggacagctgtccagggcccctgtctgacagacagatggttgggatgggggacagacaggaggccaggatcttcctgtgcatcccaggggtggggagggcgaagtgtctgtgtccccctcatcctgctgatcagtgtcttcaagtcaatatttgtgcaagtgctctcagctgggaaaaatgtgactggcctgctgaaggggagggaggaggacagatcgggccgaggrgagcgcagcctccatccaggcactcagggaacagcgggggcggctcccagggggctcagtcgggacctttagtctccttcggagcctttggtgggaggggctgtgttgccagctccccgagaacagcctgtgtccctgcccctgtccacctctagcgggtccttccctgtccaggcacargggccactggcccccacctggggctctctggaatgcttgtggtcaggcccacagggggctgctgaggcccrggtgtggggctgggtatagggtctgtccctgaagaggctcatacccctccctgctgggcagggcatgtctccctgccccccacccacagggaggtagacgatgacctcagagcctggcagccggtgaataggcctgtgccccgccccmaccccggaaggctgcgcttggctcccacagtccccgcaacrccaagccctccgagaagggtgggatttggacctgggatgtctggagtcctggaaccttgccccctacctggagtctgggcagctggtgcccccaagggctgaagctatgaggggtctgtggtcttttcatgggggaccccacagcagtctcagtccggctcagtccagtgggrtgactgtaggtcttgtgcagctctgggggaccccactctccyccttggggccctaggcttccaggcctacctggccaacagcacccagctgttcccrggcgtacctgctgtggggagaaactctccggaggagtgggcactggcgggtcagggtcccgaggaggtgtggtgggtggccctggggtgtggcatgaccctcggaggcctgctggcctttttagggcccacctgggkgcccacctgtgagcagaggaggggytggtccccactgccgcccacaaagagttgggctgagtactgaggtytcccaaggtctccatcgtggaccctgtgggccygtcaggggaggtgtgggccgggacaggcaggccacacytgtgctgtgggtccatgagttgcctctctcccccggcacccgggcctcctcgcacaggcsggggagaggttcgtgtttcctccgcctccctgccaggtccctgtggagcctctgcctgggagagccctttcccctttgtttgagaggggctggggaggggctcaccctcccttggagcctccaggcttgtgacagggcctggagacaacttccctcctttgcccccaggtagggggagccyagggctcccctcagaggctatggcgggtgggagcacttggctgcagcaggggctgagccctggcttgcatgagtgtgaaggcggggtgctgcttgggcaccgccccctcctgtgtgcctcgggaccccccctgctcctgggtgcagcctcttgccattgaggccatgggctgtttttagggaccagagaccttttcagagggggcctgtggcctgggtccatggaggagccacccccacggtgtttcactgttgggcgggtgtgtgtgcacccccaggtgcaggcatggaggcccacggtcatgtcgggtgggtgcagatatgaggctgggtagcactgactgctgggggcaggagaggctcaggcctggagtcctgagggcagggtgtcaggggatgggtagggagggagggagggagggagggagggaagcccaggctgatcagaggcctgaggggagtcagcaggcctggcctgtgcggagagaagggcctgggcctggggagatgtccgcagctgagggttagggggaggggctgcagtcagggaaggcttctctgaggaggtgtacaaagcgtcctgtgaagactgagccaggctstcccccagccccgaggcacagacacatgggctgtccctgggtggaggtcaggctgacacacggggagaaagtaggcagagccaaggtggggctggggcaggggcttggggtttcggrggcctgggaaggagcagctttcctctgccckgggcagggctgccctgacgtgcaccgggccacagcagtgctactgccccagtgcctgggctggtggagtctccgaggcagactcagcttcaagagggcccccagcctgcaaggctgagccccgcttgctccctgcagcccagtccctgggggctcagtgggcccctggctgtgggctggtcagcatgggastgagcagagcctggggaggggtgcccggtgtgaggtgggggcaggggccccatcttaggagctgctgacctgtcagagggactagggggttggacctttggacctgcctggtggcagggaccactgtctggccaccaggcctggctggaygtgagggctgtggggacactggggtgtgttcctgcctccaccctggccagtccctgcctgggccgcaggtaggcctctccctagcttgctccatctgcagccacagagcttgcaggaccatgggggaaccccaaactcctgcggcagggaaggggaggaggcagcgcgttggtcccgagcccaggcggggagcccttccaggagggctggttcccgggggctcatctccatccctggggagccctctcccctgggttcgtctgccccacacaggcaaacccagaggtgccccctgtgcggcgagggtgccacatcccctgctgtggcctcacctgaggggcagaaaatgagccaggcccctgggagcatgggaatccaggcgcccctggctcccctgacgccctctcggcccacaggtcttccacgtggcctacgtcctcatcaagtttgccaactcaccccggccggacctctgggtgctggagcggtccatggacttcggccgcacctaccagccctggcagttctttgcctgtgagtctctgccgccgtggggcctggggggagaggcaggggggtccctgggcaggccctccgtgaccaggcttctgaaggtctccraatacccagccctgccctcacacccggctgctgcggtcatgactgtcagacgaggacycgaaggctcatggggatttattggctcctgtccctggcgtcgggcacagccaagtccaggggctgtggcgccaggaatctctggtgccatctcttggctgcctctggatggcttcatgcaccggcagctcccgtggtgacaaaaggggcctggcagctcccacytcrcctcctgccagcctagccacctgcgtcaagagtactggagtcctagcccggatgctggccgtccctggccccgtgccaccctgaccagtcatgctggtgggagtgggtgctcctccccaatagggcaggcctggtcacgtgtcccccaaaattccctggcctgagaatgkgggaggggcgggtcagtgatgggcagtargcgtctgtccccaaggaagggggtgaggatggtcgtcgaggggggtcactcgcactcaaagcgtgcaagggagagcggtggggggcagtgcagtccaacgggccaggccccttcagccagtgagctgyggtctctgtcacrcggcctcttggcctgtgggagcctcagtggcaaggccsggagacgtcaaggggccygggcacygcggggacccaggcttttctggtgatccagcgccctcccctccygccattccccgcagcctcyaagagggactgtctggagcggttcgggccacagacgctggagcgcatcacacgggacgacgcrgccatctgcaccaccgagtactcacgcatcgtgcccctggagaacggagaggtgggccggggaggggcagggcggtacgggggctggagaayggagaggtgggtaggggaggggcagtgccgagcggggctggagaagggaaaggtgggcccgggaggggcagtgctgagcaggggctagggccacactggcgtcaccgcatactgcccacagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccgggtgagctgcccatggcgcaggcgggggagggggactggccgggtggacccgggactcagggtgagtgaggcctggccgcctggtgctcacggggcctgcgggtgcagtattattacagcatcaaggatatcagcatcggaggccgctgtgtctgccacggccacgcggatgcctgcgatgccaaagaccccacggacccgttcaggtgaggccccattcaggtgaggccccgttcaggtgaggccccccccagctccctgcctgtccttgtcacccctgcctaacctgagggtgggtgacctggttccatggcccaccacaaccctgctgtctgtgtgacctgcactgaccaccrccgtgtgcctcagtttcctcatctgtgcagtgatgtggaggccagggcatgtgcagcctccccagggtgccctatcttggtttggggggccttgccctactgccagcagaggtggggctctccggacccccaggccagctggccttcccaccatagtggacacctggggccctgtggaggggagtcagcaatggggatgattgatccccgactccaagactgcatcccccggaatggacaggtgcccactacctgccgaggcagccctaattcactttgggggtgcccgcccagctcccccaacctttcaggacacaacagacaacttccctgctgccccagccctgaccttcactccagtcaagcagggaccaaggcccaggayggggatggcagggtgggggcagccaacaccccacatctgctgtgccctgtgtgcctgctttcgggggcagccgagggcactgcagagcatccacctcccgggagcccctcacaggaygggcagcagccctggtgctggcaccggcacattcctgggcctcacccagagtcctcagtaaggtagggccgggctcattctgcggagaagcaaccccagggcacgtccgtcctttcctccctccctkcgttggttctttcagccagcagctgtatgttgagcgcctaacacacgctgggccgttttcctgggaatgggaacacagggtgggaccccagcccggcctcaggagcacctgttccggggraggcagctgggaaacacgcaaaccagtactcagcgtggtgcccggagggtgtaacaccctagggtggcagtgcaggcatggggctggacagaagccactcagagtggtgcagctgaggctgagtgtgtgacgaggctcctggacccccagcagggagctggcagggctcatctagtgcctgcaaccgagcagcccaactttcatgcgcttggatttgggacccgcccttgccttctgtggggccttactgctctgtccacgctccagtttacaggggaggtggggaggcgggtggagctcagacaggacaaaggttcactcccattctcacggccagtgccgagcagaggcgggagccctgggccccttcggatgtggctggtgggtctgaggggaggagtggcacagtcacctgagccggaggacttgggctgtttgccaggagctgtgggccctggggacccacccaggcacttgttgctgccagcacagcttcaggtgctgagctccagcagagctaacttgtcctgggaaattaagtgccaagtggggacgcagctcgtgacagcagggagtggaacccaccaggcagccaaatgggcctccaaggagaggaagggcgcgggagccggggcttgccttggcctgcagggaagacattgccatcccctgactcaccgcacctgggtgtggactgagctcagctctccctgcaggtgcaagcaggggtgactgggaatctttcatggaaccacagcctctgttaccaggacctggtcacccaccagtgtcccaaaacattagcctgcccatgttctccctgcaccctttacccgccaccccacctctcctccagggaagggggctccatgtcatcagccagcaattttctgcctctttacctccaccatcaccttactcccacccaaaccatcacccccactaccagcccactcccaccatcatcacccccaccatcaccgtcatcacccccaccatcaccgtcatcacccccaccatcaccgtcatcacccccactcccaccgtcatcacccccacccatcaccacccccaccatcaccatcaccatcaccatcaccatcaccatcaccatcatcacccccatcacccccaccatccccatccccatccccatcccctgggttgctgcttcctccttcctgaaatgcaccctgtagtttttctattccatgacagtctatccggaattgtctgaaaacggctgttttgtcctccctcttgaatgatagttgagctgactgtaggattcgtggttgatagctgcatctctcagcactttggagaaatgatttgactgtctcttcacctctccaggtgcttgggagagtccattgtccttgcagttgctgatcctctgtgggtcatcttcttctccaggactttttatggtctttttgccattggtgttctgcagatttattgtgatgtgttgaggattgggatttttttcttgctcaggactcacgctttttttttttttttttttttttgagatggagtctcactctgttgcccagactggcgtgcagtggcacgatctcggctcactgcaagctccrcctcccgggttcatgccattctcccacctcagcctcctgagtagctgggactacaggcacccaccaccacgcctggctatttttttttgtatttttagtagaaacggggtttcaccatgttagccaagatggtctcgatctcctgacctcrtgatccacctgcctcggcctcccaaagtgctgggattacaggtgtgagccactgcgcctggccatgtgttcattattaattcaagaccatccttggccattctttctgactgttggctccctttcctacctcttttcccctggagtccccattagatacaggagcaccttctggtttccttctcataatttctatttcctctctctttatcttctgaggtgtcttctggatagcttcctttgctcctcttccacttcactaaatctctcttccactgtgtctgtctgctgtttagcccatccattgagtctttaattttatagtttcatttttcatttctagaagttctgattggttctttttcacatctgcctgttttccatagtgttattttttttattattatgttttagatttcttttttattttattttattcttttttgagacagagtatcacactcttgcccaggctggagtgcagtggtgcaatctcggctcactgcaagctccacctcccaggttygtgccattctcctgcctcatcctcctgagtagctgggactacaggcacctgccaccacacccrrctaattttttgtatttttctttagtagagatggggtttcaccttgttagccagatggtctcratctcctgacctcgtgatccacccgccttggcttcccaaagtgctgggattacaggcgtgagccactgcgcccggcctatgttttagatttctttatgaccatttttaacattcttccctggcttctactagattactccattttgtgaggttcttggggctctttctgctgacctgccacattgtttctctgcaaggtctttagcagggtttatctttgtgcttctggcgtgccctgggattgggatggttttgggagagcttttgctatacaccccagggtatcgccagcccggcaccacttttcctatcaatttcttgacyatgtggatttttgaaaaatggaacaccagttcaggcccttgcttataggtacttggrgctggtgtgacgacagagcagcttctttgttgatcacctgtgctgacgggcagtttatttcccaattcctctcattgagggtatggccctcccagatgtttctggattctgagggaaagcagtattgattcccgaggccctgtgaggtgggccccgtggaggacaggactagagctggaccatttgaggctctgggtctaatcctcatggactggactgacttctggggtcctgctcagggaacgcacggccctgcagcctccggcagagcctgatctggggcagggactcccgctgtggtctggctaatactgagcagtaggtgcttccaacctcaggccttgtctctctccagctgtcaccctgcccacgggacgtaaggcaagattccagccctgtgacttagtgtccaccccagctggaagaaggaagcagttcttggccacttggccctagggaggtgaccaggatgcctaggagtcctgcctgctaagcgaaatctgagccttggggggtgcaaatggacccctttcccttctggctcagggaggttttgggcttaygctcgagtcctggccgaagtggaaagggcataactcagttttggagaacgcaggtctccatcctgacctgcaggcaagggggactctactgacccctgaggtgccctgtcctaggccccacccggtcagtgcacacctgctccccagtcccgcctccacaaargccctgtgagaccctgtcctccaccgcctctttccttgtgtccattccctgagcctggggaagttgcgtcagagccacargctcggggacgctgagtctgggcgagcgcttgctgccggacagctggagaaacagcagcggggggccgtgtccatgtggcaagccaagccatsgaggggatcacargccccttcagggaagggactgagcacctgccacctgcctccaggatgggcctgatcccccctcctgtgtaccccacargctgcartgcacctgccagcacaacacctgcgggggcacctgcgaccgctgctgccccggcttcaatcagcagccgtggaagcctgcgactgccaacagtgccaacgagtgccagtgtgagtgcctcctcccacacacgtgtgtcctgcccacaccctggcccatgagagggccccggtgcccgggccygtggagggcgtgccaacagctgcgctcccctctctctagcctgtaactgctacggccatgccaccgactgttactacgaccctgaggtggaccggcgccgygccagccagagcctggatggcacctatcagggtgggggtgtctgtatcgactgccaggtgggctgggctagagkgctgggaatgggctggcccygaggtggggcagggacctccccagactcaacggccattgcactcccagcaccacaccrccggcgtcaactgtgagcgctgcctgcccggcttctaccgctctcccaaccaccctctcgactcgccccacgtctgccgccgtgagtgggctcagctgggcgggtgtcctgggtctcagggtctgcctggaaagaggtgttcttgggcctttggggctgctttggaggggatgtcctgagcttccaggccagcccaggaaggagcctcccaggccacggggcgggtccccagccctcatgtccccccagggggcctggctgtagccctcatccccatggccctggctggggaggtagagactgccacatcttggagccyaccccttgagtcctggtagctccaggcttacccggctcctgcccctgcccaggctgcaactgcgagtcygacttcacggatggcacctgcgaggacctgacgggtcgatgctactgccggcccaacttctctggggagcggtgtgacgtgtgtgccgagggcttcacgggcttcccaagctgctaccgtgagcacctgccaggggcatccaaacagacaccactgcctgctggactccgggagccctgcagggggtggaggggttccccgggayggaccrtgttatcctgcctgcatctccgattgtgctgagagaccaagggtggcagggggtgtagggtgctagggttctgagcagacctggccaacatgcgtgtctcttcccctcagcgacgccctcgtcctccaatgacaccagggagcaggtgctgccagcyggccagattgtgagtaagtgtccttgaggcccccaggtccccggcctgccctggagccatgggggcggcttcacagaaagttcctggagaaagggaggattttcatttggtcactttatttttggcttatttctttttatgcaaattatgcctattcacactggaaaaccttcggaaatataggtcrgcataaagccaaagaaaaaagttagcccaggcaacatggtaaaaccctgtctctacagcaaatacaaaaattagcygggtgtagtgatgtgtgcctgtagttcgagctactccggaggctgaggtggaaggattgcttgagcctggaaggccgargctgcagtgagccatgatcacaccacagcactccagcctgggcaacagagtgagaccttgtttcaaaaaagaaaactgggcatggcacatgtatacatatgtaactaacctgcacaatgtgcacatgtaccctaaaacttaaagtataatwaawaaaaaatagaaaaaaaaaaaaaaaagaaaattggttgggcacagtggctcacgcctgtaatcccagcacttcaggaggccaaggcaggtggatcacctgaggtcaggagttcaaggccagcctggctaacatggtgaaaccccgtctctactagctggrcatggtggcgggcacctgtaatcccagctactcaggaggctgargcargaaaatcgcttgaacccgggaggcggagcttgctgtgagccgagattgcaccactgcacccccgcctgggcaacagagcgaaactccatctcaaaaagaaaaacaaaaacaaaaagttatccacaattcccccagctctgcacagcgcttgaatgctctctgtacacaagcacttctctttcacaagcttcgtcatgcgctctgcaccctgtcctgtgattacrtcccaaccacaatcctgtaaacacattgtcttgtggtccatttcatagggactaatgaagtatttatttaaacaacccccagtggttggaaatctaggttctttttttttttaattatgctgtgataaagcattattaagatgaggtagaaaactggccsggcacagtggctcacacctgtaatcccagcactttgggaggctgaggcaggtggattacctgaggtcaggagttagacaccagcctggccaacatggtgaaaccccatttctactaaaaatacaaaaattagccaggcgtggtggtgygtgcctgtaatcccagctacttggggggctgaggcaggagaatcatttgaacctggttgcagtgagctgagaaccaccatcacactccagcctaggtgacagagcgagactccatctcaaaaaataaatttaaaaaaaaagagtctcccagcatacagtcacagccacagagcagcatggcacctgctgaccaaatcattgccattaccacatagcagtctatcactcttggcttgatagacaaaaaatattctcaagtcagagccatgttcccttgctttttagtgtttctggaattgggatgcgtcttttgcttgatggcatatcacagtctagttggtagggtttttccctttcatgacgggacatacaagcatggcatctttccyagtgagtggggtcttagacttagattgtatttgatatgacgtcttttttttttttttttttgagatggagtttcgctctttttacccaggctggaatgtgatggtgtgatcttggctcgctaccacttgtgcctcccaggttcaaacgattcttctgcttcagtctaccgagtagctggggttacaggcatccgccactaagcccagctaattttgtatttttagtagagacagagtttctccatgttggtcaggctggtctcgaactcccaacctcaggtaatccgcctgccttggcatcctaaagtgctgggattacaggcatgaaccaccatgcctggcacgatattgtgtcatttttagctgcactttgactactctgtaagcttgaatcttcttgacttttcgagtgctttcttttttttttttttgatggwgtttcactctagttgcccaggctggagtgcaatgctgcaatctcagctcactgcaacctctgccccccgagttcaagtgattctcctgcctcagcttaccatgtagctgggattacaggcatgcgccaccatgcctggctaatttttgtatttttagtggagacggggtttctccatgttggtcaggctggtctcgaactcctgacctcaagggatctgcccgcctcagcctcccaaagttccgggattacaggcgtaagcctctgcgcccagcctgtatcasctatttcttataagttgtgtgtttttctcctgatgggtcatttgccccttattttgggggggagcttttttccgtgtcctgattttgtaaattttgaggtgaatctgcccacgttgttctaccgaatctctggctgagtcggatgtagatgctcctcccttacccaggaattctcttgtctgctggttctgtgatggtttttttatgtggaaatgtttagtttttcatcaatagtgtaaaccaggggtcaacaaactgtcggaaaaggcccagacggtaaatgtcatagactgagggcygtgtggtccctgtggggaaactcctcagctctaccgttaccagctgtagcttgcaagcagccatagaacgcgtattcatgagtggggttggcggcgttccaataaaactttatttacaaaagcaagcgaggagtccatagactagtttgctaatcsctggtgtaaactgacaatttatcttttcgctactgggccatagtaagcactcagtaattacctgtggctgtacagtattcactttcaatgtgttcattacaatgaattgtattgtctttcctaatggggacacagtgttgaacatcaatattttattttgtctaaattcacaagtgagattgttttggttttgtaaaatacttgggaaatcatccacacttttttatgctcccaatcagtttaaaaatcacagaaattatttacttgttaaaagtctggtcaaacttacaaaaccctttagtcctgatacctgtttttcttttcttttttttttgtttttttgtttttgtttgagacggagtctcgctctgtcrcccagactggagtgcagtggcacgatctyggctcactgcaagctctgccttccaggttcacgcyattctcctgcctcagcctcctgagtagctgggactacaggtgcccgccaccacgcccggmtaatttttttgtacttttagtagagatggggtttcaccgtgttaaagcaggatggtctcgatctcctgacctcatgatccacccgtcttggcctcccaaagtgctgggattacaggtgtgagccactgagcctggtctctgatacctgtttttcaacagagatcttaaattaaggttttaatgtattctgtggctattgtattcaattttctacctcatcttttttttttgagatggagtttcactctgtcgtccaggctggagtgcagttgcacgatctcggctcacttcaacytctgcctcctgggttcaagcgattctcctgcctcagtctcccgagtagctgggattacaggcacctgccaccacgcctggccaattttttgtatttttagtagagacggggtttcaccatgttggccaggctggtcttgaactctgaccacaagtgatccacctgcctcggcctcccaaagtgctggtattacaggcatgagccaccacgcctggccagttttcttcctcatcttaagtcaggtttgattatttgtattagcaaattgtgtattttgtttggattttttaatgtattgacataaagttatgcacagtggcctgttataaagttaaaatttctgttcatttctattctcgtctatttttatttttattttctttcttcttctttttttttttttttttggttgatcagacctaacagaggttcgttgagtttattggtctgttcgaagtacaggtgcagttctcttgataagacctgctgaggtttttctttctttagttgggaggagagattttcctttctaatattcaatttctttaatccactttctttgatttatcactttttwaaaatagcttcttgagttattatttttagtctgtcttcattcccaacaaaaaggcttaaagcagtggttctcagccagtggtgactttgakgcacaggaagcattcgatgatgtctggagacatttttggttgtgacgattgatggatgtaactgatccagtgggtagaggctagggatgctgggaacctcctacaacacaggactgctcctgcacacataacaaagagttatccagcctggactgtcagtagtcctgaggctgggaaactctagtttaaagctataaattttcctcagagtatacctttggctaggtatcttgtagtttgagatgtggggtgtcctcattgctgtgttttttttaaatagtctatcatttggggttttattttctttcaacccgtcactgttcaaggtgctgaggtttccctcctgtccttttcgtggtgtgcagttctggttttgctgcatcgtggttagacttggcacactgatagtttctgccttttgtctttggaatttgrgattttctttgtttctaacctagaatgtgacgayttttattttttaattttatttatttatttatttatttatttatttatttatttattttgacacagagtctcactctgtcacccaggctggcgtccagttgcacgatctcggctcactgcaaccaccacctcctaggttcaagygattctcctgcctcagcctcccgagtagctgggactgattataggcgcccaccaccatacttgggtaatttttgtatttttagtagagatggggttttaccatgttggccaggctgatctcgaactcctgacctcagttgatccacccacctcagcctcctaaagtgctargattacaggcatgarccactgcgcctggcagtttctgccttttgtttttggaatttgagattttctttgtttctaatccagaatgtgaccacttttagattgttccaggaacattggacaggaatgtgtgttctctatggagtaccgatttggcatgttaaagcarrcttgtggccaggtgcgatggctcacgcctgtaatcccagcactttgggaggctgaggtgggcaggtcacctgaggtcgggagttcgagacgagcctgaccaacatggagaaaccccgtctctactaaaaatacaaaataagctgtgcatggtggcgcatgcctrtaatcccagctactcgggaggctgaggcgggagaatggctcgaacccgggaggtagggtttgcagtgagctgagatggcgccactgcactccagcctgggcaacaagaacgaaactccatttcaaaaaaaaaaaaaaaaaaaaaaacaaaggaggcttgttcattatgctcttcaaacccacagtacccttgctcaatttctgtccctctgagctgtcacagtctacctatgtatctccatccagtctttgtctctctctgactctggtttgccaaattctccttgccattttaatagttttagcttccctcacctccaggacacgttacctgctcctagagattcgtttctgctgcccgttgggtgacatgcctgagcttccctctgtctcgttaccgctgtgccttccgtcctcactcctctgtgtttgcgtccaccccagctccctgcacacagctctcggtttaccacctgtctgaggcgttggtttaaggtacgctctttcaagaggctatggctggagtttcctcttggtcacgctgacgtcttcggtttttatctcatgaaggagacagcscagccccacgatcgtccttgcctctgtcagttctggctggctcctgcccttgtatcatttctccttttctgctgaaacatttcctttcctgactttcacaagttagagcaagaaaacgtgctttgattttggtctgtttgtttttgctactgtttcctctctggggagggtttgcaagctctctttctgtgttctggtctgaccagtggttactcttacatttttgacaagtattgaacctttatttttctatcagtaacaaaaactgaagcgtgctcacaaccctcctttcatgcgtaagttaagacatttgatacattctttctaccttcttcccaacacctgacattgtttytaaagaaactataattttaatcccagcactttgggasgccgaggcaggcggatcacgtggtcaggagatggagaccgtcctggctaacatagtgaaaccccgtctctactaaaaatacaaaaattagccgggygtggcagcgtgcacctgtagtcccagctgctggggaggctgaggcaggagaatggtgtgaacccgggaggcagagcttgcagtgagcccagatcgtgccactgcactctagcctgggcgacagatcaagactccgtctcaaaaaaaaaaaaaaaaaaaaaaaagaaactataatttgttttgcagcttgttttgagttttgatttgtttgtattttctcttygtgttaatgcttgcagctaactaggaatctacgtaasaaataactaatgaagcgttttgatagttggcctgactttgttgcacatcactgttttcccaaacacgcctctcccttgttggaatttttttttttttttgagacggagtctcaccctgtcgcccaggctggagtgcagtggtgygatctcggctcattgcaacctccgcctcccaggatcaagcgattctcctgccccagcctcccaagtagctgggattacaggggtgcaccactacgcccagctaatttttgtatttttagtacagacagggcttcactatgttggtcaggctggtctcgaactcttgacctcatgatctgcccgcctcggcctcccaaagtgctgggattacaggcgtgagccactgcacccagcccttgctgggatttttattattttattttctagttagtgttgtgtaaaagtgtaagaaaatgagtttgtggagagggaaggtttgccaggaggggcgtactggggtctgcagggcatctgagactcccctgcctgtccccaccctscagattgtgactgcagcgcggcagggacccagggcaacgcctgccggaaggacccaagggtgggacgctgtctgtgcaaacccaacttccaaggcacccattgtgagctctgcgcgccagggttctacggccccggctgccagcgtgagtcccctctccccgctcaacctctrcctgcgctcgaggtggacacctgaggcctggtgcctctgaccaagcatgtgggccaccctttcctgcagcctgccagtgttccagccctggagtggccgatgaccgctgtgaccctgacacaggccagtgcaggtgccgagtgggcttcgagggggccacatgtgatcgctgtgyccccggctactttcacttccctctctgccagtgtgagtggtgcctctccacgtgggcgtgggtaggggaggcccgtgggcctggcctaccgtgacacccgctccgctctgcagtgtgtggctgcagccctgcaggaaccttgcccgagggctgcgatgaggccggccgctgcctatgccagcctgagtttgcyggacctcattgtgaccggtgccgccctggctaccatggtttccccaactgccaaggtgagcaragggtcagggcaggaaggggttctgccacccacatggcgccagggcytgaccccattgtccctctgcagcatgcacctgcgaccctcggggagccctggaccagctctgtggggcgggaggtttgtgccgctgccgccccggctacacaggcactgcctgccaggaatgcagccccggctttcacggcttccccagctgtgtccgtgagtgcctagggaggaagtggtggggaggcaggtgcagtctccactgcgtgcccacagctatcyttgtctgcagcctgccactgctctgctgaaggstccctgcacgcagcctgtgacccccggagtgggcagtgcagctgccggccccgtgtgacggggctgcggtgtgacayrtgtgtgcccggtgcctacaacttcccctactgcgaaggtgagcaggcaggtggctgtgtgcaccaggtgccgggcctgtgtgtgggtctgtgctgttcacacgctgcctgccttcctgtgaggctgttcacgtgcatcttgctgtgtgtactgcgactgcgtccccacgctctgtgttcgcacyttgttcacatgccgtgcaggggtgtccgcgtactgcccgtgtctgcgtgctgtgcatccgcgcctgtcgtgtctcgtatgggtgcatgtgttgcgttctgtgtgtgtacgggtgtcatgtgttgcttgtgtgggtgtgtgtgtcacctaagtgtgggtgcctgtgtcacgtaagtgggtttgtgtgtcacgtgggtgcatgtgttgcgtgtcgcatgtgggcgcgtgtcgcataagtgggtgcgcgtrtcgctatcgcgtgtctcaagtgtgggtgtgcgtgttcatgtcctttcacgggcgtgtgggtgtgttagtgcacgtgtagtgggtgcatcttcacgtgcgtttgtgtgcttgttcagacrtgtgtcacacactgcgtgtggaatgtacacgggtaccccacgcggtgcacgtttgcgtgcatgtccatgagcaggtgctgtgtggtgggatggcacgtccgttgctgcggagggagcagggaggtgcgtgttttcaggccgtccatgtggatgagaggyacctgtgctggtcctcagctcctgtgggaccgtgggttctggctgggcctgggacacccttggccttccgggttggtcactgggaaatgaccgaggcatggtcctctcttcacagctggctcttgccaccctgccggtctggccccagtggatcctgcccttcctgaggtgagcccaagtctgctcgtgtgtgggagatgggtgaggacccaggccaagctaaaagtcccgagtccggtgagaccagggcttcctgcctgctgctcagttgccatggcaaccccagggcctgtctgctccttaggctggtcctctgcccccactgcaggtgactcctgtgagtcacaggtgagggccctcagccctcaccaccccttgtcagggctctatggctctatggtttgtgggtgggagagcagggcgcccgctctgacctgcagtcttgtcctctcccaggcacaggttccctgtatgtgccgggctcacgtggaggggccgagctgtgaccgctgcaaacctgggttctggggactgagccccagcaaccccgagggctgtacccgtgagtgtgccctggagtattggggtacaggggttccttggggaactgtgcccacaagtatatcctggagggagtgttggggtgcagggttcctggaggggctggagccagtgagtgtgccctggagggagtggtgggatatggggttcctcggggattgtacccatgagtgtgccctgaagggaatgttggggtgcggggttcctcaggggggctgcgagtgtgccctgagggagtattgggggtatgagggttccttggggggctagagcctgtgagtgtgccctaaagggagtattggggtataggggttcctcggaggggctgcacctgtgagtgtgccctggagggagtgttggggtgtggggttcctcaggggatggcacccatgagtgtgtcctggagggagtgttggggtgtggggttcctcgggattgcacccatgagtgtgtcctggagggaatgttggggtgcaggggttcctgggggggtactggagtccatgagggtgtcctggaggaatgttggggtgcagggggttcctgcgtgggactggagtccatgagtgtgccctggagagagtgttggggtacggggtttcctcggggtgctggagcctgtgagtgtgctctggagggggtgttagtgtgtgggggttcctcggaggggctgcacccgtgagtgtgccctggagggaatgttggggtgtggagttcctcaggggattgtacccatgagggtgtcctggagggagtgttggggtacaggggttcctgggggggggctggagtctgagtgtgctctagagggagtattggggtatgggatttccttggggggctggagcctatagtgtgctctggagggagtgttggggtataggggttccttggggaactgtacctgcaagtgtatcctagagggagtgtcagggtgcaggggctcctgggggtgctggagcctgtgagtgtgccctggagggggtgttagggtgtgggggttcctcggggggctggagccaggctctcctgccccaccaagcatctgagtcctgccctgctctccccaggctgcagctgcgacctcaggggcacactgggtggagttgctgagtgccagccggtgagtctgaggaccaaggtgtgggggatttgggggcacactggtcaggaccctcccctgccccacttcacctcctcccttggcccccagggcacyggccagtgcttctgcaagccccacgtgtgcggccaggcctgcgcgtcctgcamggatggcttctttggactggatcaggctgactattttggctgccgcagtgagtgcccactcgctcgtcccagaccacagccctgcctcccctcggtttatgctggggaacccaaggcccggagggacaagtgcagcctgggcagcatgargcccgggtgatggatggctgccccttggtgccagcctgtgccagggtrtgggagagggggtgcagctcccacccagatgcgtggcttcctctcccctgtcctacacctgggcagacggcactaacagatcccagcgccctcaccctcgccctcgccctcgccctcgccctgagccctgagccctgagccctgactctccatcatccagagagccccaggcaggcttctcagtctggctgtgaggggcccctgaggctgggtgggggccaggcagcctctgacctcccaccttctccctgcaggctgccggtgtgacattggcggtgcactgggccagagctgtgaaccgaggacgggcgtctgccggtgccgccccaacacccagggccccacctgcagcgagtgggtaccccttccccactgggtggtggggagcggggcaggcagcttgtcctccgggcmtctccgtgtccctcaccatgggcccacgtgaggcctcaccctccctggagayccggggccgctgtgcagggctaggtaggatggccaagctgcacctgaccagcccctgctgtggccaggcctgcgagggaccactacctcccggacctgcaccacctgcgcctggagctggaggaggctgccacacctgagggtcacgccrtgcgctttggcttcaaccccctcgagttcgagaacttcagctggaggggctacrcgcagatggcacctgtccaggtggrcgctgtgctccccctcccaggctcagcctagaagtggagccaggcgtggctggcagggaggggtgggcaggccccttgaaggcccaggcctcaggctggcagtggtcagggagagtgacccgacgctccatgcccacccagcccaggatcgtggccaggctgaacctgacctccccygaccttttctggctcgtcttccgatacgtcaaccggggggccatgagtgtgagcgggcgggtctctgtgcgagaggagggcaggtcggccrcctgygccaactgtgagtggggtccctgggccacagcccctgccccaccagcccagcccaccccaccccaccccaccccactcccaagcccygccaccttcctctggctcatgtgggtggtaggaccagcctatccccaaccctgtagggggtgcagcctggggtggccccaagggctgggctcaggagtctcacccctgcccccgcccaggcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggtgaggcaggggccagagtgagggctgggggccgggtcagggggtggggcccaccactctcagcaccacctccaccctgcaggactacgtggttctgctgcctagcgcatactacgaggcggcgctcctgcagctgcgggtgactgaggcctgcacataccgtccctctgcccagcagtctggcgacaagtgagggccatgcgtgcggtgggaccggggtgggggcttcctggacccccactgtgcctggcttcccccactcaggctgtctctggggacctgggtggacctggggctgaccacggcctgtgtccccccagctgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtgcgtgtcctgggaccccacggagcaatgggtgttgcaggaccttggcctgggggctgggggtcctgtggcggtggcaggttataggagcagggcgctgcctcaggcaatgsagcccagcacccaggcagggcgcccctgcctcctgcctcctgcctcctgcctcctgcctcctgcctcctgcctcctgcctcctgcctcctgcctcctgcctcctgcatgtgtgacctcagtgcctgtctgtatgtaggattggctgtggcctccacatacagctcagcccccaccacttgcctggagatgtccgggccagggtgggactcggctgaagggcaggccctggggtcagggaggcgctggagtgggaggggagggaggtgggaagggcgaggggtggcgggcctcccgtcaccctgccttccctgcaggtggacgtccagcttcaagtggcagtgccacagccaggccgctatgccctagtggtggagtacgccaatgaggatgcccgccaggaggtgggcgtggcygtgcacaccccacagcgggccccccagcaggggctgctctccctgcacccctgcctgtacaggtgagtgggagccggtggggctggagtaagggcacgcccggggctgccccacctgctgaccaccctccccccacagcaccctgtgccggggcactgcccgggatacccaggaccacctggctgtcttccacctggactcggaggccagcgtgaggctcacagccgarcagkcacgcttcttcctggtaaggacccctcaggtccccaccccaaggggtcagcttctttcagaagatttgaaacatgcatgagaggggagaggacagttggggtcccaggtccccaaggcggccacactcgctcatgcccagcccagcatgtttcttctggaacccctcctgcaagcgttttgtggattcagtcccttttgacgtacccccgagctgttccatgtgctcaggaaagcacctgcagtcacagctccctggccccagggcagccacctcctggcacagacagcgttggttgcctgttctggaactttcttttctttttttttttttttgaaatggagtctcactctgtcgcccaggctggagcgcaatggcaagatcttggctcactgcaacctccacctcctgggttcaagcgattctcgtgcctcagtctcccaagtacctgagactataggcactcaccaccacgcctggctaattttcgtatttttaggagagacagggtttcaccatattggccaggctattctcaaactcctgacctcaggtgatccgccctcttgggcctcccaaaatgctgggattacagacaggagccaccatacctggcctggmactttctataaatgccacacaacatgttctgtgcagccgcgtctcccaccgttgtgtcagcggataagttgccgtgttccgagacaccaacctcacatggccgcacggaaagggagcacccatttgcggcttgtgcctgctgagtgcctgcctgggtcaggtcctgggagagctgggcctggcccggcctggtggcaccaagcagcactcgagataagagtgggggaacagtgacggatgggagggcgagggggaggaagagggctatgggaggagccgcataggcctgtgggcccaggaactggccaacacgctggtctgcggttggggtttgtgcagctggaggaggagcaakggcatcttggaaagagcagggctcggtcggacgcctgggtttgcagtttcctgggtctgagctgtgtgaccggcccccccatcgtaccgcctgcaccccccatcgtaccgcctacacccccccatcgtaccgcctgcaccccccccatcgtaccgcctgcactccccatcgtaccgcctgcacccccccatcgtaccgcctgcacccccccatcgtaccgcctgcaccccctatcctccccgcaccacgggcgttgcagcatctcgtccctctgcctgcagcacggggtcactctggtgcccattgaggagttcagcccggagttcgtggagccccgggtcagctgcatcagcagccacggcgcctttggccccaacaggtaatggcaggtaatggggctgggaggggcgcrgccgagggcccggcggcagggccggctctgactcacccactgtgctctcaccagtgccgcctgtctgccctcgcgcttcccaaagccgccccagcccatcatcctcagggactgccaggtgatcccgctgccgcccggcctcccgctgacccacgcgcaggatctcactccagccaygtccccagctggaccccgacctcggccccccaccgctgtggaccctgatgcagagcccaccctgctgcgtgagccccaggtgagggccatagtctctagagggacrggggtgtcagggcaggactccgggycccaacccagggcaggttgtccagggggcrgcaggggctcatagctcagcctgctcactagggcctatccctgcaggccaccgtggtcttcaccacccatgtgcccacgctgggccgctatgccttcctgctgcacggctaccagccagcccaccccaccttccccgtggaagtcctcatcaacgccggccgcgtgtggcagggtgagtgtctggtgtggggggtggagaggctaccacacacgatgagrctggaatgccggcgccacagcgtggcctgtgctacctgctatgagcgacaggcaacatgactctgtcctgccatcarttctcaaactagctgcccttgcagcccgcagcccctacccgcccgctcccgttcccagaaaagcctgggtctcgcctctgtctcgtgcgttgggaagccccgttgtgctccatggcacgtggcgaattgagggcttgccccaggatgccsctggcagcacatgtggccctgtgtgtttgtctggttcctggctcggccaagcctggkgtcccgcacatggagttgaccggtacctagaggtgtcccgcatgacatctgtaggtcatgatgcggccaacccccgtgacatgaggggccggccttgcagacctcttgggcacgtcccgtgcctgtggccgttggccagcgggcactccttggctgccccaacgctgccatcttcaaccctctgggtgtcttgggggcgctagagatgggggcctgaccctgcctttctcccccgcccaggccacgccaacgccagcttctgtccacatggctacggctgccgcaccctggtggtgtgtgagggccaggccctgctggacgtgacccacagcgagctcactgtgaccgtgcgtgtgcccragggccggtggctctggctggtgagtcccagctgatgtcctgctcagggaccagctgtccttatacttgtcattaccactgtggtacacttgggctgggtctgtctcttctgggcctgctgaggcctggccttgtgcccagcaaagcagctcctgcctttggggacctcccgatccaccttgtgaggctccagaggggccctggaccctgcaccctgcaccctgctggtcagggtggccttcctggaggaggtggggcctccaggaaggagagggaagaggaaggcgtggccagcagacagagatgtgggagacaccaggaggtctcatgaatgctgctgcctcctcaygcccccgaaagctgctgtttggcttggagtggcctcccctgagcagycagggcccabggctgggctgggctgggctgctgctgccaggactctgagctgcctgcaggaccctggtcccagccagcctctgggggcctccccgctgcaggctctgggccygcgggagagtgaccaggcctcaccccctaggattatgtactcgtggtccctgagaacgtctacagctttggctacctccgggaggagcccctggataaatcctatgacttcatcagccactgcgcagcccagggctaccacatcaggtgggcagggctctggcaggtcaggggtccggggtgggggtctgggccgggagctggcctcaccacgtgcccctccatgtagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatastggggcttccccaactgcaggcgtgagtaccccagtccttgggcgcccagtggcagggagttggtgccagagcccaaggtggacgggtcgaccagaaagcagggtcaggagaatgttctagagcctggcagggcagcattgctgccccatctgcgggcctgggcccaggaytycagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacactgccacatcccctagggctgcattctgggcctctgagaggggcgggactgggaagaggggtcagtaaaccctgtacccgccccacagcytgtgactgcggtgcccgcctctgtgacgagctcacgggccagtgcatctgcccgccacgcaccatcccgcccgactgcctrctgtgccagccccagacytttggctgccaccccctggtcggctgtgaggagtgtaactgctcagggccyggcatccaggagctcacagaccctacctgtgacacagacagcggccagtgcaagtgagagcccagagcggcrtcagcgcggcccctggtggccttaaggacagcatttcctctagccagagggtcctggcacccaccctgctcccatttgtgctccctgggtgcagcagcgccctctcctccacttctgggaggatgctgcctgggtggggggtgcctacgaggtctcactttggtgtgagtgacctggggtggagggggctcagctcccgcccctgccacaggtgcagacccaacgtgactgggcgccrctgtgatacctgctctccgggcttccatggctacccccgctgccgcccctgtgactgtcacgaggcgggcactgygcytggcgtgtgtgaccccctcacagggcagtgctactgtaaggtgagtgagggctgggcccagatctggcctctccctccrgcctcatcagctgaaagtgtccttacgggcctttcggggcagctggggcttcctagaagcttttgggagagtcatccccattggcaggtgggtaccaggaacccggggtcaggcacctggcacctgccgaccactctcactgtcctctcatccctaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggaggtgcgcctgcaggactgagggcattgccttctcggggaggkcttaggtgggactggatgcaagatggggccctgtgatgtgtgggcatccacccrtgtgcagccacacgtgtgtgcccacagttcgtggayatggagggatgggtgctgctgagcaytgaccggcaggtggtgccccacgagyggcagccagggayggagatgctccgtgcagacctgyggcacgtgcctgaggctgtgcccgaggctttccccgagctrtactggcaggccccaccctcctacctgggggaccgggtaagcagggcatcaggtctgggggaggcactttgaggatggccaggacgcctgagagggttgggagccaggagyggggtctgtccagggarggggagctccatgggggtccgtgagggtgcccaggccctgtcccggtagggaatgagcgcaagtatccaggcccagcacagggctctgtgctgggggtgcccagaccactrctgacgggctctgagcctgtggccagagtctggccaggtcacctctgtctgtcctgcctccaggtgtcatcctacggtgggaccctccgttatgaactgyactcagagacccagcggggagatgtctttgtccccatggagagcaggccggatgtggtgctgcaggtgagggagctgagatgatgtggcagggtggttgggtgggcgtggcgcagtrgcaccgtggtccaggcccgtgccaaccctcacctccccatgtgccttcccagggcaaccagatgagcatcacattcctggagccggcataccccacgcctggccacrttcaccgtgggcagctgcagctggtggaggtgaggggagctggcttgggcacccaggtccctcatggacctcagctcatctgggaaggccggaaggggtcccagtgctgctgtgcccattctccgtggtggaaaasagcccaggagcagaagcggggtgggggctggggaggtccccacacccattgtcagatatcttctgygctggtcaccctggggggtgtcatgctgtcttcccacctgctttgtgagtccctgatccctgaggggtgagcagctgctcagtagctgttggcttcctccatgcactgcctgttagcatcttttgcccatttctctttgacttgcaaatctttttccatccttttagagttctttgttattcttggtgcttaccctctgtcagacttcagagtaacaaccgtcttctcccctctcacagctcatctggtttttctttgtttttttttktttgtttgtttgttttttgagacagtcttgctctgtcgcccaggctggggtgcagtggtgcaatctcggcttactgcagcctctgcctcccaggatcaagcgattcttctgtctcagcttcccaagtagctgggactataggcacccgccaccacaccstgataattgtgtattttcagtagagatggggtttcgccgtgttggccaggctggtctcgaactcctgacttcaggtgatcctcccacctcagcctcccaaagtgctgggattacaggcatgagccaccacacccagcctgagctgtcttctgatgaacggccttatagttaatgtacttgaatttatccttttttccttggcagcaagcgtttttgcatcttgtttaagaaagtatttgtcactacttgatcagaaaggacctgcctatgttttcttctagaagcttggctgttctctttgtgtatttcaattcttaaggcatctggagctggtttgatgtgtggtgtgaggcagggatctaggtgctggctggcctcatgggagactggtttttctacctgtgtgtacctcctcctgccccatggtctttgtgcccctccatcccctacagggttggggggtctgttctaggctccctgttctgtcccattgagtgtggccccactgaggtgccatcctggacccacaggggaacttccggcatacggagackcgcaacactgtgtcccgcgaggagctcatgatggtgctggccagcctggagcagctgcagatccgtgccctcttctcacagatctcctcggctgtctycctgcgcagggtggcactggaggtggccagcccagcaggccagggggccctggccagcaatgtggagctgtgcctgtgccccgccagctaccggggggactcatgccaggtgaggttaggacagcaccagactgcgaggcggctcacctgtgcacacccttccctccagcatcctccctgtgttcccttccttgctgcctccacttcctgtcaccctactcacctctcttcctgcccctgcttttcgcaggctgctggccaactcatgggcctgcctgtcccctgctgcctgtctgyctgcccctcgtctgcctgcccctcatccgcctgcctgcccctcatccgcctgcccctccatgcacacaccctccatacccctttcccacctaccccagcccccaccactgggtcacctggacatcccccaccgaccatcctggcgtctgcctgtcattctgcccatccctcgcccactgtgtgtctgtccagctgctaatctgccctgctaatctgtctgtctgctgtaactttgctccttctgtatgaggaggtttgtggttgaatacctcctagaaggagtggaaagagyaggccctggtccacatggagtgggtggtcaccagccccaaggcctggtcattcccgagacaggacatccgtgtggctttgagagctatgtcctcaaacagcagccaggtgctggcccacctccagccggccgaggccaggagttcctgaccagcctctgacccagcggtgaccatgctccacgggttcccagtgcmtcgtgcctgcaggatccctgagggtctgacttgtgagcttgcagggtggggcccctcgtcctctcaatcgctgatgccacctgcccccgtacaccctcaggaatgtgcccccggcttctatcgggacgtcaaaggtctcttcctgggccgatgtgtcccttgtcagtgccatggacactcagaccgctgcctccctggctctggcgtctgtgtggtgagtaggggctggtggggccaggggggcagcattcactgaaggcacagtcaagtgtgccagggaagaccaggrgctgcacttccaggtcaactgaggtctggggaagggtgttgcccagtgggggaccatctggccttgggcacagagtctgaggcaggggtggtgggagctgcacagactcggcagtaggatgtgggtgtccaccatagctctgactgtccactctgccccaggactgccagcacaacaccgaaggggcccactgtgagcgctgccaggctggcttcrtgagcagcagggacgaccccagcrccccctgtgtcagctgcccctgccccctctcagtgccttccaacaagtaagccagcctcctcccgggacgaggccctgatggtgccaggctcccttcacccagcagcggggtgggttcccactgccctctgcagaggcctggacagctggaggtgtccgtgaggtctgggcccccgacgcctggcgtgtgttccagccggagcacagtgtgctcgcccgggcccgggcactgccaggggcctagtgactgacgctgctggtctttgcagcttcgccgagggctgtgtcctgcgaggcggccgcacccagtgcctctgcaaacctggttatgcaggtgcctcctgcgagcggtgagctggggctagggcagtggggcagggcctgagtgctgaccccaggatatgcgagggtgggcgccacgggccactgacggcccctccccaccctgctcccaggtgtgcrcccggattctttgggaacccactggtgctgggcagctcctgccagccatgygactgcagyggcaayggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccgtaggcrtcgggctgggagggatgcaccctggggagggttgcgcggggaggagggaggcctgctgggcgtaccccrtaagtaggctgtgtgcctgatgctggggcccagccaggacaagtcggagccagccttctgggttcatggtcaaccytttctcccccgctatgatccggtcctcccgccccagcgatcaggccctcccgccccagcgatcaggccccttcaccatcaggcctcccccggaccatcacaccctttctccctactacaatcagaccctccccataccaggatcacatcccccctcccctacccatgatcaggcccccaccttcaccatcagaccctccccccaacccatgaccagcgccccccccacctcacgatcacatcccctctccccccacaatcagtcccccctcrtggttagacaccaccaccaatgccccaccactggcagcggacaccagccgtcagagcagggcaggccatggcagggagtctgcaggtccctcgggcccaggggaggcagctggggagtggggccaggctgggacacgagtgggtagccgggtggtccgggcggcctggaggagacacagcaggaggcagtgaagtgagggcttaggagggtgcctaggggctccctgggggggtgagagggcccagggctgcagtcacggaccccttctgcagggtgcgactgtaccccatgtgggacagaggcctgcgacccccrcagcgggcactgcctgtgcaaggcgggcgtgactgggcggcgctgtgaccrctgccaggtagggctgtggggtaagcagggctgggtgggtggggcctagggactagagttggggcctggggagaatctgataggtggggctgaggggcagtgtttgatgggcagagcctcagggggtggggccagatgggcaggacccctggcttccaggttggtctgggacagtcttgagggctgggcagggcagtgaccagcctgtgccacaggagggacattttggtttyratggctgcgggggctgccgcccgtgtgcttgtggaccggccgcygagggctccgagtgccacccccagagcggacagtgccactgccgaccagggaccatgggaccccagtgccgcgagtgtgcccctggctactgggggctccctgagcagggctgcaggcgtgagtgctggccggtcacaggagggcggatggggacttctgagtggggtacgctccaaggtcccaggccagccatgctcacccaagccccccaccacaggctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaaggtgygtcctcaacaccccacttccccacacctgatggagtaggaatccaagtcccacacagcctggtgaccccagtgttaacgtcgacctcccagagtggtcccagctgccttccatttcccgagagacccatgcctgtccaactccaaccacgctgaggagcgctgcagctccactgctggctgcacccctctactgtccctagccttcctgtgtgccctggccccaccccatctgctggcccttcctcccccactgaccccacccctccactggccccacccctccactgaccccacccctctgctggccctgcctcccccactgaccccacccctccactgaccccacccccattggccccacctcttccactggctgcacctcctccgctggccccaccccttcactgaccccacctccactggccccacccctccacaggccctgcctccactggccccctcttcctccactggcgccaccctttcactgaccctgcctccactgaccccacccctccactgaccccacccctccactgaccccacccctctgctggccctacccctctgctggccctacccctccactgaccctacccgtcctctgaacccacccgtcctctgaccccacccctccactgaccccacccccactggccccacctcttccactggctgcacctcctccactggccccacaccttcactggccccctcttcctccacyggccccaccccttcactgaccctgcctccactggccccacccctccacaggccccgcctcctccactggccccctcttcctccactggccccaccccttcactgaccctgcctccaccggccccgccccttcactggccccacctccggccccaaccccttgtgctggccctaccttctccctgggtgaccccatgcccttcactcccatctgactcctacctgaccctatgactctgccagaactctgggacctccccacaggtcctgtgtccctaagctgacctcatgacctctggctgagccctccccaccctaatgaccccagggccccagctgatcattctcccctggcctgacccaatgacactgacctgtgaccccacatcgcctgcagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcaggtactgagcgtcctggccttccctccccaacccgggccagtgcaggccttcaccttycgcctcccacagagccagctccggagccccctgggcccccrccatgagacggcacagcagctggaggtgctggagcagcagagcacaagcctcgggcaggacgcacggcggctaggcggccaggcaggagccccaagaccccccagggccccgggaggctttcacctgtgttccccgcggttcgcttgtcctcattcagcagatgttacttcatgcctcgtacatgtgtcagtgcaggggacaggagctcgagagtcttaggggttgaccaagtcactgaattactatctaaactacctaatacatttgtttacagtgtataatatcactcaaatgtctttttttttttttttttttttttttgagacacagttttgctcttgttgcccaggctggagtgcaatggctcgatctcggcttaccataacctctgcctcccgggttcaagcgattctcctgcctcagcctcctgagtagctgggattacaggcacacgccaccacrcccagctaattttgtatttttagtacagatggggtttctccatgttggtcaggctggtcttgaactcctgacctcaggtgatctgcccatctcagcctcccaaagtgctgggattacagacgtgagccactgtggccggcctcaaatgtyttaatgagtaactatttcattaaattgacaggaaataacaaatggcaagttataaccaataattttaggtaactaacaagtgataaataacaagtcatcagataagagagttaaatagataaggggcccctcttccctgggaccctcggcgctcccccagaccccaggccctcccttgccaccccgaccctcgcytaccagcagcgtgggctartgggctcttcctcyacaggcygtggggacccgagaccaggcgagccaattgctggccggcaccgaggccacactgggccatgcgaagacgctgttggcggccatccgggctgtggaccgcaccctgagcggtaggggccagcccagccaggctcagggctcagagccaggagggctgcctggggtaggggtgggggtgcctggccgagcttggcctggaagaacaggcaggatctgtcttttagatgggagacgacgcctctggagtgaacagtagggcagggtcaggaggtcggcgacacagccgtgtggccagacaggtggccccgggagacgtcagacccctcgacagcctccccaggaaatgtgccggttagatgttcgcgctcacagatatcccrtagtgcacactgagacatgggactcaggagagayttggctccctgagcctgcctaacaggacctgccagcccagcctgggggtcggcagggggtgccatgtcagagagagctggccagggagcagggtgggccaggcggagaggggcaggacgagaaggctcagaagctggctgagcagactggtgtcaggrtgttggaggcactgcaggaggtgagggccgggcaggtgaggcagctgtggcctttcgccaggtgctctaggggccacccaggtgcgctcaggttccgggcccctggcctgccaaggatggcagggctggggtcttgggcttggaagccagcaggcagaggtgcactagtacgggcggccccaggctctgacgaacccctgccccacagagctcatgtcccagaygggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagatgtgagtggtgttgtccctggcaggcggggtggggagaggcagggacctgggagctccaagggggaggtcagcatggagtggcatcaggtgggcatcacggggcagatggatctggcgggcaccaagtggagaccaggggtcatgaaggggcctggcttccagagtgaccaccctcaccctggtctcggctagtgctggcccgggtgcaggagcagctgagcagcctctgggaggagaaccaggcactggccacacaaacscgcgaccggctggcccagcacgaggccggcctcatggacctgcgagaggctttgaaccgggcagtggacgccacacgggaggcccaggagctcaacagccgcaaccaggagcgcctggaggaagccctggtgaggaccccggacttgttcttcctcctgctcctcttcccgcctcctccctgcaatccctctcctctccggctcctcccctcccctcccctcgtcctcccctccctccgtcctcccctccctcgtcctccccccctcctcctcttcttccccccctcctcctcttcctcccctcccctcgtactcccctccccctcctcctcttcctcctccccctctccccttctcctctctcctccctcttctcctgtcctcttctcctgtcctctccctccccactccccatctgcccatcatccccctccccctccttgtccctccccaatcctcatccctttccccacctcctctattctctccttccccttctcctcctctcatttccccatctctcctcaccccctcccatcctttcctcctcttctccccctccctgtcccctcccccttttgcccccttccgccttcctttctcttcttccccacttttctctctacccctccatcctcctccttccctcatactcacacgttctaaccctcccctcctcccccctcctcaccccccatactccccctcttttcttctcccttccctgccctgctgtccaccccatcacatcctttattcttttcttacccctcattgtccccaactcccctgcattgccttcagcaaaggaagcaggagctgtcccgggacaatgccaccctgcaggccactctgcatgcggctagggacaccctggccagcgtcttcagattgctgcacagcctggaccaggctaaggaggtgagtgcagcccctggcccctgtcrccaccccatccacggccaactccctcccaggcccgtgggcagctttgtgtgcacacttgcgtgcagagcccgccctcagggtcgtggatcargtggctgtgagcaggatgaggggctaagtccactcaaattccaggagctggagcrcctcgccgccagcctggayggggctcggaccccactgctgcagaggatgcagaccttctccccggcgggcagcaagctgcgtctagtggaggccrccgaggcccacgcacagcagctgggccagctggcactcaatctgtccaggtgggtggccaggagaggaggggccctgggcccaccctgrggatgcagacagggccttgggagggccagctggtctgggaaggctcctaggggctgaggccgttgtcctcaaagaagccaggccttcctcagctccacggcaagctggggcccagagtgacaggagcagtacacccagcaggcgacaggcacgggcaaagacctggaggcgggacttggcgggcaggcrcgggcacggctggttgtgagcgcaggaggctggagagccaggccgagggcgtctgygcttacccactccttygaccctcccttccgctgcagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcggtgaggcccctcacttcccctcagccccagcaggagcgcccccactgcctgcacctcccgcagccccggcctgcgtgtctgagccacggtctgccctggcatccacagacggtggtgcggcagggcctggtggaccgagcccagcagctcctggccaacagcactgcactagaagaggccatgctccaggaacagcagaggctgggccttggtgagtgctgggctccgatgggggccyttaggcctgctgggcatctgagctcccagggaccctcagcccccagccacatgcacacgtggggtttgtgggtcaccgcagcatggtttggggtgggagagctttggagatggctccccagctgcttgtgtgtcagccccggggagccctgcaggggagtccagggaggagcagcctcctgcgaggcactggctgccactgaggcaccagctgagccacagggcacagggcaagagatacgtggcctctgctctgctgacccgagggctacacgcgtgccaagctgcgcaatgagaaaggtgtgagctgctaggaccagagggctgtctcttctgagcctctattgtttcatctgtacaatggggacagctatgcctgcagtgggaccagaggccttcagggaacagaggcyacgctgagactcaacacctccccacaggctaagggactccatgtctgagtgtccctgtccatctgtctgctgtgtgtcagccttggtcctcctggggtcagaagggtggaggtgggctgcaattgtatactgggggtgaagctgcctgggagctgaagctgcctcccccgcagtgtgggctgccctccagggtgccaggacccagctccgagatgtccgggccaagaaggaccagctggaggcgcacatccaggcggcgcaggccatgcttgccatggacacaggtatgcggagcctgggcccggctctcgcagccggccgaccatgaggctctgtgacagtggcgctggccacatgtggttggtgagcactcactgtgctgtggaagagacccccacagtgggcagctggggccagacacagaaagcytaccagggaggtgccagggctgcagatagcacagacagccccagccgtcgrgagcctggcaagcttggaagtgctttgggtagaaatggagktataggtgggagggctgtaggccttgggggggattggggcacaccctgcaggaagggcacccaggagggcacagtggtcagcgtggctggaaccaaggggctggcaagacyttgggcggtgaggaccagggctcccaccctgagaggcttggagcagaggacgatgtgcctcacccagtttctgagggacccctgtggctgckgactgttcccagcaagcccaggagagatggtgggggccaggtggtgggaggtgacatggggcacatgtccagggaccagctgtggcctgagaggctgggtgcctgtcctggcatggagggggcgtctggtggaggcatttaggatgggtttggattgcactgagcagcggggtgtgagggtctcacacratccatagggggttggatgtccctgttgctggcccaacagaaagacttggggacatgaagccaggatggtccccgctggcccctgctgagcctgccctctgcccaccacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcaggtgcgcccatggccctcgcggtgcccctgatggaggcgggcacggtggggggcaaaggtctcaggtctccctctctgcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtgggtgagagtcccaggggaaggtggacatcagggagggtggtggtggacgctgatggaccrtgccccgcaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggtaccaggctggctgggtggatgcggcccgagctcaggctctgtttggaaatgagcggtgcctggtccctggtccccggtccccatcccgactgtgtgtctgtcactgccgcaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggtgggaggcccaggagagaggccggatgcctccaactgcagggcccttgcccgttcgccatctctcccctctccgtgtgcacccaccacccttcacctctccatgcccactcgccacccctcgcctctccgtgcccactcgccacccctcgtctctgtgcccactcgccacccctcgtctctgtgcccactcgccacccgtctctgtgcccactcgccacccctcgtctctgtgcccacccgccacccctcgtctgtgcccactcgccatccctcgtctctccgtgcccactcgccacccctcgtctctgtgcccactcgccacccctcgtctctgtgcccactcgccacccgtctctccrtgcccactcgccacccctcgtctctccgtgcccactcgccacccctcatctctccgtgcccactcgccacccctcatctctctgtgcccactcgccacccctcatctctccgtgcccactcgccacccctcgcctctgccctcaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacggtgagcccgcccggcctggggcagcctgggaggggctccgcagccccgagtcgcttgtgtcctggagagccgcgggttcttttggtatcttgcctcagtccgtcctgctgtagtctgaagtccccttggtccatcctggaggggaggcgcctcaggccaggtgccctgacccagccctgtgcccacagccccctcccctgcttcgcttccccggctaccggggctgcatcgagatggacacgctgaatgaggaggtggtcagcctctacaacttcgagaggaccttccagctggacacggctgtggacaggccttgtgcccggtgcgtgtggcctgccctccccgtctccacccaccccaccccaccctccgctgaccccagaatctccgacctgcagctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcaggtgcgccaggcacacccrtcctgccatccccacttgcactgrccctgccccacactaaccctgccctgtttctgcagagccagttcctgtgyttggccgtgcaagaaggcagcctcgtgctgttgtatgactttggggctggcctgaaaaaggccgtcccactgcagcccccaccgcccctgacctcggccagcaaggcggtagggccagggtggggaccagggtggcagggagaggagatggaacgatgggggcggggcaggccgcagggacacagctggccctggagcccccactggtcctgtagatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgaggtaagcactgtgygcagctggggctccgaggccaggctgttggggcggtaggctgggcttggaggtggcgccctgacccgcatccccgcttccccacagcctgcgayggctcttccccaccggaggctcastccgtggctgcgtcaaaggcatcaaggccctgggcaagtatgtggacctcaagcggctgaacacgacaggcgtgagcgccggctgcacygccgacctgctggtgagcagccctccccgggctgggggtggcatctgtggacatgcaggggcaccmgcgggcactcagggatggcctccccgcaggtggggcgcgccatgactttccatggccacggcttccttcgcctggcgctctcgaacgtggcaccgctcactggcaacgtctactcyggcttcggcttccacagcgcccaggacagtgccytgctctactaccgggcgtccccggtgagacctcacacccgtgcccattccccaccccgcggtggccgtcggagcagttgggactggggtgtctggaatgagtctgggtccccaggccggccggctgacctggctgccgtccccaggatgggctatgccaggtgtccctgcagcagggcygtgtgagcctacagctcctgaggactgaagtgaaaactcaagcgggcttcgccgatggtgccccccattacgtcgccttctacagyaatgccacggggtgagcctggccgctgggccctcatcgtgaaggtctggagggacgcccgcctgcacttgcctggacctctgtctcctctgaggtgggggtgggcagggtggggaaaaaccgagcctccggcctcccgccccccagagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggtgagcctggtgggcgctgggggacaaggtcccagctggccttccgcagctgctgaccrcctgccygccctgcacaggctcctgggcccacagcgcgtatttgatctgcagcagaacctgggcagcgtcaatgtgagcacgggctgtgcacccgccctgcaagcccagaccccgggcctggggcctagaggactgcaggccaccgcccrgaaggtgggcaccccaggggtgagcaggcagagctggggtggctggaagggtggcccctgtgygggcggcccctgcattcaccatccacgcccccaggcctcccgccgcagccgtcagcccgcccggcatcctgcctgcatgctgcccccacacctsaggaccacccgagactcctaccagtttgggggttccctgtccagtcacctggagtttgtgggcatcctggcccgacataggaactggtaaggccaggcccggctggggtgggctgagaggggccgcgcaggctgacgccagctccgcttccaggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtgagggccgagaagaaggaaggtggtgggcagggcctggcagccctaccctgacccatctcctgcccccaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgagaaccatcttgccccagcccccactccccacccactgttccctttcagctgccctgggccctgatccctgcccggtctgctcctataggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttaggtctgtgggtgctggcatcccaggccycagcagggcagggcaggggkctccaggaggttctggggaggggccccccctttcttctccatcacaacccctccccgcagacctcccaggagctacactgcctgatgtgggcctggaactggaggtgcggcccctggcagtcaccggactgatcttccacttgggccaggcccggacgcccccctacttgcagttgcaggtgaccgagaagcaagtaagcctggcagaggtggcgtgccagggcagggtttgcctccccattctggtgacctcgggggcatagcctgaccctcccttcctacccckccaggtcctgctgcgggcggatgacggagcaggggagttctccacgtcagtgacccgcccctcagtgctgtgtgatggccagtggcaccggctagcgggtgaggcccctcctgtggccagggcactctgccacccccacccttctgcagagcgggagccaggcgggactctgggtggggtggcttcttttggggctggagagaggctgggctgaggaccacctggcctcagragtccccctttctcccagtgatgaaaagcgggaatgtgctccggctggaggtggacgcgcagagcaaccacaccgtgggccccttgctggcggctgcagctggtgccccagcccctctgtacctcgggggcctgcctggtgagtgcggccttgatcaagggtgggggagctgcccctcaggactaggtgctgcrtaacctaccaccctccccccacccctccaccccctgccccctcccaccctcctcccacccccctmccaccctcctatgatgtggaatgagacaggggctgggtggggcactgacgtttgggaagggcctgtgggtctctagctgcccaccaaccagccttcttccatcttccctgtgcccccagagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgcyccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctcyttaaaaattaaaaagtaacttctgtgtaaccgaatgaatgttgacttaaatacggagadagtctcaagacagrtctggaaccggcctggacagaggcaccaaactcttcctggggtgaccgttttccgttgttaggtcaaataactaactgtctctgggaccctacagcagctccccacgctagcacctgtccagccgaaactccctttgggcaaagaaactaagcrttggcaggtaaaagaaaagactttattaataatcagtgggtgggaggtgagggtgtgcaacgcactgcaagcgcccagttsctcggaggacggcgcgtggctcagtccaggctcatgtcctcctcttcgtccttcktgtccttcgtgtcgccctctttctgctcgggcttggcgttgttctgcatggctttggcaaacgcttccacatctagaacacgttaaagacacaaggtggtgtctaacccttgcccagaactkgggatcaaagcgatgggatcaagggcagaagggctgtgacctttaccccctcagccccacttctgcagatccagggggacaggaatggaccctgcccctggctctggcctggaggtgcaggcgcagccacttaccgcccttgttggcggcctccacagcctctgcaggcagaccgaactggcacatgagggggcccagctgccccgaggccaaggctgcgctgaacatgcccagggcctgcaagaagagccaggcgagggctgagctccaacccgggctgcacccyagagccacactgctcagctgccagctstgcgggtcaggcacatgaagcactggccatggtgaaggtggggcagggcctcctcctcccccctgcccactccckgagcacacagtggrggacaccctgggcccggcctctacctgctggaactggggcgaggtcagggtattctggatctcatccgcggtctgcggcagcgactccccagatggcaagtagggaagcaggcgctcctggacatccgcgttggcgaggatgggagccattatctccggcgtcagcacactggccaggtccactggggcacaagaacacggccatcagctcgatgacagcctaagtgcccacatggaaggcatgcaagcagggactcagcccatggccccagcaccccaggcgcgcacactaggcagatgccttggaaggtgagcgtgcgagggtcagcaggccccatgccccccacccagctccaggcgacagcacacgytaccttgctggccgcctgctggcccggctggtacgttcatcgtggccaggatgctctggaggtcgctcagctggatgggctgggtcggkctggctgctgtgctggctccattcccggaactgggcgcggggctcgggctagttgctgaggcagctgctggagcagaaggggctggggtggcacgggtggaagaggtggtggatgacggggtgaccgctgcmgactggctccgggagctgcgaagagagagggcaccgctggagcggacrcgccccacacggcagggcytactcgcagggtccagggtgctgggccaggattccccactgcccctcccttaacaccgtggcacytgcgtggcaggagcgatgaggctcacctggaggaggagctgctccctggaggcccactgctccccagtaagctggccaggccaggtccagtcagggcccccagcccacctgcgaggggcaaggaaatgcgagctcaggatgccctctagcccaccagaaagagcctggcccctccccaggccagaggagcaggaattcccaacaccaaagccaggaagaagcggggcggtggggacccacaggcctggaggagcggcrtggggcgggtggacacttgcggctgtgttctggaagcaaggtcatttctrttccatcccattacacaattcatgtgcttagattagaagattcagtccagatcccacccaaagggacaagcatttctgaagggccaagcacacgggtctgcactccatgagctggcagcaggcaggcagccatgtrgggccaggggacccagggcgcaggaaccccagctccctccagtcctccagccccaccgctcggccagccaccctcctctgaagtacccagctggggtcctcaccaggggcccakaagccctcgcctacccagctctagccacaggcaaacaagcgcattcccaaaggggaaccagcttgcggacacacaggctccccgacactacgcagacagagccagcagaagtttaaasgaaacagagaccgggcctcaaagcattcccagcagaagctgcccgagagcccgggtggcgcacgttacccagtcctccraggccggctggtccgatgagctgcatgagctggctgtggctcatgtttcccagcaggctctgcaggccaccctcacctggaaaacactgcagctcaggcgggcctgccccagccagatccacgcgggccccaccgcrctgcctgcgcctctgctgagcaccgcactcggctgcccctgaaccctacagggggcaccacttgaagtgaggcgacggtgggatgcagacccgtcctaccccgtgaaggtgggagtggggagtgayccagggmgctcacagggtctctaacttttagaatcttctatttccacttccaaacaacctgtgctgagggggcgagtcatccacagtagactctggcctcccaggaaaccctgagctcacgtgacacatgtgacagttaccgcctagcgcagagagttcgtggccgctgcttccgctggcccccagygccccaggcatcggggggttgttcagatactcgttgactttccggcaatgctcctcatcctggtctgtcttgggttcctgcaagaggaagggcatgtaagggcaggagctggygccagctcacccagggccaccacagccatcctctgacctggcttccaggtgagggacctgagacgcagaggcgcgtgtgcctggccacacaatgctgaggagacaggacccggcccagcaggtgaggggacggcagtggcgcctcctgagcacgatgctctgcgccctgtccccatccgccgcaatcccgggtgtgccctgtccccctccgcccatttcacaaatggggagcctagagctccgaaggcacttagctgctgccagaccaagccctctcaccctcctgccctctggggtgcggttctttacacacccgtctccttccttcaaccagtggaaggcagcgaactggcccgctcagcacaccgcggcccagggccacggcaggcgctcacaatcgagcacacgcgtgtgcacacacatgtgcacagatcagtgtcagaagcatcgacctgcgagctcacagagctgggagcagagcacccacgcacaccccgaatggctatggaagctgcagggcgccagggacactgggagtccctgctctcatggcaaagcagggaygggggacttaaaagccaccaacaggaaaatcggggaaaaaagggagatggtggtaacagttggacactatttcttggcaaaaccgtggaaaaacacgttctacaccagcaggtggcaaattgtggccgccatctgtgtttgcaaataaagtttaactggagtttggctatgcctgttcattttctcaggccgctgcacactacttgcacaggtgaccagcaacacagaccatgtgctccacagagacctcagccagggccacccctgctcttgaaagtgccaaggggggtggggtggggacagcagctccacctctggcagagagcatggccttctctctccacactgcaaacgcatgcacacgcttcctgaccacaggcccgccaccagttttcacctacagatgatactggcttatggaaaatgatctgtgtaccgggaaattctttgcaacactgcctgtaacagcacaaaaaacggcaacaagctcaatggtcactgacagatggcagaatgagcagcggcctctagacccaaaagacgctctgcagctgtgggtaagagaaaccctgggcactgacacccctggcctccaggacacactgccagggaaggggcaggactgtggaaagtgtgagcaggatgcttcgtttctgtgagcaccagcagggaagccacacaggggcctctgcctctgctgtgggggcctcagtgacccacggcaaggggcagagagagggcactgggcatcgttagaaccagggccagcatgtctgtctgcctggaaatttcacaccgcaatcggttgcccgcagcccagcctrgagcctccgtactctgggagaggacctcggccccaggtagcatgcaccgcagccctgaggtggcatctcaggccgtgtggccgggtgtggccggcgcctgctggtttataaaagccaattgcaccacactgtaagcaagttcctaaccgaatcgcagggcaacaaaaaggcacaaccccaaggcytgccccatacctgcatccagaagaaaagccgcttggaccctgccttgaacttcagcacgtagaccctcccgctggggcactgcggcacccgcttgaactcacagtcgtcagggaagatgatcaagtcctggcaagccaggggaagagagagtcagtggcgcagatggcatcactgtgcccagtctcagkagagcgtactgagccctgggtctaaccgggtggggtgcgcaaggggcagctaagccgccagacccctcgctggcagggtctccacaaggcagagaagccagggtcagagacagcccatgaaaggcaaggccgggggagagagcagggaarggggcctttcagatggcaacggggtttctgagacgtgctggaaacaacattcccagagtagttaaaaagtcaacgcygaactgctctcaaatgtaacaaagaacaactaagagtttgaaaaacaaagaagactgagtgaagccgccaggcacagagctccaggctctccagggccacacctccaaccccaggcacctcacacggacagttcaaggccaggcacagagctccgggctctccagggccacacctccaacccaggcacctcacacggacagttcaagatacacagtggccgagatgcccctgtcaccgcggaaaccaggacgacccatcagcagggcagtcgatgacggccccacgagcggtccccagatgcggccaagcccccaccgcgaactccaaagcgaggactccgagggcccgagaagtcgcctgtcctgctgctgcggctcagggacactcacgtcttccacgttcccggacgtcctgtccttccagcagaagtgaataagcgagtcgtccgtctgctgaatgtacaccagccctttccgcttatccggagtcacggtggtccccttcagggacatctttcccgcccgaaactccaccaagtacttgttggaggcgccccgagagcctggcaccaggcttggaaagagcgcgcctgaggtcgtcatcctgaaagcgcggagaggacgctgagacgcggcggtcactgtcgcctgcggtccggcaagctcccgccccctggggtgtttgcgagcagggggcctgcgcccagagctgcctaaggcagactcagacacgccgggctgcctttccgcgtttgccccgctcacgacgatcgcaccgcccgcactcggcgctgggccggggcagccccgccaagcctagtggggccggccctaggcttgacgccgtctccgcggggcaccagcctcgacgcgccaccccggcgacccgctccgcggggcagacccgcccgagctcccgccgagccccacgttcagagccgcaggcggaaccggggcggcgcccgagaccccagaacccccgcccggcccggcccccgcaggccccacccgccgcgccggccaccttctcgtcttggctgcccccgccccatccttggtccagcagcccctgcccccgcctccggtcgcccccggccgccccaggcccggcgactcccgcacctgcctcgcgcccacactcgttcgagaggcgccgtccgggctcgctcttcctcctcggcgcctgccgggccccgccggaaacccgcgttcggcccgccccgcctgccgctctcgccgccgattgagccccgtaagccgcgcagccggctctaacctgccaacgattggcgagggcgaccgtccatcgcactcg

SEQ ID NO: 13369 - DNA, 56448 bp, Homo sapiens
  misc_feature (1)...(56448): n = A,T,C or G, or insertion/deletion polymorphism (see Tables 1-2)
cggagcttgcagtgagccgagatcacaccactgcactccagcctgggcgacagagccagactctgtctcaaaaaaaaaaacaaaaaaactgaatatagaaagaaaagactagcatggttggggaaactagggctgcttcgtgttagaggcaagacttgaactgaactttgaggaatgggcaagctttggccaaacaaagaggagtatgcggacttttggggacagaaccacagcttctgtgaaaaccaatccataaacagaattcttgattaacaaagaatgatggaattaaacatttggrctttttttttaaaacaacagttttatcaagatatagttcatataccataaaatycccccttttaaagtatacaactgagtggcttttagaatattcagagttgtacaaccatcactactaatgtcagaacatttcactacccctaaaagaaaccccataycacagattccgatgccgccgggagccctrycatgccatgtcacatatattatagtatatmtatgcccagccatggtcaacccaccgtgttctttgacatcaccatcaacagcaagcccttgggccacgtctccttcaagctgtttgcagacaagtttccaaagacggcagaaaactttcctgctctgagcactggagagaaagggtttggttataagagttcctgctttcacagaattattccagggtttatgtgtcagggtggtgacttcacacaccataatggcactggtgtcaagtccatctatggggagaaatttgatgatgagaacttcattctgaagcatacaggtcctggcatcttttccatggcaaatgctggacccaacacaaatggttcccagttttgcaactgcactgccaagactgcgtggttggatggcatgcatgtggtccttggcaaagtgaaagaaggcatgaatattgcggaggcyatggagcgctttgggtccaggaatggcaagaccagcaagaagatcaccattgccgactgtggacaactctactaagtttgacttgtgttttatcttaaccaccagatcattccttttgtagctcaggagagcaccctccacctcatttgctcacagtagcctctaatctttgtgctatctctcagttccctttgggttccatgtttgccttattctcctccatgcctagctgkatttcagagttaagtttatgattatgagataaaaactaaataacaattgcaaaaaaataaaataaaaagaaagaasaggctgggagcggtggctcactcctctaatcccagcactttgggaggccgaggtgggcctaccaaaggtcaggagatcgagaccaccctggctaacacggtgaaatcccatgtctactaaaaatacaaaaaaaattagccaggcgtcgtggcgtgcacctgcggtcccagctactcggaaggctgaggcagaggaatggcgtgaacccaggaggtggagcttgcagtgagccgagatcgcaccactgcactccagcctgggcaacagagcaagactctatctcaaaaaaaaaaaaaaaaaaagacggaaaaggcattatatatttgtgaagacatggacagaaatgtgtcctgattgtggtgccacaaagcactgagcctactagaagacgtcagcaaaagatcccctgaaaagtgactccaagccattcactgcaagggatggttacacagatgcagaatacagaaggtcaatagtagcttaatgctacatcacagcttaacactacatcawccacctcacttcatctcaccccatcgtatygtgtcactgtgctcaccatcacaagaacagggaggatagcacaggaagatattctgacagagaaagagagagaccacatttacataacttttattacagtatattgttataattgttctattttattattagttattgctaatctcttactgcacctaatttataaattaaaccttgttattggtatgtatgtataggaaaaaatatagtgtatatagggcttggtactttcttcaatttcaggcatccattgagagtcttggaatgtacccactgaggataagggggggytgctgtacatactttgcaaatatcttctctcatcccatgggttgtcttttcattttctttctttttttttttgagacggagttttgctcttgttgcccaggctggagtgcagtggcacaatctcggctcaccacaatctctgcctcccgggttcaagcgattctcctgcctcagcctcccgagtagctgggattacaggmatgaaccaccacgcctggctaatttttgtatttttagtagagatggggtttctccatattggccagcctggtctcgaactcccgacctcaggcgatctacccacctcggcctcccaaagtgctgggattacaggtgtgagccactgtgcctggccgtcttttcattttcttgatggtgtcattgaagcacaaaagttttaaattttgatgaagaccaatttatctgttttttctttcatcacttatgcttttggtgtcatatctaagaaaccattgactaatccaaggtcacaaagatttattgcctatgttttcttctaaaagttttatgattttagttcttacatcaaggtctattttaagtcttttgttttgttttttgttttttgttttgagacagggtcttactctgtcacccaggctggagtgcagaggcacaatcatggctcactgcagcctcaacctcttggcctcaagcaatcctcccacttcagcctcccaagtagctggtattatagacatgcgcaaccatgcccagctaatttttttgtagagatagggtttcaccatattgcccagactggtctcaaactcctaagctccagtgatccgcccacctcagcttcccaaagttctgggattataggcatgagccactgcacccagccccaaattttgtatatggtattagaaaggggtccaacttcattcttttacatgtggaaatccaattgccccagcaccatttgttaaaaatattttctttcccatttaattgtcctagtgttcttgtcaaaaacaattgaacataattgtatggrttcatttctggactctcaattctattccattgttgagcatatttttaagggctgkttttctctcctgtggtaactggtgacctgtacttcctggaagagagatgaaaagattcccaagccaactgagttacctcacgtgggtcaggtctctgtggctctctgcactggcctattcataatgatatcctcctgcaggatttgagccttctcctttgttgtgacggcagccgaggaggtggctgactgcccagacagccttatctctttcctacctttcaaggttattgtaaataccaaattagattgtttatacacaagaatttagcactaaagcactatacaaatgtaagctatttatttytatttatccttctccttcatgaataagaccctaaaaatagaagatatttttaatttttactcactgggctcaaggttgcagtgtctgtattattgcaaattccaaattaatgaagtctggctcttcttatattattcctgcaaaaggctgtgtgctcaccccccggagtgtgaatacgagtgtgggtcatttcctctttcctctgcacccttccttygatgaggttttgccctgtgctaggcaccatgctaaactctgagaaaaccacagagaacaaggcagacgccatccctgccctccagtaacatacaatttagtgatgaagctgggggatttaacaagccattctaataaagcgttacagtgagggaggtgcagggtgatgcctccagcagccctggtgtcagctgctccaggtccaggggaagacttccattatcttccaaccctgtcggaagtggaggcggaggctgtttattgctgacacagtccctaacccagggtctatagacattgtggaaatgccttggagtcagacgggagaatgaaccagcagaagcaatgcccgccctccaccctcctgaagagggttctcaggaactctttggaggcgaggccagcctctggctgagggcctctggatacaggttaggcctcaggctcttctcctctctactcatctctcctcccttggcccctccttcagaggctgacagagccccactctcatctcttccccacccaagcctctttccacagaaagactgcttcctcccaggagacagcagctcatttgcacacagacacccacagccctcaaagcctggaaggccaagctgttaggacccctgagagcagggtggctcctgggaggagagcccaggccaccaccttgccctccctggcccctggccttcgatggggctgctctgatcacaaacgtccaccaacgtagccggcccagaagtgcacccatgtcctctggtatccactggctctccaagccaaactgggcagggaggagttgtgagggaaaactgcaggtcaggagggaggctggcaaagcgggccagggccaggcctgaccccagctctcctctcccggccccactgccggccagtgtttaacaaggccctgccttctccctctagtgctagggacagccaccttcttcctctccccaccgccccctctcccctgcaacacgtcatctgacaagtcagtgcgatctcactggaggtgcatctcacaggaacgcggggtcacagcctcctgcacacactccatgctgcacagcaaggtgcacgtgtccctcagagccccagacaccatcccccactcacccagaagcccaagtgattcccaacagcccccagcagcctaatgggttggggtcttgggagcagctgtccctggctccttccctgatcccaccgcccagcctcaccccacggttcctccattgccccacctcccactgcgccgccgggcctctgccagggtcaaggggcttcccccctctggcagcagacgccatggtgccgaggtggcctccacaaccrccctgtgcgccaataggacaagactgtcctccctcccccacacttgtcactttgagggacacgtggatgagacaggaaaacacaggggagtgtggagacctgaggtgacttggagcaagcctctcaacctgagcggcaatttcttcatctgtaaaatgagggggttgttctcatctctgaggctttgtgtcgctctcaaagcctgctagcctcgggttctaggactctgttgggatcgtgtgtgatgttttctgctgagcgactggcagcctgtgtcctcggggggaaagagggcaggcgctccaaagctcctgcgctctgtggctccccctccctcgcagccccaagccccaggtgtgccggccgccctgagcccctccagcacctcccggaggcgcctgcaagacacctaaggtccccgcctccctcctctcccccccgccacacccctacccccggcaggcgacgtccccgcccctcgaccatggcctggtgaagaagccggccaggcccgatcagccccatccccgccgcacgagcggcgcctgcggacagctcctggggccccggccttgtcactccggaggcgggaggctccggggggtcgggctgggaagatcgagccggaggccgctaggctcccaggccccggccgaggctgcgcggccgcacggtgggcaggctcgggtgttccggcaaactgccgggtccccatcttcwaaagagaggaggccctttctccagcttcctctgcggragcccgacccagccccatcccgccacccccgggctgcacctcggcccctccccggcccgcgcccctgcccggggcgggccaggaacctcggcccgcgccgctggggactytggagcggaggaggaagcgcggcggggcgggggcgggggtgtgtcgggttttataacccgcagggcggccgcggcgcaggagaaggggcagagccgagcaccgcgcaccgsgtcatgggggccgcctcgggccgccgggggccggggctgctgctgccsctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggccaggtggcgcccgggcccgggcgggggcggggcgggccgcggcggccaatcacagcacgcggccggcttgtggggcgggcaggctggcgcccccgacccgaaccccaccccgaccccggaccctcgccccgacagtcagccgcggggcccgagcgccgggctgcgcgcacggcctacgctcccagcatgcacgagttggatggatgaggstggctgctcccaggccgcgcccgccttcgccgaaggtgctgggcttggctctggggcccccgcgctctcgggcagctgccttctcacctccggacgctgtcgctgtcaccgtcaccgcactgcactgtccatccaccctccactcgcccggcctcttttctggtcccaatttctgctccaccattcccatgaggcagattccctccagaaggaggaagcgcggcttccgcaaactaaggtctcccgcagggatctccccagggcccggkctctggaagcccttggccttcctcccctcccccagcaccgtggcttctcctttatggcctgcatctaagcagggtcctacaccctccctgccctcctggtgcccaataggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcgkcagcaggtgggctgagggctgaggcagagctcgggggcggcctcctagtgccccatcgtgggggtcgggggagagcagcccatcagggagggaggaaccctgggatccacatgggccctgacagaagggaaagcccargtaagcacagaatggctttctgagcattgatttttcytggagatggggtggggagttactttctgttaaaggaarcattctggagtaggaagycaaattcaaatacacttctccctaggctggtttatgagcttctytggaagagttgagaagggctgggcgtggtggytcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccagcctgcgtgacagagtgagacctccccccmaaaaaaagagagagagaaaaggttgagaaagactgggaagtcaccaaagccagagaatgggagggatctgccctcactgcagggtggtgccaagctgggacttgacccwgaccctgactttcaggactcctgtcccccactccacaggctgcctccactggcaggggactcagaagtgatccggtcacactaagtgacacttagtgatcagaagtgccccggtgccactgagtggccttgtccaagctacatccactctgtgggctcctccttstagcagcgaggggagggcagatgtcccaggggctggtcactggagcattcctcccctctgactccccagtacaacgccctgctaagcaacatgagcaggatctactccaccrccaaggtctgcctccccaacaagactgccacctgctggtccctggacccaggtacggcccttgcagctcccctctcggcggtgccctagtgttcccacattgccctgctgcactccrgaccatgcagttgtgtagggtctgtgsagacagcaggtaaacccaamggtgttgccctccaactggggctggacggtgcagatacccccacgccctgcttctcttggcaagtggacttccggaatctccagctgcagcccccacttctgtgtgtacctcggcctctcccatcacccctaggccttcctcctggctgcctggtttcccctttcgtgggtcctctcatgttccccaagagccctcaggccagggacccctcgtggcttccccttaaaccccgctccagccccctttatgagcagcttcgaggaaggcactccatccaataggccgctaagtgtctgtctgggttttggcctttgggtgtccccttggtgtcagccaccttaggtggtcatgtctctggggcaggggccctgcctgggtgtttctgtagctcccagccccctcccaccaggcctgtaggtggcccctgtctctgggggcacygtgatgttcaggaagctggtgggagcagtaaggactggtgcaggctctggtgaaggccgttgaagacttcaacgtggaggcctcctcaccgaccctgcytgcctgtgtctcagatctcaccaacatcctggcttcctckcgaagctacgccatgctcctgtttgcctgggagggctggcacaaygctgcgggcatcccgctraaaccgctgtacgaggatttcactgccctcagcaatgaagcctacaagcaggacggtgagcaggcctytccctgtccaggaaccacgccaggtgtcctctctcagctgtctccccagagtcccagcccagagtcaggcagagcagctggtatgacaattccagcaggccctgagtttcccagaaagtggaggtgggaccggcctgcacccagtgtgcctggactttgctgctggcctgccccacgtggccatcctgctgtcactcctggccctgatgctcctctttgcctctgggaacctccaggatctgtttagctggctgtagctaattagaaattgtagagtggcaacccccaagccaattttccagctagctgcagatccacgggcctcgagccagtggaagagccgacttacagmtgagaggctgaggtccgagcctttggcctgagcyacatacctcacccccaygcccccaggcttcacagacacgggggcctactggcgctcctggtacaactcccccaccttcgaggacgatctggaacacctctrccaacagctagagcccctctacctgaacctccatgccttcgtccgccgykcactgcatcgccgatacggagacagatacatcaacctcaggggacccatccctgctcatctgctgggtaaggacctgrcctcgcctccacatgagtyccacggaagtgtgggtccygaggtaggggtgggggatgtccagggtaagggaaggtgggttgtgaccctcacatctcacatgtgtggggcatcatactgtttgcttcacatgcaggagaccattcgtgttcccactttacaggtggggaccctgaggcttagggtcgtgagggacttagtggtcagagagctaggggccaaaccaaaggctctggccctgggtccagtgggggagccatcagcctagctcatgcccaaggaaacaagcactgtggccctgcctcaggattgagtggctggggcctggcrcagccagaaatgacagtggcagcatcttgcagccccaggacatgtggccctmggaggagtgtgggtgggactgatgtgtgagatttctggycctaagccaggcctgcagcccttgagggccccagggtacaggtgccggccccagggtgccactcagcgatgcatgaaraagcaggcacagccaggcagggagccaagctgtccccttccttccttatctaggagacatgtgggcccagagctgggaaaacatctacgacatgrtggtgcctttcccagacaagcccaacctcgatgtcaccagtactatgctgcagcaggtaagctctgggctcaagcctggggtggtgggggtcgggggtggggcgcaaaaaaagggagtcacagatgggcacaggggcgggaaggtttcgggtactgagcagcagcctggtgtgtctgtaggagcagtgagctggggtcggccccctcagtgaggtgccagctcctccctccaggctccacagtggcaggatgagagcaacaacgcactttcactcatctgctgtgggagtgagggccctgcctctgggaatggtggccacagagcagagaagctttcatgcacagggagttgacccgagatggggaccccagccctgtccccaggccagccagagtgggctccccctgacctggctccacacccctcctccagggctggaackccacgcacatgttcygggtkgcagaggagttcttcacctccctggagctctcccccatgcctccygagttctgggaagggtcsatgctggagaagcyggccgacgggcgggaagtggtgtgccacgcctcggcttgggacttctacaacaggaaagacttcaggttcagacatgggaagagcacgttctggggttccccggttctggggcccggggaaaggcaggcagcccaggcgcagggaagctggttcccaggcctgcctctaccctaccccagcactggttggaggctgggtctgttccagggytagggggtataggaggcctattagtccaccttctctggcagctttgacaaatagtcacttctataccttggaatggaggaagaaggcccaagtggtggtgagccagggcagggtaaagaatttgcttgtttctgccaggcacggtggtcacacctgtaatcccagcactttgggaggtcaaggcgggtggatcacctgaggccaggagttcgagaccagcctggccaacatggcgaaaccccrtctctactaaaaatacaaaaataaattagccaggggtgatggcgggcgcctgtaatcccagctactcaggaggctgaggcaggagaatctcttgaacccgggaggcggaggttgcagtgagctgagattgtgccactrcaggccagcctgtgcaaaagagtgagacgctgtctcaaaaaaaaaaaagaaaaaaagaagttacttgtttctactgcggcttcatgccccagggcagctccctcctcattcctgtctttcaggtgccaatctgccctgtgccctggccctgccctgttctgtccatccgtcactctcaccctcgccctctctaygccccaggatcaagcagtgcacacrggtcacgatggaccagctctccacagtgcaccatgagatgggccatatacagtactacctgcagtacaaggatctgccygtctccctgcgtcggggggccaaccccggcttccatgaggccattggggacgtgctggcgctctcggtctccactcctgaacatctgcacaaaatcggcctgctggaccrtgtcaccaatgacacsggtatgggagggctgagaggcccccacccagcctcacctaaaccccrctccaccccacagcaggacctcacttgccccactcagctctgcccttctttctgcctcccggccccaggtcaggcagggttcgggatcctcctagagcctcacggtgcacactgcgcccagctcagcacacctgggggtcctcttccaagcagggcccagggtctcgagggccagccataccttctctgcatctccctggcctcactttctgctgccccgccagcccacactcttaggggaccctcttctccctctgacctcttccctctcctttcatctcatctcccaacagaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcggtgagaggagggatagaaaagccttcgccccagctagccctccccagcctcctggacagccaggcgcctcctgccccagccagttctagcctctcctctctaatgatgtcccccgctgtgacccacygccttctcctttcctgcctgaaactccctcttccaggaagtcttccccagttcctcaggatggggaagsgttgccgggtggaaatgccttttctacaaaagytaaatccatctgtttgcaacctctaggccctaagacaatttaaccatccttttccagaaccaagtatcaggggatctgtcctcctgttacccgaaacgaaacccactttgatgctggagctaagtttcatgttccaaatgygacaccatacatcaggtattagcgcccccacccyacccacccccagtactgtcacaccctcaatccacttctcctcctgtgwtcctagctgcctcatccccagggcttgtccycatgctcctccagacctcaaaggcctggagttagagtggcccactctcctgagcctgtcttgggtctcccttctcccccaagatagcttctggtccagcctctgccctgcaggaagctggatggtgcctgggtaaggaacccctgttcctggccccccatgatcttccctgactcccaccctgtgcctgcaggtactttgtgagttttgtcctgcagttccagttccatgaagccctgtgcaaggaggcaggctatgagggcccactgcaccagtgtgacatctacyggtccaccaaggcaggggccaagctccggtgtgtggtgggaagccgggggaagtgggaggcagagaggagcggctggcaaagggtgtggcaggaggtgtctggctgctctgatggggtggggggcaccaaccacagagctggactgatgtggatgcctgtctcctcgctatgtcatcaaatatttattgagtgggccttctggctggcatggggcgacacaaatgccccctgccaccatcagagagatcccaggccccagggtcttattgccacagtttctgcagtccaytggggggcggaagtggccaggggcatgtgggccggggtccaggagcagactccagcctgagtcccctgtgcccatggtacccactctgcccaccaggaaggtgctgcaggctggctcctccaggccctggcaggaggtgctgaaggacatggtcggcttagrtgccctggatgcccagccgctgctcaagtacttccagccagtcacccagtggctgcaggagcagaaccagcagaacggcgaggtcctgggctggcccgagtaccagtggcacccgccgttgcctgacaactacccggagggcataggtaaagccctgagtgaggatggtgtggggctaaggtgggtcctcaactctgggcttggcccaggccccaggttcctggtcagctcctaccagctgagccctggtaccctgtcctggagggccaggcagccccccaagctcatcagcagggcctgcgagtggggacaggcatgtctttcccccagcatcctagagagggtgtgctcagacctgagggcccctccccttccagaggaagccagacacaaggctctgtgaggtcacactgcgggctccrctcttattggccaggggacggtagctgcaggactctgctctcctgcggccatgggccagggttgggctactgcaggacttcccagcctcctcttcctgctgctctgctacgggcaccctctgctggtcccyagccaggaggcaycccaacaggtgacagtcacccatgggacaagcagccaggcaacaaccagcrgccagacaaccacccaccaggcgacggcccaccagacatcagcccagagcccaagtgggaccatgcaggggaggggcagggtgccaggggtgggagaggcggggccgggtagggacagggsagggtacaagggagtgcgagagggataatggcttctggtgagaccacaaacctggagargggaggcagaggtttgtctgtttccctgcactctgtcccacagacctggtgactgatgaggctgaggccagcaagtttgtggaggaatatgaccggacatcccaggtggtgtggaacgagtatgccgaggccaactggaactacaacaccaacatcaccacagagaccagcaagattctggtgggagccacctccccacccccaaacctgagcatgtgcabacacacagagatgctgtcccgctcaccacacagtggggctgccaccacattttaaattgaatatttaaaacaatactcaatttcgggccgggcgcggtggctcacgcctgtaatcccagcactttgggagggggaggcgggcggatcacgaggtcagatcaagaccatcctggctaacayggtgaaaccccatctctagtaaaaatacaaaaattagccgggtgtggtggcgagcacctgtagtcccagtactcaggaggctgaggcaggagaatggcatgaacccgggaggcagagcttgcagtgagccgagatggcaccactgcactccagcctgggcgacagagcgagactccatcaaaaaaaaaaaaaaaaaaaactcaatttcagattttgrtgaacatttactcaatgcctgagcaattmttctttccttaaaaatcagtctctgggaggcctaggtgggargatcacttgaagccaggagttggagactagsctgggcaacatagcaagatcccatctctattcaaacaaacaaataaacaaaaatcaatctctagtaacagaataatttgtacataaataagtggtgctcaagtcgttttttaaaagattgaaagcctctgtttgtctccyctacaaaaggggctacacttcctctttaccctcattccctgcctrtttggctgagcacaaattatgccactgagccacacactgttactgttccttggcactttgatctgttgcctcatctttttctcaacagccttgcaaaattggtgagcttattcccattttacagatgggatttgatattaactctgaggttcagaaaggccacagagctaataccaagctggctccttcctaagggcctttamgacacttgggggtcttctcttctctgcccctgcctggatatgtgttgcttgaccgcaggcatccagggagggtgagtactgcatccaggacgttatcagcgtccagcttgcagagagtcttataggcaaaggttgcaacttaattccactgccccctcaccaccacctccagccctcagctcccacttggggcctcccgctcagaggctgctctggagctcctgggccctgtgacaccatccccctgtgccctcagctgcagaagaacatgcaaatagccaaccacaccctgaagtacggcacccaggccaggaagtttgatgtgaaccagttgcagaacaccactatcaagcggatcataaagaaggttcaggacctagaacgkgcagcrctgcctgcccaggagctggaggaggtgtgtggctcgcaaggtacagggagaggggaatcctggggcagtgagcccaacacagggtctggcctggccttcacgctgcttcctcttcctcgttgtatcaagtcatggcatctgccatgcgatgtgcacctcagaactgctgagagggcakygctccccagctccctggctccccacctgccagcccatggggcctgggggyagtgcaggccccagagagaccaagtgcaaaggagtacagctcattgcctctccttcctcctgcagtacaacaagatcctgttggatatggaaaccacctacagcgtggccactgtgtgccacccgaatggcagctgcctgcagctcgagccaggtgagagctcatgtgcaggctgagtgagaggcgagggctgggactggcatggggcccgggggtgctgggtgagagcacagagttgggytcccctcgctcttggggtcagcgtgcccaggaaatgccctttcttgttttccacgaggggggcttctctgccccactgagagccggcacctacttcataccatgccccgatcagctgcccctccctcagaaccgccctctgcttaagggtgtccactctctcctgtcctctctgcatgccgcccctcagagcagcgggatctcaaagttatatttcatgggcttggactccaaatggggggaactcggggacactagctccccccggcctcctttcgtgaccctgcccttgacttcctcaccttctctgtctttcctgagcccctctcccagcatgtgactgataaggaaattgagtcacacagcccctgaaagcgccagactagaacctgagcctctgattcctctcacttccctcmcctaccctgccacttcctactggatagaagtagacagctcttgactgtcctcttttctccccactggctggtccttcttaccccrgcccgtttgaaagagctcacccccgacacaaggacccgcacacagatacctcccagctccctctcaacccaccctttccagggttggagaacttgaggcataaacwtkcttccatgaggaatctccacccagaaatgggtctttytggcccccagcccagctcccacattagaacaatgacaaatagaaggggaaatggaarataaacaggagaaacggttttcccaggacagggtttggcctacaagttgtggatgtgggtacccatgccaagtktgaggggaggctggccgggtgtggtggctcatgcctctaatcccagcactttgggaggccaaggtgagtagatcacttgaggccgggagtttgagaccagcctggccaacatggtgaaaccccatctgtactaaaaatacaaaagttagctgggcgtggtggtagatgcctgtagtcccagctacttgggaggctgaggcatgagaatcgcttgagcccagccwgggcaatacagcaagaccccgtctctacaaataaaatacaaaaaattagttggatgtggtggtgcatgcctgtagtcctagctgctagggaggctgagatggaaggattgcttgagcctgggaggtcaaggctgcagtgagccgagatggcgccactgcactccagcctgggcaacagagtgagaccctgtctcagaaaaaaaaaaaaaaaaaaaaaggagaggagagagactcaagcaygcccctcacaggactgctgaggccctgcaggtgtctgcagcatgtggccccaggccggggactctgtaagccactgctggagagccactcccatcctttctcccatttctctagacctgctgcctatacagtcacttttatgtggtttcgccaattttattccagctctgaaattctctgagctccccttacaagcagaggtgagctaagggctggagctcaagscattcaamcccctaccagatctgacgaatgtgatggccacrtcccggaaatatgaagacctgttatgggcatgggagggctggcgagacaaggcrgggagagccatcctccagttttacccgaaatacgtggaactcatcaaccaggctgcccggctcaatggtgagtccctgctgccaacatcactggcacttgggtcccttcattttcctcaaagaggtgctgtgaaaccccaagcctaggaaaaggtagatccctggaggaggcaggtaatgtggtgttgggagagcctggctgtgtcccctctgtaggctatgtagatgcaggggactcgtggaggtctaygtaygagacaccatccctggagcaagacctggagmggctcttccaggagctgcagccactctacctsaacctgcatgcctacgtgcgccgggccctgcaccgtcactacggggcccagcacatcaacctggaggggcccattcctgctcacctgctgggtaagggcacatgtcgggccttgaggagggtaaagacggaccacagtgtgagtgagggttgggacagggctgactagagggtagggagcaggctggggactgagagactccagccctgtgggggatggttgcccaggctggaggggggtgggcgctgggagtggggagccccccacttgcatctggtgccacattcactgcagatctatgtcgggcaagtcaccatggatrggggaagaagttaataatcttgtccaggagaccacggcacccatcacaacattgtgtgatcttagagggcgaggaagaggctgtgagtgggagctggggaggctttgccaagaggtggcctgtgagcagggcctcggaagatgacagggtttgacagatgggaagtgggggatgagaggacagacgcagtgttcaggccaagggaactggaacaaagaagracctgagaatgtaaatctacttcaaccctggaccctcctttgccaagggctgcaatctcagatgccctgaatgtgtgaagtaggcggtgaggacagtaagggatggtagggagtaaggcaaagcagaggctactggttctctgtccctgatgggctgttaggaacactttcctggagcagagagaccagacaggccctcagaccatttagaaactataagggaggccccagaggacggcctggctgtgggtctagctcccacacaggctgggagtccagccctcttcagcccctctctggtgagaccaaagaacatctggtgatgtcacagtggacgtcagttcaccaactgggagacacaggccccgggaagaaaagcaacatgcccagcgtggcctgggagctggggcagagctggccttagaactcagcccctgacaattggtaaaaggggaaaggggagcaacctaacactgatgcgctctctgtctctctctctggctctctccctggctctctccctcttctctctcatgttctctccatcactcatcgctctaaccctctctcactggtttgcacttyagacttcatctgatgtcagccgaagcttcacctcacttggctaggaaagagccttgagtccaaatctgtttctgagccttccattcatcctgagtttcttccttttcctctgtcgtggagaactaggctcttttcttacactaaactcagaggcatcagcctctcctgaaggagacggctggttcctgtcagagttgctgagctgcagacaccgacctcaggtggtgcggaggggacatggcagagtggctggtgaagagagcagcctgccagcctttcaatcccagccctgccacttaggagccgtgggcccccggcgaggggggcggtcacttaactctccagcctgtttcctttactagccaatgggaatcgtgacagtacctgggtgcagacaggattgaaagtgaattcacacaatgttcttggtgcagagccaataagaggtggccaccggggtgtaggtgttctggggacctgtaatgtcctcacatgtcagcagttgctagtcacattggtctccactgctcacggacagtgaagaccacctggattccctgataaccagcaaggcccccacctagagccaggcagtaatgacctactgggctggatatgcacaccaaagatgatgtgtgcctcaaagcttgcaaacagtaggtgctcaagaaatgccactatgattagcaggactgggatctggagcgctcttcctgcaggagggcattgagcctaagtaacatttgtctttcctctctctgccrtcccccacactcgcctccagggaacatgtgggcgcagacctggtccaacatctatgacttggtggtgcccttcccttcagccccctcgatggacaccacagaggctatgctaaagcaggtccgcaccagcccaggggcagggaggccccgcygggatgggagggaccctctgattcaggagttccctccagtttagccctcccscgggatccccacggcagcaygcagtctgtccccggaacccccagtttgggcagaactccctctgcttgcagggctggaygcccaggaggatgtttaaggaggctgatgatttcttcacytccctggggctgctgcccgtgcctcctgagttctggaacaagtcgatgctggagaagccaaccgacgggcgggaggtggtctgccacgcctcggcctgggacttctacaacggcaaggacttccggtacatccagctagggctcaggtctcgttcctgagccccacgggcaagggaaatgarccaagcaaagggtccactactgtcccccagctggagccagcagggcaggatggggacagggccagagtttgggactgagtgtctagagaggtgttggcttctggcaggaaaaccccatccgcctgatggggacttctgaagcacgcaacagctctgtcagcctggccgctgggaagtgctcaaggtcccagtcctgggtttgagcatggtaggctgccccgcgtccctccttgggagcagcccctgcatggagctggcctctccctgggggcacatgctgtgacacagggaggcacacgaggatgttgggtgctctgtacagatccactctcacccctgacaggytcagaagctgccttccttggaggatggcgttttagttacctattgctgtgcaaccaagcaccccagagcttagccttacgaaacaaccagttgattttgcttatgattttatgtgccaggaattcaggcagtacacagtggaaatggcctttctctacagggccccctctgttgggggcagctctcacagccgggatggctcaatgggggccatacgtccagagccccagttctggctgtcggttgaggtcctcggtttttcccatgtggcagatgctggggcacatgttcccagtggcctcttggctcacatgttgggtgcttggggtgagatggctggaacggctggaggtgggtcaggcatctctccaggctagctcgggygccctcccagcrtggaatctgaggtgggcagatttacctggcagccagcatcccccrcagcaactactgacgcagccagttctcaaggctaggtccaaaactggcccagagtcacttctgccatgttttattggctagaacaagtcacaagttcacccagattcaagagaagagaaaaaagtccctcccacttgggagaagtgrcaaagaccatctgtcacagctgaagaagtgtctcttacaaggagaacagacacggggagcctgaaacaaaacccgatgggattccctgggctgtgcaggcccttccaggcatgaggactcagccacagggctgagaggagacaggatctgggggatgagagcccttgtggggtcttcccttttatggggagtcagaggagaagctggatagatccccagccttgtggccaggatgctgggcagctcttccttccccctccccgatgagaatgacagaaaaacaggattcacctgagccaaaaggcttccagttagatccaagagagaatttcccgcagtttgaattggtttgctaaacaacaaggaagggctgggtgcggtggctcacacctgtaatctcagcactttgggaagccgaggcaggaggtctgcttgagctcaggggttcragaccatcctgggcaacatagcgagaccccatttcataaaaaataaataagtaaatgasaacaaggaaggactgacgagagacggtagaaccttctggtttgggcagctctgcagctgccattcatcctggccataagaattcttggggtgaataagtttgtcgctgttgggccgcatgagatgcagaatcgcccactctcacccctgacagaaacagttgtttccttcagggagcctccrtcttgggagataaagcatgtgtacatgggaacccactggccacacattctctagaaagtacacaatgtcccagtgcctctagagcaagcactttgtacagtcagaaagcaacaggtggtgggggctggagtcattcaggaaaatgggaggcagaggaatggcctgaacggcccgatgctaggggcttctgcccccagattccctcttacgcacactcagtggttgcccttcccctccctccccacagtgctgtgtcccctgcatgctgcagtgctggggtctgccctgggtatagcaaggcccactgttcccttatgcccagggcttctcactgtcctctcccaacaccctctcccccactccactattcctaggatcaagcagtgcaccaccgtgaacttggaggacctggtrgtggcccaccacgaaatgggccacatccagtatttcatgcagtacaaagacttacctgtggccttgagggagggtgccaaccccggcttccatgaggccaytggggacgtgctagccctctcagtgtctacgcccaagcacctgcacagtctcaacctgctgagcagtgagggtggcagcgacggtgagagagaagcgggaggccctggtgggctgaggaccaagaaagggtggtgagcttgggaggtgggaaaggggcacttagtggcccatgggcagaggtgtggggcagagcaatyggaaggaagggagccacccagwccatcccaggaggcaggtcacagggcccaaaaggtacagcacccccacccctccaccatcacaggcacaccagggccaagccgctaggaccctgggtctgacagctgggctcccttcccttgcagagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggttctggaacactcccacgggatgygggctgggggatctctgcgagtgtctgcatgtscctgggtgtctggatgggccagggtaggggagtgtgtgtgtgtgtgtacactattgtgtctgtgcatatgatgtgtgtggtgyaagtgatggggaaaacggggtgattgtgcacagaggcccagcacgcaggagaatggggtgcycaktatagccccaagtgcagggaccctccctcaagtcaaaaatgccacccccagcctggttctccccaaactcatcttccaacatatattcccactcgacaggctgaagtaccagggcctctgccccccagtgcccaggactcaaggtgactttgacccaggggccaagttccacattccttctagcgtgccttacatcaggtaaygggaaaggcaggagggcacattgtgaggggcagtacccacagctttgtgtttcaactgcggccactgcccrgtccacaagctctgtcagtcagggcagacccgggggagccggccgcacggtgcaggtgcctgggcccactcacactgccaaggctgatgggttttttcttgaacattcttttgatgagagtctgtaccatccaaacagttgaacacagaaactcaacctaataattggctaatggttaccagaccttggttaagtagttaacattaaccacgactcatggctggatcatgagctctgcactgttttgttttgcttttaaaacaagactgtgattcttttactattattgaacattgtctgcgatacaatttgaattgtacctggaagcccttctagacactaaaatgtaggattggagatcggttaaggtgggaggcagggttgctggggcaagttacagtcacaggctggggtcagacagaactgggttcaaacyccgtctccattactttgtttccttgagaaaattcctcaatttctgtgagcttccatttcctgacctgtgaaccccatttcacaggatgcacgatggctaacttcttagcattctgtctcatacacagcctcctcagggaggggtggccaggaccccactattcatcactctctagtggaatgtagctgcacactaggtctgcaggtcacatggccacagatgagtgtgcccaatgcagcccctctccttctgtgtgccccgggagagcacttgctgagggctagcaaggctgtttgtgatccgggaggctccctgggaggctgggggctagagagacctcaggctggagttccaggtgcccccgggctacaggtagcccaggccacccccagagggctgtggctgcctctggccctggcctcccgtggttcctggaagcccagcaagggcagggcccatgcccaccttgcctcctggcacctgggatgatgccagcacatcatcaagtgctaataactgattgtgggatggatgaagtctgtccccagagtccaggaagagggcatccctggagcacctcagataggcctgacctagacggtgctccagagatgacacttaggacagggctcccgcctgcctgctggagtggtccctggggttcccagccggcgctggctctcacccgggagccagctggtgtgatggctagcttcccagcttaatgcagacaattctccaaacaggggtgggcaaaggagacttggctgctctagaaaaacattccggattctggccagcagccttcacaaagcacttttaggaaagaccagggaactaggtggtacatgcttgcacccagcattcaaagtgagaggcctgtgccactggctcaggacatttaaaacctcttcagactttaagctggggagaatcctccagccttgactggcagatttctaccagggaattcgtgatgctttggataagatcatgtrggactggcttccctgcccagaccaccctagtagatccacacggcccatttggccacaccttgcctctacttgcatataccccagggatggagacctcactgcctccaaagccacctgccagatctctgaaggctctgccctgaccccatggagcaggccctcctgagttgtggaggcagctctgtgggtgggaggcatctacacaggcacggctaggaagaggctcagacaatgctaagagctggggtgggggagctcaccctgatagctgtgggcagagttggggggccttggctctgctgtgcgcatgtgacttagcacacrtcacatgtgatgtgcagaagggcctggggcccagtggcacaaggccctcaaccaactccgccccgggccacggcctcgctctgctccaggtacttygtcagcttcatcatccagttccagttccacgaggcactgtgccaggcagctggccacacgggccccctgcacaagtgtgacatctaccagtccaaggaggccgggcagcgcctggcgtgagtgtcctccagccctcctttgtttccatgctctggcctgcgcccctgggccttgaggggtctgtccactggagcttttgtgggaacacttgccattttgagccgggaactcccacctgcagcgtgggccaggcctgattgccatctccttaggcacctggagccctggggccctgggacaagtttcagctgggagtgggtatggagagtggatgtcaggtgggggcaagaggggccatgtccttctgactctgcctccctgtctcatgcctccccaggaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgcygaactccggtaccgccacccaccccacctccagccttgggtcttaaccccctccccaggctgggcagccatgcggctgacctcggagcctggccctgccccgcayccttgccctgccctgccctgccctgcccatgctgtctccttgcttcccrctcagctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcrgctcttcagcatccgccacmgcagcctccaccggcactcccacgggccccmgttcggctccgaggtggarctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttragggacatttttatgacttttatgtgtatgtttatgtagaaatttggaaaatacagaaaactgtaaagaaaataaaagccctttatatcaacgtcaagagataagccctgttgacgttttggtgtacaacttgccggacttcttctcagcacatgtgtattttaaatgggatcacaccatatttacagtcatacatccttttatcacttcatacaactagatctgtttttctgatatttaaatgccagacttcgaacttggccaatagaagttggtccatttgctggggccaggggctccccagccacccgggcccctctgtcaaaccctcagccctgagtctcttctgggctttgctgatgtcttcaccctagctaggtccatctcccaatatstgtcccccttagtccacagcttttgccccccaatccaggtgccgtgcgtgtctctgtgtgtccgtgtctgtgtgtgygttgtacacaggcttggctgttacaggcccattctgtaaggcaggatgtggggctgaggtattttaggattgaaagagggtggaagtttatgattacataggacaatggaatttataaacatgtcctctaaatggttccragtcatctaccaatgaagacttcttgaattatccccccttttcccagcctgttttgaaagctctttgtttaccagacaaaggtcatcaatcatatgacccyctttgccttttttttttttttaagatggagtctcgctcttgttgcccaggctagagtgcagtggtgtgatctcggctcaytgtaacctccacctcctggctttcaagcgattctcctgcctcagccttccgagtagctgggattacaggcgcccaccaccatgcctggctaaatttttgtatttttagtagagatggggtttaatcatgttggccaggctggtctcgaattcctgacctcaggtgatccacccacctcggcctcccaaagtgctggaattacaggcatgagccaccatgcctggcccccgtttcctatttttatgaaccacagcggttcatgctgcctgtcagagcttctgggccgcgtgaggtcaccagctttcaacacgcaaaggactgcactgcagctgggggaagagaaactccacactgcattggcctggccagccttaccctctgggcttttgaaatagtatcttttttctgtttgttttcaaacagagtctcgctctgtcgcccaggctggagtgctggagtgcagtggcctgatctcggctcactgcaacctccacctcccaagttcaagcgattctcctgcctcagcctcccgagtagytgggctactacttcaggcgcacgccgccatgcccagctaatttcttttgtattttagtagagatggrgtttcaccatgttgcccaggctggtcttgaactcctgagctcaggcaatccgcccgcctcagcctctcaaagtgctaggattacaggcrtgagccaccgcgcccggcccaatagtatcattctttagatgcctgcctctgcctccttgggtgagtggggagaggcaggggatacctggaargtagcagaggaagaggaggcggtaacagcaggaagaggggccascccagtgttttctactggtggccctgaaggctgagcccatccccgtgccrtgcctgccaatgccgctcttgggagaccagctctcacctacgctagccacaggtggtggctgccagacagtttctctgatccccacagccctccccaccctctaccttcctctgtctgcctaacccccttcccacccaccctggcttttaacataagtgaaaaagtggctaaccccacctctgcacttatcacctgtgtgaccttgggcagtttgtttttgcagtctgcattttcttttcttttctttttttttttttttttttgagatggagtctcgctctgtcacccaggctggagtgcagtggcgtgatctcggctcaccgcaagcttggcctcctgggttcacgccattctcctgcctcagcctcccgagtagctgggactacaggcgccagccaccacgcccggttaattttttgtatttttagtagagacagggtttcaccgtgttagccaggatggtctcaatctcctgacctcgtgatttgcctgcctcggcctcccagagtgctgggattacaggcgtgagccaccgcgcccagcctgcrttttctttcttacggttcttatcaaccctctcagcgttgccatgaagatgaaatgagatgatgtacaaagtcctagtagagtgtcttctctttataatgaatgcatcgtctcctgagaaagctagtttcataacaaccccagatcagccaagtccagatcagccctctcacttgagacaggaagaggacycggggcaactgggtgccggagctggactgaaaactcccatctcccagctgccttccaggaacttccccaccacacgtccttgcacaaccagtcaactgtcttcttactgggagcacacagagctcgtccactgggggcccacagcttgcctcagttccaggagtactcagccatctccctgtgtcgcctctccctcatcatccctccccatgtcacatctccctcagcctctccgtgttacctctccctcatcctccctccccatgttgcctctccctcatcctctctctcatcctccctgcccgtgtcgcctcttcctcatcctctccctcatcctctccctcttcctctctccccatctctcctctccctcatcctccctccccatgtcacttctccctcatcgtctccctcatcctccctgccctgtgtcgcttccgcctcatctcccctccccatgtcacctctgccttatcctctctctcatcctctctccccatctctcctctctctcatcctccctccccatgtcgcctcttcctcatcctctctccctatgtcacctctccctcatcctctccctcatcctctctatactctccctcatcctccctccctrtgtcgcttctgcctcatcctctctccccatgtctcctctccctcatcatctcccctcaccttcgaggatccccataagaccctgcctggggatttctatcttgccctctgtctcctaactcttgctcatagygctcaccccatttcctgtcctgtgtgcctggcgattccccacctgtgtcctccaggcccggtgcttctgatttttagcctactgtttaatctggctgtcgagagttttgtcgttccaatttaatccctatatttttcattttagcatccctgcttctttcaaacctcctgggttttcataaacgcctgtttttgcctcacagattctgttctctgaatcactttaaagacctggtttttttaattgtggcaaaatatacataatgtaaactcaccatcttaaccatttttaagtgtacaattcagtggcactaagtacattcacattgttaattgttgtgcagccatcaccactgtccatctccagaacagtttcatttttctgtgtgtgacaaggtgcccccaaaaagtgtgcttactctgttgtccaggctcactgcagcttcaaccttctgggctcaagcaatcctcccacctcaagctccacagtagctgggagcacaggcatgaaccaycacactcagataattttttttaagtttttagtagaggccaagcacggtggctcacgcctgtaatcccagtacttgggaggccaaggcgatcggatcacttgaggtcaggagtttgagaccagcctggccaacaatggcaaaacctcatctctgctaaaaatataaaaattagccaggtgtggtgggggtcgcctgtaatcccagctatttgggaggctgaggcaggagaagcacttgcacccgggaggcagaggttgcagtgagccaggatcatcccattgtactccagcctaggcgacagagcaagactctgtctcaaaaaagaaaaaaaaaatttttttttggtagagatgggatctccttatgttgtccaggctggtctcgaacttctgggctaaagtgatccacctgcctcggcctcccaaagtgctgggattacaggtgtgagccacagtacccaacctctgtacccattaaacagaaaaatcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtttccttgatatagattactccttttccccttagctacatcattttgtaaaatgttataaaagactgaagggtgccatagaagttccctttcctcttttctgttgaacttcattatagatgattaacttccctcttccttctcctacgcaaagacctcacgactgtcacattgtccaagatgtgttaaatgtactcttttaaactgaaaaaaagaaaataagctattactaatcaaattgctgtacctcataaaccaaacttatatgggaaatgttgtgattctacctaatttcttagttttctgactataaagtaagaccttaaacttttcagcttcagagcactgaccccatttctttggagcctgtgagaatggccgtcctcagcttcacgctcgaataaacctgttaaactggattctgatcttttttattatttcaggttgacagaacactgtgtgcaaatatctgtttgagtcccagctttcagttcttttgtgtatatacccaggaggattgcccgatcatatggtaattctatgcttcattttttttgaggacccaccagactgttttccgcagcggctctgccattttccccctagcaatgcacaaggtttccaatttctccacacgttgaccgactcttgttttctgtttttttgataacagccatcctaatgggtgtgaagtggtggctttgatttgcctttccctaataattagtgatattgagcatattttcctgtgctgatgagcagctcatgtattttctttagagagatgtctacccgagtcctttgcccatctttgtttttgttgtcgttgtttgtttgtgtttgtttgtttgttttgaggtggagtctcactctgtcacccaggctggagtgcggcgaggcaatctcggctcactgcaacytctgcctcctgggttcaagcaattctcctgtctcagcctcctgagtagctgggactgcaggcgcccaccaccatgcccgactaatttttgtatttttttagtagagacggggtttcaccgtattggtcaggctggtcttgaactcctgacctcaggtgatccacccacctcagcctcccaaagtgctgggattataggtgtgagccaccacgcctggccctttgcccatctctgaatgtttgagtttgaggagttctttatgcgttctgggtattaattccttagcagatctgagagtaacagatattttctcccattccatggattgcctttttgctctgttacagtgttttttgatatgcaaaagtttaaaattttgatgaggttcaatttgcttattttttcttttgttgcctgtgcttttgatgtcatatccaagcaatcattgccaaatccaatgtcatgaaacttccctctgtgttctaagaattttgtagactttgctcttttgttccctctttcttctcctacacaaagatctcatgactgtcacattgtccaagataaggtgttaaatgtactattttattatttttattttatttatttattttttgagacagagtttcattctgtcacccaggctggagtgtagtggtgtgatcttggctcactgcaacctctgcctcccaggttgaagcgattctccagcctcagcctcccgagtagctgggattagaggcatgtgccaccatgcctggctaatttttgtatttttagtagagacaggatttcaccatgttggtcaggctggtcttgaactcctgacctcaagtgatccacctgcctcagcctcccaaagtgctgggattacagacatgagccattgtgcccagccttaaatgtactcttttaaattgaaaaaagaaaataagctgtgatccatttttgagttaatttttatacatggcataaagacctgcattttaagtcccttttggattgctctgctacttgtccttcctccattgcagtctgcttcattcattgtgtctgcagtttagcacaagctctggaaccaaccatatgaatttgagtcccacttccaccatcygctggctgtgtgactatgagcaaattcctcaaccgttctgtacctctctttcctcatctgtaaaatgggagcgttgatcacagtacttacctcatgggtttcttgtgaggattcatatgttgaaagcccccagatggtccctggcacctggaaccaacccacagtgagggttggtaattattattgtccctcctaaaactggattttctcttatacttggtaaactgtacctatcagccatcttcagttgggttggaatggcctgcacaatcccatgcatgcacctgacgcttgcaggggctcccagcttggcagagacgccatttccatcgggatcagctatccccccacaccaatgctgcagctctctggatggatgcaccctgacctcccctgtgttagaggagaggtgggcgtgttgaatcatggaggcagacttcycctttgccgttctcgtgatagtgactgagttctcaggatctggttgtttaaaagtgtgtagcgcctcccccttctctctctctcctgccaccatgtgaagatgtgcctgcttccctttcgccttccaccatgattgtaagtttcctgaggcttccccagccgtgcttcctgtacagcctgtggaactgtagagccaactaaacctcttttctttataaattacccagtctcaggtagttctctatagcaatgtgagaatggactgtctacatgcttgaagcaggaagggagactttcctgtgagctcagtcgatcagcttaaccagaagtgtcactatttttttctttctttcctcatgttataaatatattttacccataatggatcatattggggggttatttggtcagtttctctagtcgtggtatcagcccatgtgtagaggtagggcctttttgaagatgtgagccattgtgggctgagagtgatggaaggcaacccagggtacagggattctgagtgtggagggaagtgagtctgaggagaaatccaaggtgagacagatggagctggcctccacagacctcagtgcaagagtactgggggtgaccacaggcctacagagagctggtgtcttgccagctggttttcagatcaggctcaggtactcatgggcatgcaccctggatggagggtgcccgcctcacctctccacaccccacccagtccctaccttgtgtgccctctcctaattgcaaactcataacatcagggtctccctggagaaayaggtatgatggggagggccctgcacagccctggggttgattgcacagcccataagagagaaaaagcccaaacaygtgaacataagaggtcaagttagaagaacctagagagataacctggcttccagagacccagatatatcacatccatccatccatccatccatccatccayccatccatcatcccatccacctgctcagaagtggtcccagcctatggagggagggcctcatcaatccctggccataacccaagggtggctcaagccccagggaaaagtggccgaggagagcagaacaagttctggcctaaaagtcaagacccctggttcctctttttggctcgccattagctaactacatgaaccagatcatttggcttgactttctggacctcagtctccccacctgtaaaatggggacagttggaccaggaggtggatggggatttccagttctaacattctgtagctgagcctctggcctctgacgtcacaatatggagctggcctcacccagctctgctgctctgttggtcatgggagcaaggtggacttgccctggaccttccctacttgtgctcctctgttatgggcagctcttgccttggctcaggatcaagggtgaacacagtttaggtgtggctgggaccccaagaagcatgggaccagacaaagggactgggtgcggacaggaccttctcagcacatgatgcccatatccttccctgcagatgacttctacaatgagaccgagaccaagatcttcctgcagttttatgaccaaacaggtgaagttgtgttgaacaagttcatggaggccacttggaactatgtcaccaatatcaccaggaaaaatcaggaggagatgatgtgataccacctccaccccagcctctcctctctttgctctttttagggatttgggaccatggggcaccacayctcctgcccccatcccaagcaagaggaacaagggaagccccagtgtacatgtcaaagagggctgcaagctctgggcctcctggaagccctaawcttcctccaggcaagaatctcttgcttcttgtcctttgtaaatctcacctccttgcttttagagatccaggtttctgccctctccctctcagcaaatcttgctccctaagccaatgggattagggagtcagttagggtgccatggccctggaggtcaagtgggacccttcccctgtcccccaaccttggtggctctctttgcagctgcacaaggacatggagaggtcccagttcatgatttactttggcacccaggcccacctgtttaaagtcacccagttcaaggacccggatgtgaatggcatgctgagtaagctgcagaacatagacaaggcggctctgtccaaggacgagctgcgggaggtgatggatggaacccccaggcctttaggcacatgctccctggtcctaggggtctggtaggggagacagagtgcctggggcaggagggaggcagggagtggaggaagggcaggatcagaacttcctctggagaaggagaggagtagaggtgggggtaccgatctctcctggctggtggggcgagcactggggggggacctggggcaccagcctaccctgggtaacacctgtccccccagtataacgagcttctggcctacctggagatgacatacagtatggcccaggtgtgcctgaatgaggggccctgcctgtccctggagtctggtgaacacccaagccctgtcccacccaaccacagaatctccagcactcagtcccttccaggggcccctcccagcccccaaccaccctcccttattgccaggagggtgagggaagaggcaagtgggagtgggtcccccatggctccttttctgggcatagaactcgaagtcatggccacctccagggacaaagaggagctgctgtgggcctggcagggctggcaggatgccgtgggccgccagatctgcaccaccttcgagcactatgtggagctcagcaacaaggctgcacagctcaacggtgagcagatgggatgccacagagcttggagtgatggcaaggaaggggcaaagctgagctttcccagagtgaaggtggccgtagggccctggagacaggacctatgagccctgcagctgggctctccaaatattcatagagcacctaggtgctaggtgctggggaggttctgacgacacataggtgaaaagacaggcacctgccctcatgcacctacggtcctgcagggagacagaccatattcagtaaacacctgtctctcactaccatctggggtgatgcggaataggaagaggctgctgagaaagagaatgagaagaggctgctgcagacaagtggacagggaaggcctctgacatttatccaagacctgaaagatgggcaaaagacgggaagcaagatgtgaaagaagagcagcctaggcagaggctccgcggcaggaggagccggtgctctggaagacctgaaagaagcccaggtggccacagggctaaggatgaggtgggataagaggggactcagggccttgcaggcatggtggggagctcggatcatggactttgctcagtgcctttctgaaatgggcaggtattctccccgttttgccaaagaagacccagacggtcagcgaggttgagtggcttccctagaaggcgtctgggtatcctgtcagctaggccatggctaaagggtgagatggtgagctcctggtgagtcctctctcctgtcctaggttacaaagacatgggggccttgtggcactccaagtatgagtcggataccctggagcaagacctggagcggctattccaggagctgcggccactctacctgaaccygcacacctacgtgcgcagggccctccaccgccactatgggcccgagctcatcgacctgagggggcccatccctgcccacctcctgggtaaaggccctgmtggtggccraggtgagtgccagataagggcagagactgtctccagcctcctcttagcccctctcctcctcttccagagaacacgttggctcagtcctgggtcaacatcttagacccggtcctgcccttcctgaagaagatcccagaggatgtcacaaagatcatgaaagtccaggttagtgcttggcctgtctgtccctgcccctccccaytggcatccttggacaaacagggcagcgccccccacaccccctcttctcccatagcactggaagccagagaaaatgttggaagaggctgagacattcttcacctccttggcgctgccacctgccccacccagtttctggaaaaagttgatgctaatgaggccaaccgatgggcgagaggtggagtgtcacatctctgcctggaacttctaccaggacgacgatttcaggtgctcacagcggcaccacacacccggtcctctcctctgccctgtctggctgtcttaggtatgggcaggggaaagccagggcagaggagggagaaggcaagtgagaaacacagaaggaaaggtgacgtgagaggaaagggcttggttgctgggtggatatggggcctggagtaagaaagaacaattgccggccgggcatggtggctcacgcctgtaatcctagcactttgggaggccaaggcagtggatcacgtgaggtcaggagttcgagaccagcctggccaacatggtgaaaccctgtctctactaaaaatacaaaaattagccaggcatggtgacatgtgcctgtaatcccagctaggaggctgaggcaggagaatcactggaacctgggagccggaggctgcagtgagccaagatcgcaccattgcactccagctgggagacacagcaagactccgtctcaaaagaaaaamaaaaaaaagaacaactgccaaggcctgtctgggctccaacccgaccacccaatccctcaaggagtctgaatggggaaactccctttctccatgctccttgacccatgccctttgcttgtagaataaagaagtgcgcggaagtgaccacagaagacccgctctccatcttccacgaaatgggccattccagtacttcctgcagtacaagaacctctccatcatcttccgcrcaggtgccaacccagcctttgaagaggctgtggggtctgtgatcaccctctcggcctcctcccacaagcacctgctcaacataggcctgctcagcctctagcaccaggactcaggtgatgaggatcaagggcccagcaggagggcagcacaagcctgggaccgcagctagggcttggtggggtcagggctctcgggcaaagctacgggaaggagatcccaggggttgcctcttgactgccctcaccctcttcccagaggatgaggtcaatttcctgatgcatattgccctggagaagatcgccttcatcccctttggctacctgatggacctsyttcgctggaaggtctttgacggcaccatctggaaggacatctacaatcaggagtggtggaacctcaggtgggttgggcaccatcttccaccagatgggccatttccaggactttctgcagcacaagaacctctctaatcttccacacaggcactgagcaggtcttttagcctttctaggcttcagtctcctcatctgtgaaaaatggaccctggtgatggccccacctgctccctgggtagctgggaagctcacacaatgattgcaactgagcttctctaatcacagaacactgaccaccaggcaggccctcccaaacctccctcccttcctggtgccaggcaatggagtgtgcgggggcctgagcactttcctttctggggaaagactccccatgggagagaggcaggcccctaaaatgcacgcatgcctgcctcgggcttaacatccccaagctgccatgggaacccaccagcagttgggaggcatcactctcgagtgagggacccccgtgttacacctcatcactgacccctggccatttgatgggataataaatgcctgtgaccagggctcctccatatgtggcaggccgcggactgaccagcttcagtctgctggtcatagtgtgattcggggttgccagggggtgctcctggctctgcaacaggctcttactttttttgtttgttttttgagacagggcctcgctctgtcactcaggctggagtatagtggyatgatcacggctcactgcagccctgacctcccagcctcaaccaatcctccttcctcagcctcctgagtagctgggactataggtgtgcgccactatactggctagttttgtgtaatttttttttaagagatggggttcgccatgttgcccaggtttaaactcctgggctcaagggatctgcctgcctaggcctcccaaaatgcggggattacaggcatgagccactgtgcccggcctcttatgtttaatttgaacatttacaaccaccttgcgttgtgatcacttcaaagcgctcagctcacagaagcaacagctgaagctcacagaggtcacaaaccagcccgaggtcacacagcaaacgagcaggtgacagagctgggagctcctccccttgtcctctyactcccacccttgacttcaggagcaggtctccctggtgggcttggcagagtcttgacctcgtgcctctctaaggtcaccctcataggccatctgaggcacctgcaggaggcctctgtcagccctgcccatcaccccagctgatggaaccctggggctaagcaggaggggtggcaactccctgggccttgaataaggccctgtcaactgggagggaagctcctgacactctgttgaccttggagatggttcagaggctccagtgagccaatgatgaagccttgtttttgagacagggtctcactctgttgcccaggctggagtgcagtggtgcaatcatggctcactgcagccctgacctcctgggctcaagcgatcctcctgcctcagcacctgagtagctgggactacagwtgcgcaccagaacacctggctcatttttgtattttttgtggggacagggtctcactttgttgcccaggcyggtctcgaactcctgggctcaagcaatcctcccacatcagcctctcaaagtgctgggattacaggtgtgagccaccacacctggcctacttcsttccattttatagacattttacaacaagactcggagacaatcagcaactttcccacagtcgcacatctcagaggggcaaaaacagaccttcaggttatcagggtgtgactgtgactggctctgtgtcctgaggccaattccctgatctccaaaccttggtttcctcatctgcaaaatgggaataatagtagtactgccccacagtgatgttactcttttttcttctcaagacttcttactagatgaaatgaccttgtttattggtctataatctgtcccccactgttaggatgcaagcaggggccttgcctcccccgctcccccactggtccctcccccagagaccaggacggtgttgagtgcatgatgcgtgagtctatgtggagagccagacatggttctgagcatagaggaagtgttcagtcagtgttaactgctattgttttactctgattcccaatcccatgtgttttcatttatttaatcaataaaaatgcattaggtatcctcagcctgccaagtccagttttgatagacacgtaggtgctttgaaaagaaaaaggcaggccaggtgcggtggctcacgcctataatcccagctacttgggaagctgagacaagagactcacttgaacccaggrtggggaggttacagtgagctgagatcacgccactgaacttcagcctgggcaacagggcaagactctgaaaaaaaaaaaaaaagaaagaagaaaagaargaaaggaagaaaggagggagggagggagggagggagggagggagggaaggaaggaaggaaggaaggaaggaaggaaggaaggaaggaaggaaaagaaagaggctctgagaacctgccagacaccaccaccaagccctctgccttttccctgccaggttgaaataccagggcttgtgccccgctattcctcactcagaggaagactttgatccaggtgccaagttccacttttctgcwggtgtgccctacatacggtaaaggtctgggccctgttagcagtgccagtcctaggagttgaggggcatgggaactggggtgaggatttgcaggaaggccctaggtccaaatgtcaccctgtacccgtgcccatctcttcctgttgggctgygcagccttctgaggcctctgacctagaatcctttgagcttttgcatcaggtccagtgtagagggcagagctgatgagaatattctagaccatccctgctgtcccttggaggagagcaggtcagaggggggcaagggttggggtgactgctggttcagaaagctagagaaggagagccccccagcactctagggtcagcccaagactgggccctgcccaaggagcctccgctcaggcagtgactgctgacatggggccctcgtggccactgcatgtcagagctgcctggtcccaagtggctctgagtttcccactcctggtctccactccccagcctgccctcacgtttctcaaccaggtacttcctcagtctggtgctccagttccagttccacgaaacmctgtgcaaagcctcgggccacatgggtccactgcaccagtgtgacatctacaactccaagattgccgggaagctcctggggtgagtgccctctccttcatttgttctgggctcccccatctccctttaaggaagtcctgctccaggctccctctccacacctgactacactagacaccttgagcagagcttcattaagcttatattctagcggaatttcttcctcatgtcagactgcagtctttcctacattaatcagagcccatttcctcttgtgyagccttctgtgttcagagacactgcttaggctgggcgcagtggctcatgcatgtaatcccagcactttgggaagtcgaggcaggcggatcacctgagggcaggagttygaaaccagcctggccaacatagtgaaaccccgtctctaccaaaaatacaaaaattagccgggcgtgatggcaggcacttgtaatcccagctacttgagaggctgaggcaggagaatcacttgaatgtgggaggtggatgttgcagtgagccgagactgcaccattgcactccagcctgggcaacaaggtgaaactccatctcaaaaaaaaaaaaaagaaagaaagaaaagacaatgtttagcccctcccactaacacacacacacacacacatgcacacacatatgccagtaagccaaactgtcccagataggaagccagcactggggttctacctcaggcttcagccttccgtccgaatcccccttatcctttccttacaaggtgctgacctaccctctcagcagcacttggcacacccttcagtgcagtctgtttctcccacctcttcttggaggtgcccaaatccagttcccaggctgatccaggttactttcacagtagcctcttggcatgcttctggtcagcctgtggtccactttgacccttgagtctttttctctgcacttggtgtttagcttattctttccatgcttacctatgtggcagtggtttttagtcccaaagcaaaccctgagggagtaggggactgaactgaaaatgtgaagcatttactactacaggaggtgctctctgatgagtactcttacagtgtttcatattataataatagctcttaactttgcaaagtggatattattatctgccttttacaaattatgaaactgaaggcaagagaggtggtgtcgttgtgcatcattcatctagcaagaagcaaagtcatgctttgaaaccagaactgactccagaacacattatctttcaccctgttcgcctccatcattcaaagaatacagcccctggtgagcttagatccaggtctaactggttccaagatcagcactccaaccttggagatgtggagctcacccacygacttgatcattttcctgttgaatttcaacggatttcaataggtccatttccctaattggtcaaggtcatcttgagctttattcctgtctcctagaggattaacactgccacaaatttagtatcctttgcaaatttaatgagcatatttttgattccaccatgcaatttatctgtagccaccaggccagatggggtttcaggactgatcccctgggctttgctcctagggagggctgcaccttgcatgactgttgtctccctagtagatttgctcttccatcctttcacgtctcagggctttattctagctgattgcccagctttgagcttttctgaacatgttgaacataagggcacctctctgctctttgcattcctatctctggctgcctgtcatttattcattcagtaaacatttacttgtcctcatgcagaccagctgctctgcatccaacaggggtagatgaaccacaggataaataaatttcatggccgggcatggtggctcacacctgtaatcccagcactttgggaggctgaggctggcggatcacctgaggttaggagttcgagaccagcctgcccaacagggaaaaaccccgtctctactaaaaatacaaaaaattagctgagagtggtgatggttgcctgtaatcgcagctacttggaaggctgaggcaggagaattgcttgaacctgggaggcggaggttgcagtgagccgagatcatgccactgcactccagcctgggcgacaagagggaaactccatctcaaataaataaataaataagtaaataaataaatttcataataccaggcaatggaaaggggctttcgtgaacatagaaagaggattaggaggtcatgctgggggaccaaggagggagttttgtcctcaaatgcaagtgtgcaagaaatagcagaaagcaggcatggtggctcatacctataacctcaaaactttggaaaagccaagatgggaggatcccttaaacctaggagtttgagaccagagtgggyaacatggttagatcctgtatctacaaaaaatgaacaaaatttggccaggcatggtggcacgcacttgtagtcccaactactcaggaggctgaggtaggaggatcacttaagcctgggaggtcgaggctgcagtgaactgagatcacaccactgtgcttcaccctcggcaacagagcgagacccccgtttaaaaaaaaaaaaaaaaaaaggagaagaagaaagagaaaaaaatagcagatatctgttttcttttcttttcttttcctctcttcttttcttttctgtttttgagacagtctcactctgtcacccaggctggactgcggtggtatgatctcgactcactacaacctccacctcctgggatcaagcaattctcgtgcctcagcctccagagtagctgggattacaggcacacaccaccacgcctggttaatttttgcatttttagtagagacggggttctaccatgctggccaggctggtctcgaacgtctggcctcaagggatccacccacctcagcctccaaaagtgctgggattacaggtgtgagccaccacgcctggccaagatatctgttttcttttacatcaactcacctctttcatcccacctgattggtgggatgtttgacctcagtcattttcaccacttcccacgctcaccccactcaaggtgcacagggctctcagggtctgacttggcaccaaagcatgtggccagtgagtcatctcttgtcattgctcaccagtccctgtgtgtccctggccagactcctgctcagggaaaatcctgattccaggcttaggacttcacataccattttgtgagccgtgggcagaggaaaggtttctgagtaaggaggatatcatgacctttgcagatgatgaaatagcagcagagccgaatatggtttgtggaggggagaggggatgtgagtgcttgcagggggaaaagagaaagattcttggctgctcttttgcctaattgatcttaaaacttggttttgctacttttgattcatcctcctaaatgtgatggccctgagtcaggctctgggctgcttctgttgggaatggagggttgaattgggcctggtcaaagttctcaaagtcacccagcttcaccccaccagccatggtgcgcctgaccttgtccatggggtgtgttgttgtcactttggagttgaaagctccaggcagcatctagttgtcatctctgctgctctctggtctcatgtcctgtccacatgggctgttggctgccctttggtcaaacatcttgtcccacccagcctgaaggactgtttctaaatgggtagattctcaatggttgaagcttttcccctactaggttcttcctcttactcaggagccagcatcagaacctcttacctagagttagttgtggtttttcttctccagtggtatctgccaaggccccactgacctttggtttccctaactctttcttttccagttgtttattaagtgatgcgcataagcctttgcaagctacaaaccctccttcatcattgtgggacttagtcctcatcacaatgagggcaggtattcatggctcccattttactgatgaggaaactgaggccgagagaggctaagttgtctgcttaaggttatgcagtccataagtagcactgctaggtcaggtttaagcctgggccctgttagtctagactctagatcgtgacctctgggcctctgggtcccaagtctgtcctgagagttggatcaaggaacaacaggttgtgaaggataaacatctgcccaccactgcctctcctggggactctggagtggagaagcctggagccctggcttcagcacaccttatactcccattgtgagcccaagggacctagcataaagttcaaccacctgcccctaaggacygggtgtgccgtgaaacacagctgacatttgtgcagcactacaggtggtgtgcggagcacctcccatgctcatgatgtttctaatcctcccaaaccctccctgaaaccagaaaggggtgaagagctgccactatctaccaacaccgagcacctcacgggaaacagtgtctcaggactttatgcctatttgagtccaggagaataataatcatcacagtattaccagtagtactaggaatcatcatcatcatcagtagttaacgtgtattgcctgcatgctatgctcccagcaccgtgtttatttaatcattacaatggctcttcgaggtagataccattatcatctccgttttatggatatggaaactgaggctcagaaaggttacttgcccaaggccccacagctactaaatggcagagctgagattcaaacccagattaatcttctttcaaacttgtgattgtatccactatgccaagctctgcgggaaagttctggctggccaatcgctggggctgggattgggtgcactgggggtctcagctgcaccagctgatgccctcacacagcctcacagctgcacccactcccctagggatgctctaaagctgggctcaagcaagccctggccagaggtcctaaagatgctgactggggagtctgaggtgtctacaaatgtcttcatgacctacttcaaacccctactgacctggctgstgacagaacatgcagcaaggggacatcttaggctggccagacttcagctgttcctttgaaggtttgataatctgaccctggttccagctctgggccagccccaggctccaccttaccctgctctgtcctagtacctamccctacccagccttaacccctggctcattcatgacctggcttgaatcaacagcactgctgctgtgggaccctgtctgtaccaggcctgatgcagcttcagccaagaccaccgctcccaccacagcccctggctcagttgcttccttgcacactgtccagctaggttgccaggctgacatctgagcaaaggatcagcatcttgcctctggtcccttgcatgcaggggcatgtagtccaatcagatctcctctgacagccacaggagaccccaggggtccctctccagttctacccaccctatgagactcctatgtcttccacagaaaaagacacagacaaagtgacattcctgagtctgaagctggaccccaaccaggctaaatttgggtactgggtgctgttggccctgggctttgtcatgtctctggtggtgctggggctggcctgcaggctgcagtccctggaaaaacagtcactgactcaagacactgagatattcagcccactgcccaatgcctgcttcctgggcatagccatggaaccctgccaggctgctaaaggacagtggatgctgctgggcctctgccttgtcctgatgctgtgctcaatcagcctggccatctggattttcacacagtaaagcaggaagcctccaagggtaagagctgaatggtgaagttgggactagacaccagtgaactggtgaggctggggggcaggaggagggaggctgagccagagagttggggggcagaggaggggacagcctgcatgcatagtgcccaattataattgggttcagctgtggcagatctgggtacatgtgatattgtaattgtgtgtttgcaaactcatgtatgtgaggctgtgtgcacaaacaactggctctatgtgattctatgtgtgtcctgggtttcaggccaaactccttcccctggtggctcaggacctaaggttttattgacccagtggctgtgtccctgcaaaccagcccccaccccaagtcatgcccagaattggttctgcacacagccttgtttttttcagtaacccggctatgggactgcagtgcccaaggaatttctgctctggttagaaaaaggactctgcttcagtccacttctgctctggttagaaaaaggactctgcttcagtccacagtacataaaatgtactcaggtaggacaggacattcctttacgaatcaccagtgcccagtttatgagcactgtgcttttataccaaccagcacatctttctgctaatccttgggccagccctgtgttggactacataatccagcccccaaaagctctttgttgaccagttgagatgtaagtagcctcacaaactgccccatggctctctctgccccagcccaagcccttccaaatggagacagtgggttgctgggcattgagccaggcttgattaatgattgacttctttaatatttaaacaaagctcatctccaaccactctgctctggagatggccttgttcaacacacacacacctgctgcctggcccgttgccctggggagcgagcataggacaaacagcacctttycaggctcagtgggggatggggaggacaggaaggagggaactgtaggagaatacttgggaaattagtgctctagaaacaagcctggggaaagaacgggaaggcctctgcctctgcctttcctagttcattatcctcagcctgggtctgcctgccatgaggatcctacattcaatattggggattcagagcgtctggatggaggttgcatgggctcctggggaggctgggagtcagtgtctgtcagagaatagggaaaacttgaggggaaagggcattatagccagtaactacagagaasgggtaccccggctgcaactgagctggtgggagggtggccaaaagaggagaccaggtctctctgaattaagaatctgagccccaaactcaggtgttcaggggacagagatactaggctgagatctccatggaccctgcccctgtccaggtttcaaaaggtctttctgagatctggctgagcccaagcacttgctccagccccaggctccacagcacccttgtttgatgactctgtccctgctcttacttttctgtgccataatgtccttatttgtccctattactagctatcagctctataagagctggatgcacatcaggagtgtgcccctctgtaacaactctagtcagcacaggccatggtgcacaaaagggacttggaaaatgatggaatgagtaagtgaatgaatgaatgaatgaatgtcccactgcccaagtccctcctcagagctcagcaccccatgtactgagctcatgagaaatagccccttcttttcctccacagccagcctgtccaacagaggggcagccaggacatctctgccctcttctcatcccccagccacagtggccaaagaggcccccactaggcactgtggctctgcatgacaaacacacatccagcccaggactctaagcctctcacctggactccagtaaaaaccttgctgagcctccttgtctatccttcctcccccacccaccattgtaaagtttatgtcaccagaatatttctttcatgtctaattgcttaagaacttggttgttcatcaattaaatctagatgttcaaaatggcatctgagggtctttattaattacctccttcctccaaactcacctctcccacacccccttgttccccccaccccagcccctctgcactgacatcacctttggcctttgcctraggtgcatgccccatttgaatgcttgccctccaagatcaggctcaaaattgctcaccaaaccctctgcagcactacaagcccacccagatgctcagtgaacagtagtccccttctccccttcctctccaggaagcctctttcaataaacctattcccacccccatttgctttttctagtgtgttcattttcagtcagtactcagtactcagacacttttatcagtggtcacttgctaataggtggttttaaatctgttctccttccaagatgtacctgtatgctaagagctctcaggcctctgaagaaggcatcttattgcatacttctttctttctttctttttattttcagatggagtctcgcgtctcgctctgtctaccaggctggagtacagtggcgcaatctcggctcactgcaacctccgcctcccgggtacaagcgattctcccacttcagcctcccaagtagctgggattataggtttgcgccaccactcagctaatttttgttttttcagtagagacagggcttcgccatgttggccaggctggtctcaaactcctgacctcaggtaatctgcccacctctgcctcccaaagtgctgggattacaggcgtgagccaccgcgcctggcccttattgcatatttcttgcacgtcttcatgtgtactcctaccccctcctctcaggaccaggccctggctggacttggcggcaggagctctgcatgggacctaggtctcagctgagctggagatcacttgctataagagcaggccagaggcctaatggtatcattgccagggtcgggcccagtggtcagacccggaagaaagctttcagccaaagaccacctgaggcccctaacaaccccatctgtagcccccctcctgcctgggaaactccctgcactgggaggggagactgccctttggtactgggagggaatcggagaggtgctgaggccattggcccttaggacaggaacagaagcagctcctcagagaacacctgccctattccagggccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcctgtggctccgcgcaggggccgcggccgaaggagccggtccgcaggggccacgtcgctccccaaaacacttacctggacaccatcatccgcaagttcgagggccaaagtgagtgtgtgtatgttggggcggggggacgatctggagtcctggttccgtgaaagggggggctggacccctttactaacttctaaccgggcaaggtggtgagtgccgggtgctgaatgaaaaatccttcttttgatgtccccaacaccttctcctccagggggacccgcttgccttaaatgctgtcctcttttctggaacacaaggagcagcgtgcaggccttccctccctactgccagctgtttccttggtgccccaagttcgaacctccccttccagccactgcctgccccctcatccgcgtcctccagaggcttctctgagtccttcttttccttccttttcatatcctggytctggtcttcccaggagctttcccaggcctgacccccatctggkcacatscctgcctcccttccccacacttttcctgtttccaggaggccttgggccttccttccacctcaagaccctcactgccctagtcttcccacaatccccaggcctgactccctccctcattccggtcactgccctgctcctctgcctaaattccccttactgccaccaagagtccttatgatctttccctcccagccgctggatcctggctcccatggactttttgcctcccacctcccaccccaggtcggaagttcctkattgccaatgctcagatggagaactgcgccatcatttactgcaacgacggcttctgcgaactcttcggctactcccgagtggaggtgatgcagcaaccctgcacstgcgacttcctcacaggccccaacacaccaagcagcgccgtgtcccgcctagcgcaggccctgctgggggctgaggagtgcaaggtggacatcctctactaccgcaaggatggtgaggcatactcaggccagaggctttgcagggcaggcttggccctctgtcttgtccagccagggtggccttggggaaggcactgacccagggtccaaagggcctgaacaaaccctgtttcttctaggggccttggttcctccacaggcattggatatgatgccttctgaggtcctttgcaggagctagggatcaggctgggccacccactggtyctggcctggggcagggcctcctgctctgccatccctctgctgtgtccctggtctcctggctctccactatcttactgtcagccccagcggtcaggcagctgggatggaaattaaccttccctcctctccgtctgctccaaggattagaggaggagtcacctcctgaagacctctgtggccaggcaaggcatgggggcttttggctggcaaagtggggtgggcctgccttatccagtctcagctctttggggagacagggtctggagttttccctgaccaagaagctcattcagatggagtttgggttgttactgccagctggagcatactgcaagcagaacagaagcrtaagtcaggagctgaagacagatctcagcagcccttggaaatcctcccccaccccccaggaccacagggtcctcactggacctggcagcatgggtgggaacgaggaaaagagcctgaatgtcctgggaaatctcttgaatcaatggcccccaacctggttctgcatcagaattacccagagcatgttttccaaaacatgctttctctacagagaggctgactcagaaggtgtgagatgaggccaagcgggtgtatttggaaatatctccctggtggttctgatgtcctgcttactttaggaaccactggcttaggtaaatcccttcatttcatagatgtggaagggatttgcccaagatcccactgctagagtccaacctgggactggaacccaagtctctggattcctccctcggagatttcttttgagtaatcccaagaggagagaaaggaccccagctgcctttgtgtttacaggcaggatttctggggaaggaggtgctcaggggagagaagtccccagggaaggcaggcatgaggccacctgagtggagataaagaatggatgtctctggatcgggaccgaggagtgctgagagaccaggtttcaggggcctggagtgtgtgaaacatgagcatgtgtgtgcttgcatgtgtgtgcctctgtgtgtgwgtgtgtgcttgcaagttcacgcctgtgtgtgtgtgtttgcaggcttctcagagttacagcttctcgggtaggtcctggttgttcctgctgctgccacttgagtgagtggcagtgggaagtgcaacaggcagcggcagccaggaagggactgggaagaatctggcttagtgtggcagtactcacagggttaatgaactcagaatatttttaaaagctgtgacctcacctcctcacatcattgcagaggagaggtggcagtcaggggagtgagaagggtcctggggaacaggatgggacagcaggaaatgggggttacagcaggtcctttcttttcctctccttgacactagagctatacctgatcccagattcctagggatgtcaggtgatggctcttgaggtcccctcagcaccctgaaggtgtctgggcagagggcagaagtcaaagcctggccttggccccctgagatcaggactcagatcagaatcctgtgggagtcctcaggtctcagaagggaacctaggaaccttgtcttgggggctgaccctcggtgaaaatgggaaattgcccacatacctggtgccccataagtcccaatctactcccatcccaccctcggcccttccctatcttattgcccaaggctttgatttacctggaccttcctgaaattgtcctgaaacccagaaaggggagcttcctggcctgcattacactaagggaaggatattgtgctcagataactgatgttcaccttaaggtccactctgacctcatataatccttttttttttttttttgagacagggtcttgctctgtcacgcaggctggcaagaacatagctcactgcagcctcccatcccagcctcctgagtagctgagactacaggcgcgcaccctcacacccgactaatttttwaattttttgtagggatgggggtctcactatgttgcccaggctggcacatgatccatttttgaccatattcatgtacacttacagtcctgctgaggggcatcctaatggtgatttctttcctcctcgggtcagtacctcccttccccccaacccccaactccagggaggtgggaaggggtcctgagcagatctctagctgatttatgtataatcctcttttcctctaaaggggtaatccactgaaaattctcgaagtcaaagtggagggtttgtgttcacatagctccacgttgtgcagctacagacatttgggctcaaasaggccagggcacttggcaaaaataccccgggagacatctcagagacccctgggaaactggctcttcctctatttgcctttgctaggagtggtgagaacctaacagataaggaggaatggggatgtggcaggactagaactggtgagagtttggcaggaagaaaggagagcactcagatccccccactgtcacccacgcctgccccgcactggcacctgcccgggagcccaccccagcctgcctttcctgggtcctcttctctgaggatcccgaaccagagagtcccctaatccccaagccagatcagaggagtcctgggacttctccagtcctcagctcttgatgaggaggatgggacaaggggctgctgtctgcccccaccctcctcccatgtttaccatatgcacatctgtgaatgccaggaggaccaagctaggaggcagcatgcagcggccaccctctcagtggcagctttttggctttttgtagcaccagcctctccctggggactcaccacagtgctggrtggggtgtgcatcgggagacagaggtgaagacaacaaggaggttgtgagtgctgggaaactgaacgaaggagcacattcaagagggagagaagaggagagagaattggggtctcccaggggagagaagtggggtgcctttgctaagaaaagtaagaacctagcatataagaaggaatgggaattcccagggggcagacaaacctgctgcccttggtcagaaaggtgggtgctgggaggagctcctgcaaggaagaagcaggcagagactgtggctcctcctccagggccctggtgagggcacaggaacaccatccctcctgggcataacctgagatggtacagttacccacttttggtcacctagatgtgggcttttgttgtgtgggggctctgagccacgggtaa

SEQ ID NO: 13370 - DNA, 14271 bp, Homo sapiens
  misc_feature (1)...(14271): n = A,T,C or G, or insertion/deletion polymorphism (see Tables 1-2)
gcctgtaatcccagctactcggggggccgaggcaagagaatcacttgaacctgggaggtggaagttgcagtgagccaagatcatgccgtagcactccaacctgggcaacagagcgagacgccatctcaaaaaaaaaaaaaagtccaggcaagrctcagtggctcatgcctgtaatcccaacactttgcgaggctaaggtgcaaggattgcctgaggccaagagttgaaggctgcagtgagctatgatggtgccattgcactccaacctgggcagaaaagtgagactccatctcttagaaaaaaaaaaccaggccgggtgcagtggcacatgtctgtaattccagcacttcgggaggctgaggcaggcggatcacttgargtcaggagttcaagaccagcctggccaacatggtgtactttctatactaaaagtacaaaaattagccaggcatggtgacatgcacctataatcccagctacttgggagactgacataggtggattgcttaaacctgggaggcagaggttgcagtgagccgagattgtgccactgcactccagcctgggtgacagagcgattctgtcttaaaagaaaaaaaaaaaaaaaaaaggctgggtgcggtgtctcacgcctgtaatcccagcactttgggaggccgacgcaagtggatcrcctgaggtcaggagttcgagaccagcctggccaagatggtgtactttctctactaaaagtacaaaaattagccaggcatggtggcatgcacctataatcccagctactcaggaggctaagacaggagaatcgtttgaacccgggcagcagaggttgcagtgagctgagattacgccattgcactccagcctgggcaacagagtgagactccgtctccaaaaaaaagaaagaaaaaaaatccagggccagtgtggtgactcatgcctgtaatcccaaaactttgggaggctggcccagcatggtggctcacacctgtaatcccaaaactttgggaggctgaggcaggcggatcacctgaggtcaggagtttgagatcagcctgactaacatggtgaaaccccatctctactaaatacaaaaaattagccgggaatggtggcatgcacctgtaatcccagctacttgggaggctgaagcaggagaatcgcttgaacccaggaggcagaggttgcagtgagatgagatcagtcattgcactccagcctgggcaacgagcgaaaccgcctctcaaacwaacaaaaaaaaactttgggaggccaagatgggcagatcacttgaaaccaggagttcgagaccagcctgagcagcatagaccctgtctcaacaaaaattttaaaatattttttaaaattagccaggcacagtggcacacacctgtagtcctagatacttgggaagctgaggtggaaggatgacttgagcccatggttttgaggttgcagtgggctatgatggtgccactgcactccagcctaggccacagagcaagacaccatgtcaaaagaaaaaaaaatccaatcacctctgctcacctccctctttctctctctctctctctctccctccccctctctcccctgcamcacacacacacacacacacacacacacrcacrcaygcacgcaccacacactctgacgacctttaaaggcttcctgtggctggatgaaatctagaggctttacccttcttgcatggccctgcatgacctggcccctgccctcctctctgacctcatctcccacccgcctcccagtctctctctctgctccagccacactggccttctgtttgtcgtcaacacccccagcttggttccgccttccagcctttgcagtagctgctccctttacctgaaatgctttgctcccaaacttttacctggtcactattttttgtcatttgggtctcagctccagtgccacccaaacactcaaagaggattttgctgactactgtatttaaaagtagctccctgccactcttacaacatcagcctgtcttattttctcatagtaccaatttcttcttcagtttctttcttttccgtctggcctcactggaatacaagctccacaggtgctggtaccttctctgatccctttgcctccatgtccctcctgccttaggacaatgcccagcatgtgttaggcacgcagatactcactaaatggaggaatggatgaataattcataaagcaggataaagttcaactttaggcttgtggctcagattggacttacatttagagtcagatttaagtttagtgttaggagtggtggtaaactggtttcaagattagccctagaaacagggttgggttggggtagaggagaagttttatttagggggttattaattgggatgtgtttagatttraggttagggttacagttggggttgagtttgagttgtgatttgggttgaggttaaatttgggttagggttgatgttggtattaaatcccaattcaggttttgaggctaagttcaagtttgaagctaatgtcatttcagtctcatttggaggcttcagagatttcactagtttctccacaaagaccactataaagactgtatttccctgagtctggggcacaagactccagtcatcagctctcccacccagggaaagtcccaaaccaactgctggcctgcccaagaaagaaaccaaattcatacaacctccgaaactgagattgaaaccaagattggcccatctcaaggagcatccttcgcatatctcacatgcaygtgacactgagcctcagcccagtcttacccttccttcctctgtgtctctcatgtctccccatcacccttcttgccttcccttttttgtctttcaatgtcccattcttcctctttaatttaaatttctctctgtgtctcactgttaattgcaatacctttttttgtttgcttgttttgttttgttttgttttttggttkgtttgtttgaaatggagtctcactttgttgcccaggctggagggcagtggcacgatctcggctcactgcaacctccgcctcctgggttcaagcagttctcctgcctcagcttccctagtagctaggattacaggcgcgtgccaccatgctcggctaattttttgtatttttagcagtgatggagtttcaccgtattagccaggattgtctctatctcctgaccttgtgatctgctcgcctcagcctcccaaagtgctgggatgacaggcatgtgccactgctcctggccttgtaataacattttatattttaatatagctcagctggggtcccagtccatcagctcataccattagagaagcagaaagagacaacaggaagcaaaaaggaccctgagagaaagggcaacacagagaaaaagaaaggagcaggggctaaaagggaaacccacactgacacaagagataataaggttaaaagaatgagaagaaggttgggcscagtggctcacgcccataatcccagcactttgggaggccaaggctggtgggtcacctgtggtcaggaattcaagaccaacctggccaacatggtgagaccccgtctctactaaaaatacaaaaaaaaatttggcgggcttggtggcgtgtgcctgtaatcccagctactcgggaggctgaggcaggagaatagcttgaacctgggaggcagaggttgcagtgagccaagatcgtgccactgcactccagcctgtgcgacagtgagaaactgtctcaaaaaaaaaaaaaaaggaaaagaaattttctgacytatctcatctgatagtaggttataagaccctcattccagaagaggttctgccctatacctgggaggaaggaatgctgtacagagagaccaagaagaatatggccaggccttgctgggatccccccagtcccagtctgtgaccattagatgatactccttttgttcaattacatttctgcacagctgttcattcttcatcaaatctaagcataaaaatagktttcccctgggtccttgggtcttcatttctgaaggctcccatgtcacctaaaactttgattaaataaatgtattatgcttttctcttgttaatctgtcttttattataggagtattggccataacccttatgatgggtcaggaagggatcacccctttctgcccctacagaaataatagctaagactagtaaagcataaaaggcaaaggggcaggtcctcaagtagagaagaacaggagaaatagctcatacacacccagaatgttacttacatgtccctccatgttacaccaagacccctcagggaccttgtgcctggggagagaagtggtctgccccatgcaacagtgggctttaccccgggtcaccaccagccccagctccaacccctctaacactctccaagtaaaatcacatsagtagcagtaataatatttgaggtgacaagttrgtattatctcaaacttaggaaaagtgaataaagtcatctttagaaactgctttttttaaaccttgtaacttgcaagctaagtgaaaatgggctcatgtatgagaatgttcgtgttagacattttttgtgttagacaaaaactagaaacaaaccaaatccccatcaacagaatatattagaatatattgatacaatagaatattacatcataattttttwwaaaaacattactgatacatacaaccacgtatatgaatctcacaaacataatgctgactgaaagaagtcaaacagaaatgagtacattctgtgtgatttcatttatatgatgccccaaaccaggaggaaataatctatggtgataaaagtgagagagtggttggttatctttggagggtatcagcagggagggggcatgagggaacctgctggggacctgaaaatacgtggagctgggtggtggctacatacagatggaaaaattcatcagctgtacacttaagaggtgtccacctcatacctaagttacatatcaataaaaaggaaaaaaattttggaaactttttttttttttttttgagacagagtcttgctctgtcccccaggctggaatacagtggtgcgatcttgactcactgcagcctccgcctcccaggttcaaataattctccagcctcagcctcccgagtagctgggactgcagatgcgcaccagcacgcctggctaatttttgtatttattatagagatggggtttcaccatgttggccagctggtctcaaactcctgacctcaagtaatccgcccacctcagactcccaaagtgccaggattacaggtgtgagccactgcaccaggcctggaacaattttaaaataatgtattggctctgcaaatgcagcttcagaacaagtcccttagctgtccccaccccaccctaagtcaccacccttaagcctcacccatgtggaattctgaaacttcctttgtagaaaactttggaaggtgtctgccacattgatcctggaatgtgtgtttatttggggttatataaatctgttctgtggaagccacctgaagtcaggaagagatggagggcatccttcaggagtgagatgagacctcatcatacttgactgtccagcatcatctctgagtraggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaacyrcctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccrcacagcaggtgaggctctcctgccccatctccttgggctgcccgtgcttcgtgctttggactaccgcccmrcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgrttcctctctgttcccttcctgtctctctctgtctccctctgctcaccttggggtttctctgactgcatcttgtccccttctctgtcratctctctctcgggggtcggggggtgctstytcccagggcgggaggtctgtcttccgccgcgtgccccgccccgctcactgtctctctctctctctctctttctstgcaggttctccccatgacaccacctgaacgtctcttcctcccaagggtgngtggcaccaccctacacctcctccttctggggctgctgctggttctgctgcctggggcccaggtgaggcagcaggagaatgggggctgctggggtggctcagccaaaccttgagccctagagcccccctcaactctsttctcccctaggggctccctggtgttggcctcacaccttcagctgcccagactgcccgtcagcmcccyaagatgcatcttgcccacagcamcctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgccaycccccaggaactcagttgttcagtgcccacttcctcagggattgagacctctgatccagacccctgatctcccayccccatcccctatggctcttcctaggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagrgcaggcacatggaggagcttgggggatgactagaggcagggaggggactatttatgaagkcaaaaaaawtaaattatttatttatggaggatggagagaggggaataatagaagaacatccaaggagaaacagagacaggcccaagagatgaagagtgagagggcatgcgcacaaggctsaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcycagtctatctaaggaatggagggagggacagagggctcaaagggagcaagagctgtggggagaacaaaaggataagggctcagagagcttcagggatatgtgatggactcaccaggtgaggcygccagactgctgcaggggaagcaaaggagaagctgagaagaygaaggaaaagtcagggtctggaggggygggggtcagggagctcctgggagatayggccacatgtagcggctctgaggaatgggttacaggagacctctggggagatgtgaccacagcaatgggtaggagaatgtccagggctatgraagtcgagtatggggacccccmcttaaygaagacagggccatgtagagggccccagggagtgaaagagcctccaggacytccaggtatggaatacaggggacrtttaagaagatatggccacacamtggggccctgagaagtgagagcttcatgaaaaaaatcagggaccccagagttccttggaagccaagactgaamcmagcattatgagtctccgggtcagaatgaaagaagargrcctgccccagtggggtctgtgaattcccgggggtgatttcactccccggggctgtcccaggcttgtccctrctmcmcscacccagcctttcctgaggcctcaagcctgccaccaagcccccagctcyttctcccsgcagggacccaaacacaggcctcaggactcaacacagcttttccctccaaccccgttttctctccctcaaggactcagctttctgaagcccctcccagttctagttctatctttttcctgcatcctgtctggarrttagaaggaaacagaccacagacctggtccccaaaagaaatggaggcaataggttttgaggggcatgrggacggggttcagcctccagggtcctacacacaaatcagtcagtggcccagaagacccccctmrgaatcrgagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagaygctccctcagcaaggacagcagaggaccagctaagagggagagaagcaactacagacsccccctgaaaacaaccctcagacgccacatcccctgacaagctgccaggcaggttctcttcctctcacatactgacccacggctycaccctctctcccctggaaaggacaccatgagcactgaaagcatgatccgggacgtggagctggccgaggaggcgctccccaagaagacaggggggccccagggctccaggcgktgcttgttcctcagcctcttctccttcctgatcgtggcaggcgccaccacgctcttctgcctgctgmactttggagtgatcggcccccagagggaagaggtgagtgcctggccagccttcatccactctcccacccaaggggaaatggagacrcaagagagggagagagatgggatgggtgaaagatgtgcgctgatagggagggatggagagaaaaaawcrtggagaaagacggggatgcagaaagagatgtggcaagagatggggaagagagagagagaaagatggagagacaggatgtctggcacatggaaggtgctcactaagtgtgtatggagtgaatgaatgaatgaatgaaygaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacrgatgaatggagagagaaaaccagacacctcagggcyaagagcgcaggccagacaggcagccagctgttcctcctttaagggtgactccctcgatgttaaccattctccttctccccaacagttccycagggacctctctctaatcagccctctggcccaggcagtcagtaagtgtctccaaacctctttcctaattctgggtttgggtttgggggtagggttagtaccrgtatggaagcagtgggggaaatttaaagttttggtcttgggggaggatggatggaggtgaaagtaggggggtattttctaggaagttyaagggtctcagctttttcttttctctctcctcttcaggatcatcttctcgaacccygagtgacaagcctgtagcccatgttgtargtaagagctctgaggatgtgtcttggaacttggagggctaggatttggggrttgaagcccrgctgatggtaggcagaacttggagacaatgtgagaaggactcrctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctycagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccawctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcmacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctycagaactcactggggcctacagctttgatccctgacatctggaatctggagaccagggagcctttggttctggccagaatgcygcaggacttgagaagacctcacctagaaattgacacaagtggaccttaggccttcctctctccagatgtttccagacttccttgagacacggagcccagccytccccatggagccagctccctctatttatgtttkcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaacatggtctccttcttggaattaattctgcatctgcctcttcttgtgggtgggaagaagctccctaagtcctctctccacaggctttaagatccctcggacccagtcccatccttagactcctagggccctggagaccctacataaacaaagcccaacagaatattccccatcccccaggaaacaagagcctgaacctaattacctctccctcagggcatgggaatttccaactctgggaattccaatccttgctgggaaaatcctgcagctcaggtgagatttccggctgttgcagctggccagcagtccggagagagctggagaggagccgcattctcaggtacctgaatcacacagccaagggacttccagagattcggstgtctaggcttcaaatcaccctgtcctaactctgcaacctgaaccagccacttaacctatctatccaatggggataggaatgtccaccacacatagggcatgtgagagaaggcctgacctccatcagaggacctcactcagcccttggcacagtgggcacttagtgaattctggcttccttcaaccagtttccagctgttctatccccttccattctctcagtgggtgaaatcgaagagactgaggacaataaagaacaaggaaccraactgccggacgtggtggcatgcaccygtaatcctaccactttgcaaggccaaggtgagaggatcgcttgaacccaggagttccagarcaacctgggcaacatagtgagatcctgtctctattttttaaaaaagaatgaaacataggaataagatgtgggtgaaggactcacatgccggcttggtcccactsgtctttgtggtgaaggaggggagagrtgagaggtgggtaatccggaaagagaaaagcaccccctccctggatgaaggctcttctggagagagtcaaagacaaataagggtggggcgcagtggctcatgcctgttatcccaacactttgggaggctgaggtrggaggaccacttgagcccactagttcaagaccagcctgtgcaacatagcaagaccttgtttctagaaaaaaaattaaagattagtcaggtgtagtggtgcatgcctgtaatcctagctcctcaggaggctgaggcaggaggatcactcaagcccaggagtttgaggttacagtaagctatgatcatgccactgtacccccgtctgggtgacagaacgagaccctgtctcaaaaaaataataattccaaaammaaatatggagacggaaattgagcccccctagactgggagcccccactgagttyggaaattaggctttacctccagccctggggtgccaggcargagaaaaccatgtrgtaggctgagggggtagggtgacccattggggtgacctakatagggccttgggtcaccctctgcctcctccagcctgtggctgaaagtcagccatgaagtaatgggggacactgttactcatcccagaagcacccayacttactcacttttgggaagggggacctaaagtgtgaaaaaaaggtgaggattttccgtctcaccctaaatgggacaycctaagtggggcatcggtttttcctcctccccagaacttcctggtgttttcaggcaccacaggctccttcctgccatccccatctctctctaatattctcccyttctttctccttcagcctcctcccttyagaccccatgagccttgaattaagctccttggaggagaagagttgactgtcgggtaggagacagagaggccttcaggcagctctagggggagaagtgcggggcccctccaggcttcattcctctgtcatgataggggcttactctgctgctgggcctttctgagtggtgcttgctgggctctgtaatgacccctctcactgttggggggtacccaagagaaaagagtatggtgcagagtctggttgggaccatgtggccctgaaaatcaggatgcctagagaa

SEQ ID NO: 13371 - DNA, 33019 bp, Homo sapiens
gggaggacccaggttgggggggccctctccagtcccacccagtttagggaatgcccctgccctctcccccaccccccttcacctggctcttaaagggcccggcccctggccggcggctacttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctggtgagtccgcgccccgcccctgccccgcccacgtgagacccgcgtcctccaggcagggtcctggggagacgggagtgggtggcccggcaagcctttccgccctggcccttgacgcttccgactttggggggcacatttgtgtgggggagaaggggcaagtgcaggaagctgaggtgcagcsaggggacctggtgatacagcagaaggtgtctgcgctctcggccttcttttttgctccatttattttcccttgatggagtgtgcgtgcaggtgggaacttgggggagkcagggggagaaatgggagggttttagggccatcccatgggctccagcaggcccagctcctacaaccctagacggccaagctggggaaaggacccaaatgttgttctcagcttccacttggagaaaaggrgaggggaaccccagactctgaaattctgcacacactgagaaatgactcctttcctcctaataccggtgttcgaagcacctaaacaggaggcgtctagaaccgaagaggccccaaatccagggttgtattagacttgagtagggactgagggcaggctagggcgtaggttaggggagaggggagaaagagtaggggaaagrgggaatctgccaaatcagggttatgatttaaacctgctcagaatcgytcacccatcctaccccaccctgctccagggaggagagcagaagctgagtcacygggtgggtgggacagaagtgaatcagccgtgaaaacatggggggcagcggggagatggggagggcaggaaatgcaaactgcgcatcccagaggctctgggttccttccacgggaggggatggagaattcacttggagtttctttcagttccaaatgcccgagtgcaggcttctgggcgtcctcctaaaaggtggtctgggtggatgagaggaggcagtttggaactaaatggttgggtgctaaatgtagggaatgaaggagaaggtctggggaggggtgggcatcctgaggaagaaggatcagactcaggaytgcaggggaaatgtctcctgggttgtgagtggtagttagctgggagcttgtctttaggcacagaggaagaggatcccttcaggggttctgatatctgattagatgttaggcaaattccaagcagtcagtacatgctcccctttctgccttttcctgtccctgacttatttcctcaccccttcccagtcctgagctctccccggaccctccggaaactttctccagagccaggagcaacctgcaggttggaagcccctcattccttgcaccttcttaatctgccctcagcctatcttggttaagggttgaatccatgtgctcctgggaccactggggttgagctggcctgggtcacagggtaccagaagggagrggttcccactgcagtgccccagaagtaaccacatctcaggcctgggaggggtgggttgagtcatagcaaggtcacagcmgggacacacattccttttgggtccctgttggcccccctcctacatcygttgctcttctgccccagctctcyggcttcgtgcgcccccttctggcctctggtggaacagccaggtcttttcacccaaagcccaaagccccaaatagtcctttgaatttgttctccattttttcatttattttattatttattgtaattaattgattgatttttaaattagttaattttttaaaattaagtaattagttaattttttaaaattaagtaattaattaattttttaaaattaagtagttaattttttttaattaagtaattaattaattttaaaaagtatttatttattttgagacaaagtctcactctgttgcccaggctggagtacagtggtccagcgtctcactgcaacctccgcccccccgagttcaagcgattctcctgtctcagcctccggagtagctgggactacaggagcctgataccatgccaggctaatttttgtatttttagtggagacggggtttcaccatgttggccaggctggtctcgaacgcctgacctcaagtgatctgcccaccttggcctcccaaagtgctgggatgacaggcrtgagccactgcgcccagccaataatttatttatttttgagacagggtctcactcggttgtccaggctgaagtgcagtagcacaatcatggctcactgcagtcttgacttctggggctcaagcagtcctcctgcctcagcctctcaagtagctgggactgcaggtgcacgccaccacacctcggtaattttataaattatttgtagagatgaggttctcattatgttgcccaggctggtctcaaactcctgggctcragcaatcctcccacctctgcttctcaaagttctgggattacaggcgtgagccattgcayccatcctcattttccatttttgctttccaaaattcatctcctttataagccttaaaaatcagtatgggaaatactggggaatattgtcaggaaaagtaatataactatytgtcagagaaagaaactagggccagcatcatgcaacagcggggcataaggccctcccttccttacttcagcaggtgatgtgggcaaggcccttctccacatggctctgcctgatttctgacctctccttctcctattcctcctccagttgcagaggagaatcctaaggagagtaaaccccaagcaggcactgccsgcccacaggatgtgaaccgcagagaccaacagaggaatccaggcacctctaccacgccctcccagcccaattctgcrggtgtccaagacactgagatggtgcgtttggagctggtagggagcaggaggggtgggaagccytggagacttccatctgagactgctcccttgggcttggagacgtctccattgtctgtcctgggtgcttgcctggtgggccagaaggttggaatggggagctgggctggagcggttctaagctgcctactctcccttccccagggcccatgccgtagacatctggactcagtgctgcagcaactccagactgaggtctaccgaggggctcaaacactctacgtgcccaattgtgaccatcgaggcttctaccggaagcggcaggtgagactatttttcttctcctcctgctccagcagaaggctcctgccagggagtgggggcggtgctgcttacaaagctgcataaataagacactgccccatctttaaggatcttccaactttaggagaacatagagaatataatttattaaacaaacttagagaataatcaaccacacactgtgagagaaaacccacttaaggaatgccctaactcagtggytcttgaacttgaggcatcagaatcctccggagggcttatgccacacagatagctgagccccaccggcagccttcctgattcaggaggtgtggggtggggcctgacaatatgcatttctaacatgttccctcgtgatccggatttgggaacgtcactttgaaaactactgttccaggctagcagaatgcacacaatttattggttgaagagggggaactaaagagagggaacactgggccgggtgcggtgtctcatgcctgtaatcccagcactttgggaggccaaggctggtggatcacgaggtcaggagttcaagatcagcctgaacaacctggtgaaaccccatctgttttaaaaattacaaaaattagccagatgtggtggcatgcacctgtaatcccagctactcaggaggctgaggcaagaraattgcttgaacctggraggtggaggttgcagtgagcagagatcatgccaatgcattccagccagggcgacagagcgagactccatctcaaaaaaaaaaaaaaaaaaaaaaaaaagagagggaacccccgaggagacgctcaggtgtttttacatcctcagactcagatgtcccctctcattctcctgstggaagcctctggcctcactcctgacctgtgtgcctctctctccagtgccgctcctcccaggggcagcgccgaggtccctgctggtgtgtggatcdgatgggcaagtccctgccagggtctccagatggcaatggaagctcctcctgccccmctgggagtagcggctaaagctgggggatagaggggctgcagggccmctggaaggaacatggagctgtcatcactcaacaaaaaaccgaggccctcaatccmccttcaggccccgccccatgggcccctcaccgctggttggaaaragtrttggtgttggctggggtgtcaataaagctgtgcttggggtcgctggcttgtgtctctgtgtctgcctctcacaattctggaatccctggccctctctttaccccactacagctcactcacagcatttctcctttcctgtggatacctttagtccttcctgtgacagccaggcagaagcttcaagccatcaagcctcacagagctgcccaccaggagttgggagtgggaaggggagacactgagatcatggccttaatctgaagttgtgaccttgtttctaacactgatctttggacacaaagggaggggaaggattaatagttaatcccagcaggaacccagcaaagaggaactctcaaarcacatacccttctgttacttcctactaaaaaaagaaggaaattattactaatatatgagctcatcccatggcccygaaccatgtgattttacctggacaacctcattttgagcttacgataaccttgtgatatagggatttttacccctatttttcagaggaggaaactggcttaaaatttggggtcacttgcctgaaattatatagctggtaaatgacagagggaggtttgcatccggttcttccatatgtgacaatasytggtattccctaggtgctgaatacgtgtttgtttagtctcctttctgcctacatgctcacccaagcaggtgtcaggaagcggccctgtcagttcaggggccctgacactcagcctttcctggaggggccccagttccgtgagtagcacagtgccaaccccatcagaatattaccacatgtgtcaatcacacaccttgtggtgaaagcgagctgaackcactgatacatgaagacatttctgactcctccctgaccttcagcctgctgggagagagacyggaaggccagccatgctaggtgacaagcttctgagaggcaaagttccyctccccaagatgtacccagccactattcctgtgtgtgtgtggcggggtggatagcacccttggagctgggcatctggatggtggttggggtgttagggggatgtggcgatccctgcgacagacagcagagtgaggtctgaatctgagaagctctgcctccagatcagataacctatcgcactcccagaggccccctcctcctgaaaggactttagtctttggagctgtcacctgagctgagtgggacaagagctctrcagggcaggccacactgcgaaggaaggaggcaacacgggcaagggctgcctgctgcccgctggagaccgcaccatggagccaggcggggcccgtctgcgtctgcagaggacagragggctgggaggggagcgggagcgccaaccctgtggagatggtgagcygccctcgggggtgcagaaggcacaggcaagtgggggggaggcggggagagatgcgctatggagagaaggctccaactgcctgatgccaatccttcctgctgtccagagaggccaaggaaggtagaccctggcctcagcccagagccacccagctggaagatggaacagaaaagagctatgtcagagctgtggcctggccttatccttctgactgtttagccccagatagtgaatggagtagcttcccrttccctgagtgccctgttcccagyaatgtcaccaggccccctgcttgcctatggcctcctcaccactggcaacagcaacttccccttctagtagccccaaccrtgatactagatattggctggttggggtgagggcagctgctgagcacacaaagcatttcctgaccacaggatgcctctgggtctgcagaaccccaattcctcctgttgactgtgcctttgatccctsctcacaggaaacactgagacgcacagagccccggacttggtacaatggacccgacacatggaggtgagkgatgtcagaggtcagaggtcaagtggacagatccttggtagcaggaagcaggagtgaggcttggtgataaagatgacttttttttttttttttttttgaaacaaagtctcgctctgttgctcaggctggagtgcattggcacaatctcggctcactgcaacctctgcctcccaggttcaagcragtagctgaactacagatgagtgccaccaggtgtggctaattttttttttatatttttagtagagacggggtttcaccatattggccaggctggtcttgaactcctgacctcaagtgatctacccgcctcggcmtcccaaagtgctgggattacaggtgtgagccacggtgcccagcctgatgacttgttcctgagtgcaaagatcggattcgaattaaggatggagatggaggggtttgaagcacaggtcccaaaggtcaccaaaagtcagccagtagatagagtcttcctgctartgyggctggaggccaggggtgaggagtgacaatcggaggtgaccagrctggaattcagacccagggaggggaarccttgctcctgctgtcactccctgatcctcgctgctgccccaggaagccagaaggagatcaactctgggcagggatcatggcttgttcatctttttaccacagcacttagcactgcggggtcctaccccaccagcagacccatcaccaccccaccaatgcctgcccttccccccrcaggcctgccaccactgaacccccatccctgctgaccccccaggttgtttttttttttwaaaaaagcactgtgcctggcatagacagaaattcagtgaatgtctggtgaatgaaaggatggctgactggagggacagtgggctctrccctggctttgtcccgtaggctgtgaaggcacaattgctggagcaagcgcagggacaactgagggagctgctggatcgggcyatgcgggaggctatacaatcctacccatcacaagacaaacctctgcccccacctcccccaggttccttgagcaggtgagtctggggaatggctgcgcgggctcctctgtagcaaggatcatgagctagaaacatcacgttatgtgcccttgccagctttatcaggaccgtgactccagccttccctcttccccccttgtcttcctaacactgacctccatctactgggcctcgctctgccctggccctgaccttctacccggtcctgccctctggccctagccctgacctttccctaccactccccttggctcccaagtattgaccttctgcatggccctgccctctgcccatttactttttcctgaccctgaacaaacatctcaattcaggacccaggagccatccctggggaaacagaaagttttcatcatccgcaagtccctgcttgagtaagtcggggtgrtgacaagtaatgggaggaaaagaaagggmtttggctaggggtcaaggtacctcatttctcatccccagsctctaggtggtttgtggrgaggacttggaaagggtttctaaggtgcrggtcccctatttgccctaggcatggttgtggaagaaaggmckttagctggaagttctggatcgctaggcyccatgcctcatgtgtacagtgtctgagctagttcacacaaccctgaggaccctcccacactgactttcgggcccctgtccctctagtgagctgatggaggtgcagcatttccgcaccatctaccacatgttcatcgctggcctgtgtgtcttcatcatcagcaccctggccatcgacttcattgatgagggcaggtaggtccccttcccacctgggacaggcacacctatctgatcagaccctctgggtcctcagtgccccacctgcccttggggcaagaggacacaggttccccctttggttattggacatgtaccaacattgctcccawcaacctttccacctgaaacactctctaggatcccttccttccccagccttggttggccctttgtctgtcctcccagggccrgccaytctcaaatgcttctcaatgacaccttgccctgaggcagatgtgtgtgtgtgtgcacacatgcacacccatacacactcctttccaagtcagttctattcaagtaacctccattgagcacctccygagtaccagtcctagtggccagagaaatgaggggggcagaccccactcctgtctgtgaggcactcccagtcttgtggggaagacagacatgtaaccaagtgcctgggtgggtcatttccccsacagagcaccccatccaactgtgaggatgagcctcagagagctgtatacccctgggggtctgtattttcatacctcccmctattcccagaccaaactgagggttggggctgctatttctcatggcccaataacgagatgcagatgaactggggaggaagtgagtttttatttctgtaaccagttacagggagaaggcctggaaattatcaccaggccaactaaaaattacaatttccagagcatatataccttctaagctctacatctatgtgtaggtgtgcattcatctaaagacataagtgattaacttcttttaatctataactaaggtctgagtcttgaagaccttcttctggagcctcagtaagtttacttaatctaaatgggtccargtgctggggtgattacccttctcttatctcctgctaaataacggaggtttggggagtttcttcagacccccagcaaaacttgtttaatcatgctttgaggttcaggaaaggcctaggcaaaactcttggtgggcttttgttacattccagcctttgtataagggcactggtttttaacatttaacttaaccactcagtcagtactgaaacagttgttatggaggtctgcattagtgagacctgcttgtcacagtccccactgtcaatttacacgatttttatcatgyrtggatatttatttatcatgagaatcgcagggagatggggagtcgtaatctttctggctacttcctgctgagagggggtcgtcgttatggggcaccaaaagcagcagtggagtggaagaggttgatttgttcgcagtagcactctctgtttcggggccttggaggcagcacctgctgaaacataatagtatgtaacagtacatataaataggctactgctcttttcttctgaagtttaagttgtctagtcttcagtttgcagggctttaagaaagcagagcttaggtttcagtgattaccaattaggaagaatgggggaaaatggaaaagaaagaggaaaaaattgaaaacattattttggagacctgtagccagaaaagttagaatttaatccaaactgcagaaaataataaaaactgaaaaacatcaggcaagactagaatttaacaacagatgtacttttttttttttttttttgagacagagtctyggtccgttgcccaggctggagtgcagtggcgtgatcttggctcactgcaacctccgcctcctgggttcaagcgaatctccaacctcagcctcctgagtagctgggactacaggcacgtgttactgtgttcggctcatttttgtatttttagtagagactgggtttcaccgtgttggccaggctggtctcgaactcctgacctcaggcgatctgcccaccttggcctcccaaagtgctgggattacaggtgtgagccactgagcccagccatagtttttgaaacataatttttctctctccagtttcccatttttattaaaagacagatcatagtaggactggtttgctttattatacttggkttaattatttgtatacagtacagcaagaataattagtttcacataggccttttaaattggctttgatggaacttcgttccatagaaggaatctgagataagtccttttaaagccgagcccagccatggatttgtaccaataaatacctatgagttgggtgaattcctcttctcttgaggttccaagataacttggggttcctggcctgtcagaaaatgacattctttacctaccacagatcagaaaccctggacagggactgtgtacacaaaatatgatgccagttttcaagggctttattggcttcataagtcaagttcgattccttaaaaaagagtacaccattccagtcaaagccttgggaaaataaccactttttccaattatgtcctgttacaaaagaaaacagattcttattgtactatgcaaataactaatattgcaaatagtttccaaattctggagaaatcaggtagagagaaacaaacatgctccaaattttattcataggagtatactttacttaattgttaaaagctattaatagctcaaaagaaaagtttccttgactctgcaaagcaaaacaaaggactagcaacattttaagcaaaaagtgaaaaagatcacttcaatctcctwttagttcagtacatgcagttaattcctgtcctgcttcatattaatgaatattttaactcttcaagagccctaaatgtttttcctccattgtgatgtcacaatctacaaagttatcagaaacctgcattcaagagcacctgttagagctttataactgattataaaaccaccttctaaagaggaccaaaacaagaaaacaattgtttatggatgacaaacagttttagggtagccatagttaaagacacaattgacaaggaaatctgttacctctgtagcacacaacaatttaacataacaatggctgggcacagtggctcatgcctgtaatcccagcactttgggaggccraggtgggtggatcacgaggtcmggagttcaaaaccaacctggccaatatggtgaaacccygtctctactaaaaatacaaaaattagctgagcatggtggygcatgcctgtagtcctagctacttgagagactcaggcagaagaatcacttgaacctgggaggcagaggttgcagtaagccaagatcacgccactgcactccagcctgggygacagagcgagactccatctaaataaataaataaataacaattctaattattattgataatgtacactaagatatatcagaattatagcagtctctcataactttggaatacataccaataacatatttatacaaatatagcccaaagaaagtcaaaccccattttatatttggcaatgcttcctgtatgatttttggtaccaaataarccaaatttcacctttwtattagtgtactattaatgttaaacccaattatttatttatttatttattttcttttttgagacagagtctcactccgtcacccaggctggagtacagtggcatgatctcggctcactgcaatctctgaatcctggattcaagtgattctcctgcctcagcctcccaagtaattggaattacaggcatacgccaccacacccagctaatttttttgtgtgtattcttagtagagatgggatttcatcatgttggccaggctggtcttgaactcctgacctcaagcgatccacccaccttgacattcccaaagtgctgggatcataggtgtgagccactgcacctggccttaaacctaagtcttaataaaaccttatacacatggtttacccaattttaatgtttgaccataaggtaagatttgtatagactttttcgaaccctttacaatttttgttaaagagcaggttagtgctctaagagaaacccattgtgcttttattttaatgctcaatttacagaagaaactggatgatacccctttaactttagccaatatgtttacacacagaatttcctttacaatcaaccttccacaacttgcttaaacctccatctttatcttacccaacttaaaacaatccttttaccttttaatctagggaaaaatccattattgtcatgccttcttataatctttttaccaaaagtatattttacttttcttatacaccttgcacataaattgtttcttcaacagtgttaaatatatattatactgttaactcttagmaacctttacttttggtgaaaaccttggtaagtttgggattttaattatgtactaggtgtggcgcctaggacctagacaggagtacagataaggtctgacttattccagcgtctaactccatgtgtcctaggacttacctagctgtaaagcaggcaagttgtacagctaagagtcataaagcatttaggaggcctaatcacctttaaattgtataacatttcttgtataaatttcctttaayaaattctttcaggacttccacagacaatctctgacatcccttgactttctgatttgtcctaaacatgtttctctttaaacaaccagttattttactttaggacaagaatttaccayacaagatcctttcttatataaattctcttttctttaatatctttttgcatatctagggggcatggctaatttcacatgtccctagccttatctagaatctaacgctccaaaataaatttaacaatttttaagtcaaagatgcagtttatgacctaaagcatttagcaaacctaatatttgacatccataatttaaaccaaacgtttacatttttgaagatatttttattttaccaataatctttaaaattgtctttatttttataactttttttatgcctctcttatttcctgttttttttaccttgttttatatataacctttaaggtttgaattagacaaaaattagttactctttaaaaaggacacaatttttagaaagaatgttttcctacatttttattggaaaatacccaaataatgaaatatctgttgtttaactttagattctaaattatgacaagtttatgagtatttatcccattacatttatctaattatttattttaatcatttgcctacatttttttttttgagatggagtctcactctgtcacccaggctggagtgcagtggcgtgatctcggctcactgcaagctccgcctcccaggttcacgccattctcctgcctcagcctcctgagtagctgggactacaggcgcccgccaccacgcccggctaatttttttggtatttttagtagagacggggtttcaccgtgttaaccaggatggtctcratctcctgacctcrtgatctgcctgcctcggcctcccaaagtgctgggattacaggtgtragccaccttgcccaacctatagtgtagctttaaaacagagaatgataacagtcctttcccagaacaaacttccttcatgtctgtggactagactaaggccacaagagtagaagttagggtattttactaaataattcaagatgtcgctatcttcattaaacaatattaatgtttcattcattaaaaatgacatgagcaaagatcattctgttttgggctgagttatagttttgtagcctctatgccaaattttgacaccttatrgtatttggcagagataagtatgaaattgcttgatcaataaatgcaaacaaaaatgtatgctggcaactcttamgacatttctagtattactttaccaataatttttaaagctagcttatgtattaaagattttatttaagtcacataaacttgaaaaagcatttgactagtctttccttttttctgttaaagtatttaagtgcttttatttttctttaagccaattaattagaactcttttatatattttcagtagtgaaacatggtatacacaagacataaatacgcagacgtattaggcatgccaatagaagtacattttatagattcctaagacctcctttttcctctcttttaactggatctttgtgctctgggcagatcttacactgaatcctgggttttcaaaaagggagaattattatgaagccagatcatgtgaggcttttacagtgcacttacatttttttttcccaaagacatttctatgtctctcaattacacttcttaaaaaccccagagtagcttctgttgtaatagctattaatcaagaaaacagaattcagtcaactgagaaggaaaaaaacttctgctcaaaaagacaaggtcctggccgggtgtggtggctcacgcctgtaatcccagcactttaggaggctgaggcgggcagatcacctgaggttgggagtttgagaccagcctgaccaatatggagaaatcctgtctctactaaaaatwaaaaattagccaggcgtggtagcacatacctgtaatcctagctactcgggaggctgaagcaggagaattgcttgaacccgggaggcggaggttgtggtgagccaagattgcaccattgcactccagcctgggtgacagagcaaaactctgtctcaaaaaaaaaaaaaaaaagacaaggtcctaggagagraataaaaacaaaaccaaaaacatgaaagccttttaaatacaaacgtgcacacatgcacacatacrtatacacatcttggatgttatcttttaattaagctgactctcaaccattgagcgtctagaagatatttttccttcccagtggcctctcagcaggaatggacccaatacctcccattttcttttttttctttcctttttttttttttttttttaagacagagtcttgctctgtcgcccaggctggagtgcagtggtgcaatctcagctcactgcaacctctgcctcctgggttcaagcaattctctgcctcagcctcccaagtagctgggattacagacgtccgccaccacrcctggctaatttttttagtagagatggggtttcaccatcttggccaggctggtctcaaactcctgaactcatgatccagccacctyggcctcccaaagtgctgggattacaggcgtgagccactgcacccagccaatacctcctattttcaagtttacatgctatcaaagggaataagacagatacacaaataagtggagacaaattttggacaacacaagggggagtgcactcaggcaaaacagactcaaaaccaactcaaaacctgatygcaaccaaaatgcaaagcaggcgtatgagtgagccctattgcttccctgggtggtaccggacaaatggcttaacaagcccaataggaaaacaataggctcccggcatatgatctgtttaactcaccctttgagcgtgtctgcttctgatctctgttcttccccagtagtgaaagggacgtgcagttttgcacacgggacagccctcgggagggtccccargaaaaatctcacgggcagctgcttggaccctcctgaagactgtctcatcgcaagccactggtggctgaacacagcaccatcccggtctctcctggctggcttgccacgttttgttcccaggtcaaactgaaggttgggctgctatttcttgmggcccagtaacgagatgcagatgaactggggaggaagagagtttttatttctgtaaccagttacagggagaaggcctggaaattatcaccaggccaaytaaaaattataaagttttccagagcttatataccttctaagctctatgtctatgtgtaggtgtgcattcatctaaagacataagtgattaacttcttttaatctataactaaggyctragtcttgaagaccttcttcyggagcctcagtaagtttacttaatctaaatgggtccaggtgctggggtgattacccttctcttatctcctgctaaatcacagaggtttggggagttccttcagaatcccaataaactcatttgtggaggcctggggagtttcttcagacccccaataaaacttgtttaatcatgctttgaggttcaggaaaggcctaggcaaaactcttggtgggcttttgttacattctggcctttgtataagggcactggcttttaatatttaacttaaccactctatcagtactgaaacagttgttatggaggcctgtattagtgaaacctggcctgccacatcccctctccctatgttgggcttgggaagcaatgaaaaaaacagctccaaggawccacaggctcagcaacagcactgccttttggtaaaatttttgttgttagttatacaagtattaaaaggacaaaatctactgctaggtttgcataagaaaaaaataaattaaaaaaactaaaaatgataaaatctcagtaaaaagctcaaatacatgtttttgtgtaaaggaggtccttcttgaccgcctccttcaatcccacactgctctcggaggattttaaacagtttctggctgggtgcagtggctcacgcctgtaatcccagcactttgggaggccgaggcaggmggatcacttgaggtcagcaattcaagaccagtctggccaatatggtgaaaccctgtctctactgaaaaaaaaaaaattagccagtcgtggtggtgcaagcctgtagtcccagctattcaggaggctgaagcaggataattgtttgaacccgggaggcggaggttgcagtgagcagaaattgtgccactgcactccagcctgggtgacagagcgagactctgtctctaaaaaaaacagtttctgagtttccacccagagcattttccatgcattgacattcagtaccaaagataggtacattgtggaggtttcacgtaaacaagaaactgtacctattattttgtaatttgattttactccctaacaatttattttagggatcttttcatgttagtccattggyttgaaggactgaagaatatggaggtgccagatttgttcacttagtcctttactaatggacacttaggttgttttcagtttttccccttaacaaaccatacactattaacctaggctaacaaaacactgaacaaccggcatcctattacctccaatctacaacaacagacgctccaaaggaataaaactaaggaaagtcagtctagttacctcatatcctaacatgtgttgtatatagagtactgagcccttaccaacaccatgaaatcagagagggctctcaaggycatttagaatcaaactcatgccatgactgagtctcctggagcaacgccctgtgccacagaggtgccgtcttgaacacctccagagatggggagctcacaacctgatcaagatacctcagttcatcttccaggagctcagactgaagaggaaggggacaagaatgggcttcacttgtctactttgtctctccttccccactccaaggctgctgctggagtttgacctactgatcttcagcttcggacagctgccattggcgctggtgacctgggtgcccatgtttctgtccaccctgttggcgccgtaccaggccctacggctgtgggccaggggcacctggacgcaggcgacgggcctgggctgtgcgctkytagccgcccacgccgtggtgctctgcgcgctgccggtccacgtggccgtggagcatcagctcccgccggcctcccgttgtgtcctggtcttcgagcaggtgagggccgagccctgctgacggacaggaaggaaccagctggtggggccatctcagcagagggggagtcccccaaagagggggcggggcccacgagagggaggcgctggagaaggcattggcaggggcggagctagttaccgggggtggagtccattacgagggatttggggaacctgcaggctggaaggcaaacactgtgacaccgccatcacaggaggttgaccggaagactccgctctggcctcttatccyagcagccttcattcatcccagcatatgttagrctatacggccatccaacaaaaagaaaaagtatgggctctgaccagacagatcttacactctgcctgcctctcagaggtaacccararcacaragaggktaagcgatttgcttaaagccacacagcaacttttcctccccttccattctgccacaggttaggttcctgatgaaaagctactccttcctgagagaggctgtgcctgggayccttcgtgccagacgaggtgaggccttcatcttgcccggttgtgaactcagtcctcttggctgactgaatgaagccagcaggtgcaggatcctgataaaagtccctgccttcctaagcccgggttgcccaccaggcacagccctggcatccagctgggctctgtgggccttcatcattaggcattctcagcccctgcctctgacagatggcacctctgttacccaggacttctggcactttcctatttcctatttccaggcccagcctgtcacccaggctttgttattccatttrtagagcacaggcagagtatatttagcatcattcttaagggccctaraatttttggaatgacaagttggcactggctccaacttaaagtcaccagctgcattagcccttaacaagagcccttaaagtcaccagctgcagrctgagcacagtggctcacacaggtaatcccagcactctgggacactgagacaggaggatcgttygagcccaggagttcaagaccagcctgagcaacgtagtgagatggggtctcacttcaaaaaactttttaaaattagccaggtgtggtggctaatgcctgtggtcccagctgtgtggaaggctgaggtgagaagattacttgagtccgggaggkgaaggctgcagtgagccatgactatgtcactgtactccagcctgggcaacagactgagatcccatctcaaaaaaaaaaagtgagagacatgcaactctttctttcaytcacttgaacacttaaagaccatttcaacgttattaattggcccaatttcaaatttttttttttttttttgagatggagtcttgccctgtttcccaggctggagtgcagtggcacgatcttggctcactgcagcctccaccttctgggttcaagcgattctyctgcctcagcctcctgagtagctgggattataggtgtgtgtcaccacacccagctaacttttttgtacttttagtagagacagggtttcaccatgttggccagggtggtctcgaactcctgacctccagtgatccacccacctcagcctcccaaagtgctgggattacaggcatgagccaccgcgcccggccaatttttttttttttttttttttttttagagacagggtcttgctatgttgcccaggctggtcttgaactcctgggcttaagcaatcctcctgccttggcctcccaaagtgttgggattacaggagtgagccattgaggctggcccctaatttcaatatcgttgtatctsagcgaataggaaagctcgaggagaacagaagagatgggagaatggccggtcagyagagtagtcagaacacacacagaatttgtcagttaagtttgctctcttatttgggtgtatttcatgatgccctaaaacaattacaattgtaacattaaaaatcactggtcacrgtgatttttgccgaggtgagaagttggggtaraagggtggacctgtgactcatggtggtggagaggggacgtttctgggaggcctggggaggcagtgggagggtggtgccaagggaagaggaggccagtgctgggccagaggtccaatgccaccggcagctgccagtgtccctctccagttatgtatccccacaccccctccaggccctgggctgtgtgctctatgcctgtgcaccataccacatataataataagaagaaagaaatatttcaggaattgccaaaatgtgacacagtggcatgaagtgagcacttgccgttggaaaaagtggcactgatagccttgtctcttgcagggttgccacaaactttcaatttgtaaaagaggcaatatctgggaagtgcagtaaaataagatgtgcctgtattaggaagtccagacagaaggggaaggagaatgggttgtcgaacgtgtgggtaccaaatgaagctctggccacagcaggccctgcactggaagatagggtgcctgaaatgacagcagaagagayggtgttaaagagccagttccgctcctgcccagcttagctcccctagcccgcatccaggtcctacgtccagctccttgcttatcccccacccccaccctatccatttctccactcaccaatcccaccacccttccccagcagscccctcacctctgccctctgcccttrcccttactaatccacccctctcattcctccccaggtgaggggatccaggcccccagtttctccagctacctctacttcctcttctgcccaacactcatctacagggagacttaccctaggtaagaccctgcactccttccccaaatgcccaggcccatcaggaaacttacccttctactctcccctccctgaggtcctcaggctcacctcaggcactggccactttctcaggaagcatctcataataaagatgggaaataggtgactggtagactaccctgtctccttgcccggcctatgatgacactagggcaacccactttcctggtttacccaggactgtcytgataatcctacccatcctacacacccttgttgacatccatgcttaaaacccacttgttatctctgttatggaaagttcagagtatcctagacyccaccaccctagataatcctcccaggcctaagcaattaagggaactgaggagagagggccccagaacccgtgcccaggctgaacagagaacaacatgaaagaatgagaaacatattgtccccattgccgctgcaggacgccctatgtcaggtggaattatgtggccaagaactttgcccaggtgagaagatagggtagaagggtggacctgtgactcwtggtggtggagagkggacatttctgggaggcctggggaggcagtgggagggtgatgccaagggaagagaaggccagtgctgggccagaggtcaatgccaccggcagctgccagcatccctctccagttatgtgtccccatsccccctccaggccctgggatgtgtgctctatgcctgcttcatcctgggccgcctctgtgttcctgtctttgccaacatgagccgagagcccttcagcacccgtgccctggtgctctctatcctgcatgccacgttgccaggtgagccaactaaggtagggctagagcagctgtgccctggggaaggctaatcagggaaggccttgctagttaccttccctcagtttcaacacgttctccttctgagtctcycctcacatctgtccccycctatcagggccattgccatggtctcagttcagaccatctgctccccctccacatcagcctcctaacccatctccctggcacccrgatctttcctttcccatctacccctaacactgctgcccaggtgaactttcctactgcaactaatcattccctaccctccttcaaaaactctagtgataagtcaatgctggcacttttggatcagatatgaacccttgatgtggcatccaaggctccttcccacacagccccagcctatctgskgraagatatgtgcytccatgcctccaggcctttgcccatactggcccctcagcttgaaataccctttcctaattttcagccatggaatctagttgcttcttggaggcccatggttgagatgccccctcctgtgggaagccttccttttgtagccatcaattactatgacccacctgtttctctgtactcacaggcacatcaatgccaccatacttagctcccattacatttgccctggacacatggttggacatctttctgtctctgtctctgtgtgtgtctcacttcaattactctgtgaactcccaatggccctttgagaytcatctctatcaccaacatctggcacaaagtgatgccaagtaaatgtacatgaacaaatggatgaataaatgaatgcatgaggccaggcacagtggctcacacctgtaatcmcaacactttgggaggccaaaggaggaggaccgcttgaggccaggagttygagactagactggacaatatagtgagatctcatctctacaaaaaacttaaaaatagccaggcatggtggctcacacctgtaatcccagcactttgggaggctaaggtgggtggatcacgaggtcaggagatcaagaccatcctggctaacacggtgaaaccccatctctacyaaaaatacaaaaaattagccgggcgtggtggcgggcgtctgtagtcccagctactcgggaggctgaggcaggagaatggcatgaacccaggaggcggagcttgcagtgagctgagatcgtgccactgcactccagactgggagagagagactccgtctcaaaaaaataataataataaaaaaaattakctgggagtggtggctcatgtctgtagttccagttacttgggaggctgaggtgggaggatcrcttgagtccaggagtttgaggctgcagcgagctatgatcacaccactgcagtccagcctgtctcaaaaaaaaaaaaaaaaaggaatgcataaatttgtgaattaccaataaatgaatggtaagagttggggccctggtttctgggcaggggctcctcagaacccagatcagggctgcctgtgggtccatgtgggccagcctgacctgcagcctcttgtccccaaccaccaggcatcttcatgctgctgctcatcttctttgccttcctccattgctrgctcaacgcctttgccgagatgctacgatttggagacaggatgttctaccgggtggggcctggacctaggccagttggaagctggagatagggagggttagggagggatctggggaagatggtagccaggttgggtgtcacttcagccatgctgttcacctcccataataagaaatgcagtcctctggatgtgcttataatgccacccctccacctcctgacaagccagggctaactgcttttgtgtgcatggtactacagaatcttctcctgagagagggagtaggagggaggacagggcctccgtgacctgaggagggaggtgggagagtgtctgctgtccctgttctgccaggagccagcccttctggaacactgggatagggtgcaggcagagggagcagtggggaggagccrgaacccagatgcttgcttacctcctttcccccactctgaccccaccttctccaggactggtggaactcaacgtccttctccaactactaccgcacttggaacgtggtggtccatgactggctstacagctacgtgtatcasgatgggctgcgggtatgggccctgcagaccccttcagctctcacagttaataggggctctccttccttccctctccttccctcctgctacagtgtggcaactacaccactcacctaagggcctaagggccgttttgatttcatctgtcctcaytttctcattttacccaacccaatgggtagaaagtccttgcaatcttaactttcttccatctttatccttaattccaccctgtccacagggcattgtttcccaccttagccttctaaggaacatgcacatagcaattttcagctaccaagggtttttacatacatttaatcagcacagtaaccctgagaaataaatatgattatatcctcattttaaaatggcacctaagtcccaatgggatagtagcatgctttttttttttttttttttttttttttttykgagatggagtccagcctwgttgcccaggctggagtagagtggcacgatcttggctcacctgcaacctctgcctcctgggttcaagcgattcttctgcctcagccttttgagtagctgggactacacgcaaatgccaccatgctcagctaatttttgtatttttagtagagacgaggtttcaccatattggccaggctggtcttgaactcctgaccttatgatctgcccatctcarcctcccaaagtgctgggattacagacgtaagtgaccgtgcccagccagcatgctcttaaataagattgatgtcaccccttctgacctcagatcccatattctttccactgcgccacrctccccctggcttccttaaggtgggggctcttttttttttttttttttttgaccattgggaggtaaacatcttaaaagcaaattttattctggttacattcattagcagaaatactttcatctgacacagcattaggtcaacaactttaaaccccaaactaccttttttttttttttttattgatcattcttgggtgtttctcgcagagggggatttggcagggtcataggacaatagtggagggaaggtcagcagataagtgaacaaaggtctctggttttcctaggcagaggaccctgcggccttccgcagtgtttgtgtccctgggtacttaagattagggagtggtgatgactcttaaccagcatgctgccttcaagcatctgtttagcaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctatttctttctacacagacaccgcaaccatccgatttctcaatcctttccccaccwttcccccctttctattccacaaaactgccattgtcatcatggcccgttctcaatgagctgttgggtacacctcccagacggggtggtggccgggcagaggggctcctcacttcccagtaggggcggccgggcagaggcgcccctcacctcccggacggggcggctggcygggcggggggctgacccccccacctccctgccggactgggcggctggccgggcggggggctggaggtgggggctctttgtggaggagctcagggagacttactcttcactcctttcctcaccctgccagctccttggtgcccgggcccgaggggtagccatgctgggtgtgttcctggtctccdcagtggcccatgagtatatcttctgcttcgtcctggggttcttctatcccgtcatgctgatactcttccttgtyattggaggtgagctggtctctgtgccactggaagggagccatccagagggaggcctgcatcctgctcctgcagatcccagactgatggtgggaggcctcgcccccaggcctggaggyaaggctgctgagactgagaggtggagtcaagggggtacttggaaagcagggagggaggcagcatttgggaggcagccaagctgtatcctggggcatgtgggaggaggtttctggttggagaggaatatttgaatagatcactcatggaggaagacaaagaggaggaaactgggatgaggctgagaggctcagtatgagattcaggatattgaagtacaaactgaagaatcctggttttacatgggccactttagacctctacgaatttctgcacctgagttcaagatcttctccaatggggccttcttgttccatctcttcccaataccctggaatgggagggaagccagggagacaaggcactcctggagctggaatgacaacctttcctcctgcaccaggaatgttgaacttcatgatgcatgaccagcgcaccggcccggcatggaacgtgctgatgtggaccatgctgtttctaggccagggaatccaggtcagcctgtactgccaggagtggtacgcacggcggcactgccccttaccccaggtaagagaccacaaccctcatccagctccccatccatgaggacacacagaccaacagccagtccctccttgttccccaactcaccggccacagtcaggcaccagggcctggcttgggggtgatggactctcacgtcttggatgcatgggttgagtcaccaggmatgatctcattcacgacttattcttctctggctcaggcaactttctgggggctggtgacacctcgatcttggtcctgccatacctagaggtcgggacagacgacgctacctgcccagacaccaccaagttctctgcctgcaaaacctgggaccaggactcctgtcygcattcccaaatttggctctgagtcgaggcaacctgcacacaagaccccaccaaggaatgtgcaaggactgagatctgcagacttgtgggtaactgatcacagacctcagcatgggggtgaccagggtgactcttcaatccctatccccatgggctgggtacaggatatcctcctaccccatgactgtcttagggagacttggggtaccttatggatttgatgaatgtgggggaactcagaggaactggggccaccaaggttggaaaagggtttggttcttgactttgtattccttccaatacagcaataaactttgtctccctttttattcattcattcattcattcattcattcattcatcatttgtggaaggctcacttggatttttgtagagttgtgtctgcagaggcaagactttgtggtaggatgggtgagaatcttgggtgccccctgccttaccttctctatgccaccaccatctcccagaaacctgacccttcttccacctcttctccagctcatattgaattttctagcccctttaatccttctgctcatggcatgccctagcacattttgagaggacacgtagcaggcctcctttcctttagtagattcaggagaggcatgcctcgtatagacctgaaaygaagcttttaatttcgtgaaccccagtttctacaactataaaagggacattaaaattaggagtgtcccaactgaaggagacagaaggtcaaaatacttctgttcaaaactgtttcagaaaccagactatgtggtctgccctccccacactgattccctkcctgatgtggttctggggagacatctgtgtaagaaaagtggggaacattagtctcaggggggctgaggaccaaaaaatccagggtccctaagagagagagatggggtatttcttttttttttttyttttaacacttcaacagtgtgtataagacatctttttttttttttttgagatggagcctcgctgtgtcgctcaggctggagtgcagtggcgcgatctcagctcactacaagctccgcctcctgggttcacgccattctcctgcctcagcctttggagtagctgggaccacaggcgcccgccaccacgcccggctaatttttttttttttttgtattttcagtagagacggggtttcactgkgttagccaggatggtctcgatctcctgacctcgtgatccgcccatctcagcctcccaaagtgctgggattacaggtgtgagccacygcgcccggcataagacatctttttatgtcaataaatatagatctattttgtcacttttatttatttatttgtttttatttatttatttatttwttagacggactctcgctctgtcgcccaggctggagtgcagtggcatgatctctgctcactgcaacctccacctcctgggttcaagcgattctcctccctcagactcccgagtagctgggactacaggcgcctgctaccacgcccagctaatttttgkatttttagtagagacrgggtttcaccatgttggtcaggctggtctcaaactcctgacctcatgatccacccgcctcggcctcccaaagtgctgggattacaggcatgagccatcacacccagactcttttctccctctttttatgccttcttttgaataaattattattccacaagtggaatgaatgatacatttttatttcatttctgttatcttattgtatgttctttactcatcccatgatttagctttgtagctcatgttgctattctttcatttcccctaccccattgttattttggatgttctactatatttttccattctcttgttagttaccttcccttccagcaataataataaaacacacattatgattatttgaaaatatgccaattatgtattccattaagatgtttcatgtcctgcacttctaccaataagagacatttagaatactttttcttacctctctcactctgcttccaactcctgggtttttctgagataggatagtacttttggttgtagatataattagatgtctatcaagctccatgaacatttaactgtataatatttttctttctaagtttgttgctcactacttgttctttattctcttcaccttcctctatcttgatttctctgttctgtaccaaaccattctttcaggtgaggtatgagattgatatactctctgaatcctttggatctccaaatatatatcttttgccctgayaggtgaaagttctctcagctgggtatgagattcctgtgtaaggctggatgcagtgactcacacctgtaatcccagcactttgggaggccaaggtgggtggattacttgatgtcaggrgttcgagaccaacctggccaacatggtgaaaccccatctctactaaaaatacaaaaattagccaggtgtcatggcaggtgcctgtagtcccagctacttgtgaggctgaggcaggagaattgcttaaacctgggaggtggaggttgcagtgagttgagattgcaccactgcgctccagcctgggtgacagaacaagactcagtctcaaaaaaattaaaataaaaataaataaaagactcctggccgggcgcagtggctcacgcctgtaattccagcactttgggaggctgaggcaggtggatcacaaggtcaggagtttgagaccagcctgaccaacatggtgaaaccccgtctctattaaaaatacaaaaattagccgggagtggtggtgcacgcctgtaatctcggctactcaggcagctgaggcaggagaatcacttgaacccagggggcaaaggtcgcagtgagccaagattgtgccaccgcactccaacctgggcaacagagcgagactccatctcaaaaaaaaaaaaaaaaaaagaaagaaagaaagattcctgtgtagtcatttatttctctcagttttcccactttgagcctccagtgttgcagatgaaaagtcccataccaatgtgatttgtttccttttgtagataacttgctctttctgtctaaaaacttgaaaatgtttttctttaaccttgaagtttgggagtttcatgcctgtgtgtatgtcttttcttgttgtatcttcctgtttcctttcagtcttcaagctcagatatttcttcacgtcagcaaaattttcttctattctttattgcttctcctccatctattccttttcccccttttggaactaatatagttgaatttcaggactactggatctactctccaagaatcacattttcctcattatttccatctcttcatagtatttgctccatgctttgaaatattatttccacttgttcttccaagccactaatttgagtctcagcagtgcctattctctctttcaatacatatactaatttttttgttgttgaaagtgttgtttttttagttcccaaaagttgtttctttctttttccttttttttctttcttttcttcttcctctttttttttttttttttttttcatactacttgaatctctaagtgctcctaattgtttaagttatcatatatctctttcagkggctactgkgctttctggkgggcagggaaacaagctatcataactgcatccctgcagggccaaggctctctgagtcacattcttccagkgttccyatggtcctgatctctctgctctgggtgcttcaaagctggtctctatgcagtgagagtgaggaagctcctcaccaggtctccacaccaggacttcccccctctaaccctaagttaaggctttaattggcaccctgcagcctggctccagcagcaacatggctaaatgtttggaaatgagggtggaatagagtggaaattgccttagaactgtagttctcaaactccatcgtgcattagaactaccttcggggtttgttaatacagagtttctgattcattaagtctggggtcaagcctgagaatgtgcatttctaacaagtttccagggsaagcccttgctgctgatctagggaccacttctttagcatacaccgaaccaagccctctttcttctcctcctttttttcctttttcttcttcaaaattattctttcttttctttcttactttttttttctttttttttttgagacaaaatcttgctctgtcatccaggctggagtataggagtgcgatctcagctcactgcaacctcccgctcaagagattctcatgcctctgcctcccgagtagctggcgttacaggtgtgccccactgcacctggctaattttttctatttttaatagaaatgggatttcactgtgttggmcaggctggtcttgaactcctggactcaagtgatctgcctgcctcagcctctcaaaattctgggattacatgcatragtcaccgcgcccagcccaaaattatacattctttttatggtaaggaaattaacccaatgtcagggaattatctcctagttttatgtttagtcttcctactagttcacggtactgggacttgtacacgaatgagctccatccaggcgcctcctccaccgaaacgctcatgggtgcatccctgacgagcccaggtgtgtctaaggaggaggcaccagcggggacccgaaggcactccaggcaggacaccaccactgggctcacctgaagatgagtaaaggtgggtcagaccagaagttgccatctgtgcatggcctcaggcccccctcctctttggacacccttttattattagctttgtgcccacacagccctcccttcaggatcctcaggggtcagagggctgtggttcgggaagtacctagggtggcrgtaggtggtgaggctgctgcccggcaggactttcctcccctgctgagagccacctttcttcctgtctacagtctgcgagtgttgtcccctgtgtgtccccagactgcacccaactgcttgttacagacaccttcccttcacccctttgattttgcctagtgtttccccttctttaaatcaccttgcctgtcctgggacccttatagcactcgctctgctgtcctatggtcccctcccgaatctgtgctgtccagtgtctgtgacctctgtaacaccccacacctcactatccatgctcctctcatgctctgccatgcggagctcctcttccataacacacactccaccgttctacaacacaggcttcaaatgggcatttcagcaaagtccaatgaccytaatcttaatctgcatgcaggatttccttttttttctttctttcttccttttttttttttgacagagtcttgctctgtctcccaggctggagtgcagtggtgcaatcttgactcactgcaacctctgccttctgggttcaagcgattctcatgcctcagcttcctgaatagctgggactacaggtgcatgtcaccatgtccggctaatttttgtatttwtagtagagacgggttttcaccacattggccaggctggtcttgacctcctgacctcaggtgatccacccacctcagcctcccaaagtgttggaattacaggcgtgagccaccatgcctggccaggatttcctttccattcttcaaaggaactatatcattcattctctcttctcccatcatccctctccaagcccacagaactccccagcagctctcctctgccccaattccttcctgttaactgaagaaattcgccctcttccctctcctcctaccatctcactcaatgatatcagcagctctggcaccatccctccattctcccttctactagattgctcccaacagcagccagctatgctcctagtctactctccctatgtctaactgtccctctcctcccccacagctacatcaggctgctgtcccacttctcagctccctgtcacagccacacttctccaaagagttgcctgtccccactgttgaggtttttcacctcacattcactcaagtgttgatcataggtctgcaaaggggcctctcatattttaatatgggttatttgctccagtacacaagccttcctgttatttcccctctcatcagatggacccactttgacacatgacaaatctgtatggattcttgaaaatgtagtgctttattgtaccttttaaatttatataaagggtttagtcagctttattcaaatataattcacatatcatacaatttgtccacctaaagtatgcaagtcaataatgttagtataggccgggcgcagtggctcaagcctgtaatcccagcactttgggaggccgaggtgggtggatcacgaggtcaggagatcgagaccatcctggctaacatggtgaaaccctgtctgtac

SEQ ID NO: 13372 - DNA, 28724 bp, Homo sapiens
aacatagtgagaccccgtctctacaaaacaattaaaaattagctgggtgtggtggtgcatgcctgtagtttcagctactcaggaggctgaggagggaggattacttgagcccaggaggtcaaggctgcagtgagccatgactgtattgctgcattccagcctgacaacaaagttgagacggagtcttgctctgtcgcccaggctggggctggagtgcagtggtgcgatctcagctcactgcaagctccgcctcccgggttcacgtcattctcctgcctcggcctcccaaagtgctgggattacaggcgtgagccaccgcgcccggcctaaaaaaaaaaacaacttttttaaagaacagttttaggatgggcacagtggctcacgcctgtaatcccagcactttgggaggctgaggcagggagatcacttgaggccaggagttcaagaccagcctggccaacatggcgaaaccctgtctctactaaaaatagaaaaattagctgggcatggtggcacatgactataatcccagctactcaggaggctgaggcaggaggatcacttgaacctggaaggtggaggttgcagtgagccactgcactccagcctgggtgacagagcgagactctgtctccaaaacaaaacaagcagacaaaaaaacaaaaccaagccaataaccccaagttcctcaacttttaggtacctagggaggtttctggactaggactctggagacaaaattttaagaaggggagcaatcatgctcttgggaaaatacatatatatgtatttttagacagagtctccctctgtcgcccaggctggartacagcggcacagtctcggctcactgcaacctccacctggcgggttcaaggggttctcctgcctcagcctcccaagtagctgggattacaggtgcatgccaccacacctgtctaattttttatatttttggtagagaaggggtttcaccatgttggccagtctggtctcaaactcctgaccgcaagtcatctgtctgcttcagcttcccaaagtgctgggattacaggcatgagccaccgcacgckgccatgggaaactaatattaatagatgtgtggctatggtgatgagaagggaggagctggagaaggagctacacggccctgccagggatgyccttgaaactatgccctcttccagggcatccstacrttgttcctcggtaaggagaccaaggacacaatgagagctgctcccttgggatcagaagcatcaagataatttcctgaccaggtgcgtggcatgtgcctgtagtcccagctacctgggaggctgaggcaggagaattgcttgagcctcggcatttgagtccagcctgagcaacatagcaagactttgtcgtaagaaaaacaaaaggtgatttttttgtcttggccacagtctccctgtccactaaatgattgagggtgggaatggaagtagaaccaaaataataggaaactcaaagttgtctgagatccgtgaaaaaataagccactttttaaaaaaacatgcctttttttttctgtaacaccttttttaartcagatgttttctcatttatayggactctaaataaaatgaagatctctttttaaaaggataattttttagaagttttatggaaaaaaattttttttttagacaggtctggctctgtcactcaggatgcagtgcagtggcatgatctggctcactgcgacctccacctctctggctcaagctagcctcccaactcagcctcccaagtggctgggactacaggcatgagccaccatgcccagctgattttggtatttttcayagagtcggggtcttgccatkttgcccaggctggtttcaaactcctgagctcaagtgatccgcaaaccttggcctcccaaagtgctgggattacgagtgtgggccactgtgctggcttattatgtaaattctcaaaaatatattaaagtagggaggatagtataatgaaccttcttttactcattgctcaacttcagcagttrtcaaaccaccagtataccctccccatctaccctcaaaccagattatttagaagcaaatcctagtcattttatcatgctaaacagaaatgcttagcatgtacctctacaagaaaataacaaaaaggacttctgattatttacaaatcttaatcttgcttccccttcattcctcatctatcccagggcatggattaggaagcgtgagttctaaccctggtttgccccttgctaaccgtgtgagcagaggcaaatcatttaacctttctggacttgcatttttctcacctgagtgagggaactagatgatttctaagatcccttctagttctagaaatcaaaaattcatgcaagggccgtccttcaagcctctagagacatacagatttggtgcagtatctatttactggtttttgtttgtttgtttgtttgttttgtttttttggtgcartgcccagttcagagtcaagaccctctcaatgaagagccaagcaaaagtcctagaggctgctggtggcggaatctttaacctggagctttaggaaagaaataggccttggagcttcccctttgtgcagtttcatgstgccctckgtatctcttctcataacctcaatttatcattttttttttctttttttgagatggagtcttgctctgtcacccaagctggagtgcaatggcatgatctctgctcactgcaacctctgcctcccaggttcaagcaattctcctgcctcagcctcctgagtagctggtattagaggtgcccgccatcatgtccagataatttttttgtatttttagtagagacagggtttcaccatgttatccaggctagtctcaaactcctgaccttaggtgagtgatccgcccaccttggcctcccaaagtgctggtgtgagccaccctgccctgccggcgacccgtcactttattaaacaacaggaactgatttctgtcatgttccaggtgactgttaaggaataagaatactcattttatgggcaaataaactgaatgtgaagtaaagtaggtgcatctcaggttgcctggtgaaagaaggattaagtctggtatagggtttgtcttttaaaattgtggaaaacatgcatatcgtagattgacttttagggaaagatgtgggtcctattgggttaatggcggaatcttttggtaagatcatgcccagccctgaggacygttgccaatgcctccctcaccacgtgtgccatgtgctcttgaggacatcctgtcattggcttcccacaccatcattacatctggaacaarggacgcataaaaagtgagtggcccagcgtggctcagctggtaagtgaagggcatgggcttggacccaggacttccagctgctgcagcatgtgtcctgctcccctacagcttgaagagggctaaatgagactggaggacttcttagaaaaagagacttgattatcagcgtagtgggagaagagcaaatgcttatgaatactgcacctgtgctttaaaagtcaccatgagctgggcgttgtggcttacgtctgtaatcccagcactttgggaggccgagacaggtggatcacttgaggtcaggagttcgagggcagcttggccaacatgacaaaaaccccatctgtactaaaaaaaagaaaagaaaagaaaagaaaagaaagaaagaaaaaaaattagtcaaatgcgtttgcttgaacccaggaggtggaggtacaccctgggcgacagagagagagaggtraaaaacaayaacaacaccatgacccagagaaagaaagaaaaaaaatgaagttcccaaatggaaaaagcccctaaaattaccattttaaaacacagccctaatcagctctggggatttgcaggaaactcatcgaagctattgataggaactattgttttggtgccagggttttcarttgggagttagatttaaaaggaccaaagatgacatctgatatttcaaacagaaaccgacatttctcagtggaaaactttccgggccagtgcattttggggttggttactgtgcttggagacrcccctgagttggaggacacacttctggctgatgtgaggggcttctgaggagggccaaaatgtacactctttgtgttcttgcaccacggctattagactgtgagactctgtccttagcaggaaatggtaaaggaatcagcaggaagcctaaaacaagggaagggaaactcctccctcctatcaaaggccaggcaagggcgaggatgagaatggaaagtggggcacgtgcattaagccgtctgggggagcggtagggatagacatgttgaaatggagagtggttgaatcttgaaaggaagtaaggaaaatgtatatgccacragggcaaggatgtatgataggcttgtatttattgtataactttattttattttattttattatttttagttttttgaaatagagtctctctctgtcacccaggctggagtgcaatggcaygatcttggctcactgcaacctctgcctcccgggttcaagcgattctcctaccccagcctcccragtagctgggactacaggcactcgccaccacgcccggctaattttttgtatttttagtggagacggggtttcacggtgttagccaggatggtctcgatctcctgaccttgtgatccacccacctcagcctcccaaagtgctgggattacaggtgtggaccacagcacctggcctttattgtataactttaatatggagccttagtcctccagaaatctgcaccatgcccagggaaaatgctgttcctttatttacatgaggcagaggtttgtgttgtttgctgaggtccagcagctcactgtgaggacaacctctccctcgttcctgatttctggcttattcaaggccagaggacccaaaactcgagttgaaaattttgactaggagaacagataaaaatagaaatggaatccatcttaagaaatgctcaatgtgaaggagaggggaatgcaaaatagtttttctgttttaccacagtctttgtaactgaaaatcctatgttcttgagatagagagagagccaatgatccaatgcaagaaactgagtttaagaagaaactgtttgctgggcacggtggctcacgcctgtaatcccagcactttgggaggctgaggcaggcggatggcctgaggttgggagttygaggccagcctggccaacatggtgacacgtcgtctctactaaaaatacaaaattagtccagcgcagtggtgtacgcctgtaatcccagctactcaggaggctgaggcaggagaattgcttgaaccctggagatggaggttgcagtgagctgagatcgcgccactgctctccagcctgggtgacagagtgagactccatctcaaaaaaaaaaaaaaaaaaaaaaaaaagaagaargaagaagaagaagaaactgttcatctgaaatccgacaactcattcttgaaggttagagctcagctttgaagtttcacttcacgagcttggctcagtgaggtatgttactccccggtgaaaaagaaaatgaagagaatgttttatgttgaaagtgcttggtgacgaaaaggcagcacctagatcccttatctcataaaaaatgcagcagattcttaatattagcaatctagtrtttagattgttacctgaagaaaggaaaaacaaactgtcccaaatgctgattctactgtttcggtgggraaaaaaaatgtcttgcaggcaagtggcaaacaacaaaacttttgaaaaagcaggcctggggggagtccagtacagtttcataatgggtatgaatagttattttactgtgttccccccaccccctttctttctgggttttgatgtggatgtctttctatttgttcaggaaattgtgacgtgtgttctgggcagggtttgaggttttggaacattttctaaaagggacagagagcaccctgctacatttcctaatcaagaagttggcgtgcagctgggagagctagactaagttggtcatgatgcagaagctactcaaatgcagtcggcttgtcctggctcttgccctcatcctggttctggaatcctcagttcaaggtaagactcaggagtcttgttccccagccatcttctctgtaagccctgtggtccatgcaagtcattatattcattttaaggcatagaatgtataatattgtgagaaaggaggcaaagaagaaggatttggggtcgctgaaccctttaatatgagttctgttaagtttggtaccaagaaaaattaaactctgtggcgtgtgcagtcttgtaaactcttacaatgattgaaatgtgctattttgggatgaaaatgtgaggtttataaattttaaaagctcaaaaaaggaatctagaaaatgactcctgtgcctgttgcatggaggagatggcacctttgactgttggggggtgtctgcctacccctaagtgtctacatcagccccaagttttagtgcgctgtgacggtgtcattgttattttaacactgggagacgttatattccaattggggtgaatctgactgtgtgtattttcttttcttttttttttttttaaagataaacttggttcttactgaaaactcaattatggttagacatagttcatgtaaaacctctcagattttaaagagaaggccaaataatttggtatttgtgctcttgctcagagaagcatcatattcggaaatatcttcctaggtttatctaccatttagtgttgtttagtcagactgaaacaacttaaaacctgtaatgactaagacaatgaaaatgataggcttgtaagaaaaatacaatttgttattctttggcaaataaggaatcakgtstaaataagayggaggtcatggcttgatagagagatggctgaacctatagtagaaaaacactaggttccgccaaatggtaagggaaatgttgagtcacaatgacacacatgtcctagatttgtttcgtcaaagygacttttrgttgtcatgatcttacttccggtggagatgaaatcttacagatgatcgcagagacattcattttatgttggaaatttataaaatcattttcttctagttatgctaatgctgaaaaaagagcaagtaatgtttctggaacgttattaatttatgtatttttaaaatataaaacattgtcaattgtagggaacaggyttcactgggatcttttagggaatatcttcagcttgatgaaataattcccgaatagccaagtggtctgacaagatcgagagtaatgaggcccatactttagtacagtcttgaatggccagatggtgctgggcataccccaaccagagatatgtaagtctttatgttgtcaaaatttcccagaaacatgaatttcccactaagattcattaaggaaaactagaatgaaaacaaaaacgttccttgtataatattcattagaaagaaatgaagaaggccgggcatggtggctcacgcctgtaatcccagcactttgagaggccaaggtaggcagatcatgaggtcaggagtttgagaccagcctggccaacatagtgaaatcccgtctctaccaaaaatacaaaaaaattagccgggcatggtggcacacacctgtcatcccagctactcaggaggctgaggcaggagaattgcttgaacctgggaggtggaggttgcagtgagctgagattgcaccactgtactacagcctaggtgacagtgcaagactctgtcagaaagaaagaaagagagagagagagaaagaaaggaaagaaagaaagagaaggaaagaaaataattcatcatgaaattgtatagaatactagcatttatgtcatgacctcgtaggtttagctctttgttagaaaaggaaaccatagaaagagacaagggagaaactgacaaactagggtgtttccgaaaaaaggctctcagtatcgggctcaagggcttgtgcccacatctgagcatgcaggraaatagatgtcccccactggctgcacatgtgagtgactgcrgcacaaggctgtgatgtgaagagtcrtgacaccatttcctcacacctccacgcaatgccagatatgattcgacaacattcttcctgtcttataaaaagtgtttatctagcccgtyggtttggcagatgaaatcaactaggcttttggcttgcttttactgagcatattcaaaaccatttcaggtcactatagtggtttgctcggrttgccataacaaagtaccacggactgagtggcttaaataacagaaatgtatttcctsacagttctggagatgggagtccaagatcaaggtgctggcagggtcgatcgcattctgaggcctctctccttggcttatagatggygccttctcccttgtctgcacatggcctttcctccatgcatccgtgtcttaataccatcttcttagagggtcaccaggcattggatcagggccaccctaatggcctcatcttaactacctatatctgcaatgaccctatttctgaacaatttcacattgtgagattctgtgggttagaactggaacatatgaatttggtggtggtatatttttattataagtcaaacccaagtaaagatgtggggtaagattgtgtttaccaagcacaaagaaatggaaatttggggatgtgtaactctggagagcacagatgactaatctatttaatgtagggctccaggggatttgatgaggcctgtgaatcttccacttttattgcctctcttttccaatgacacccataaagaaaaaaaatggaatatccatgaacaggtgcagccaaggaggccaggcccgccatgtgtccactgtatactgtctcctagctcacaggaatgatactgatccactccttgtgctgctctttgtaaagtgatttcacatccattctctggtaatcatcatcacattccctgtgatgaggaattagcaccaattatagaggagaaaactggatctgacatttctcatctcatttgctctatacattaacctcttgcaaaaaatttgtgagtcttgcccaagacccattacaactaattaacggctgaactggtcgtctgatttcaaggccagaattaactttctactgcagctcatggatcagaggttttctttatttaaacaaacaaacaaaaaatcctttgaccgtagcccttgctataacrtttcccactgagttgagggagaaattgaaagtaaacttaggagctttttatagcttgtcaaaccatgcaagagtgggggaagcttatccatcttgtggaattgatagaccaggaggaagtaactccggcttagataatgctaccattttgaataaatcaaatggtcttcttttccccttcatggtagttgctgcttaagtttytytaacatgcctgcagtaagtttccattaagaataggaaattaggctcggtacagtggctcacgtctgtagtcttagcactttgggagaccgaggagtgtggatcacttgaggtcaggagttcaagaccagcctggccaacatggtgaaacccccatctctactaaaaatacaaaaattagccaggcatagtggcatgcacctgtaatcccagctactcgagaggctgaggcaggagaatcacttgaaccagggagatggaggttgcagtgagccaagatcatgccactgcactccagcctgggcgayagactgagactctgtctcaaaaaaaaaaaaaaaaaaaaaaaaaaaaagaaaaagaaaagaaaagaaaaaaaaaagaaattagtatattgtgattatgttgagggaaaagttagtaccataatataaaaaggtatggactattggagaaagttgtttgctttggtaacatttactcatagaaagtattttggtaaagcaggactcagggtggtgggggaggtgggcagtgagggataggattcaaataaaaaccattctttcccttggaatccactacacaattaaccaacaaatcccataagtggaccttttaggaagataacatttctatccatgagcatagccactataatcacaagacatttatctcaagcaagatagagtcaagatactctcacaacctcaggggctggaactgtaaattttcacatcctgccaacacccttgaatagctatgtcaagaatttagtgtctgtaacttgttctttattttaaagtacatttaacatcatcggccccaaattagataggcttttggagtgggatcccttctacttttgatttctttataaaattttaaaatagctttgttgagatagtgttcacataccatacagttcacccattaaaagtgttcaattcagtgattaggccaggtgtggtggctcatgcctgtaatcccagcattttgggaggccaaggcaagtggatcacttgaggtcaagagtttgagactagcctggccaacatggtgagaacttgtctctactaaaaatacaaaaattaactgggcatggtgrtgtgcacctgtaattccagctacttgggaggctgaggcaggagaatcacttgaacctgggaggtggaggttgcagtgagctgagattgcaccactgcactccagcctggatgacggagcaagactctgtctccaaaaaaaaaaaaaaaaaaagtgttcaatgttttttagtatattcacagagtcatgcaaccatcactataattgcttctagaacattttcatcatcccccaaaagaaagccttcgttacgaattttaattagctgagattctgaactctgggggaattttgtattctagaaatattttttactaatatgctacagttgtatttgtcatgctggtgaaaagatgtggtctttcacctggatgctttctcattaagcattatttttctgtttagcttcctgtgtragcaaacattttctcagcttgatactcagtgcatcagcggcttgcagaagagactgcctaggcctgctctgtccagtacggtagccacaagtcacttgtggctactgaacacttgaaatgtggcaaggccaaattgggacaggctgtgaatgcaaaatatacaagatttggaacccttagtatgaagaaaagaatgcaaaatatcccagtaataacttttacattgatgatatgttaaaggacaatatttgaatatgttaggttaaataaaattaatttcacctgtttctttttacttttaaaaatatggccgctggaacatttaaaactccctatgtggtttgctttgtgtttctattggacaaagttggtctagacagtacaaggtgtgaagacaccgccctctgctggagaagatgctggatttttatttcacctacaggaagagacgtctaagtagcaattagatgctaaactaatgctgcctcaggaaagaatcaaaagagaaagagtgaaaccaggccgggcgcggtggctcacgcctataatctcagcactttgggaggccaaggcgaggggatcacgaggtcaggagatcgagaccttcctggctaaccccgtctctattaaaactacaaaaaattagccgggcatggtggcacgtgcctgtaattccagctagtcgggaggctgaggcaggagaatagcttaaacccaggtggcggagggtgcagtgwgctgagatgtgccacagcactccagcctgggcaacagagccagactctatctcaaaataaggaaaaataaaaaagaaaagaaagaaagtccataaattgagactcctagagatactaaatggtagaatgggaatttgaatttaaatttataagatgttcactctcggagatcataggtcattgttgtcctcctccttttcatgacaggaactagcaatgaagagctctgactatgtgctaggtactactctgagaacctaacatttgtatctccttattaactctattactgccccatcctacagatgagaaaattgaggcacaggaagtttaagttggccaagatcacacagccagtaaggggcagacattgaaaggtcattttgcctgccttatccccagcctccaggcagtggcagagttagctcattttggacaaacagctctcccagaccagacattgtaagctatactcaggaatcataggaaagattatgatagaataatatatagttacaaagaaaagaaagaaaatccaatgggagaatatttactgttttctatattaaagtgtttaatgtttatgtttttagaggaatattgtttattatagcaatttagaaaacaaaatgagaaaaaaaatcaccaaagattctacctccagttatttttgtgtatttccttccatttttccccccatgtctgtttatataattgaaactattattcatgcaaagaggtattctgattttctcagttatttttatttatttttaattttgtaaataaacttttttcttctgagacagtctcgctgtgtcacccaggctgaagtgcagccgtgcaatcttggctcactgtgacctcccagtctcaagcaatcttcctgcctcagcctcctaagtagctgggactgcagatgtgtgctaccacatccagctaatttttaaaatcttttttctcttttttggtagaaatgggagtctctctatgttgcccagcctgtattgaactcctgggctcaagtgatcctcccacctcagtctcccaaagtgctgggatttcaggcatgagctaccacacccaacstaatttttatttttattttattaaaaaaaaaagtttttgcctacccgcctctcaccctctcactcatttttaagtataggtttttytacaatgccacattgtcttttccataaaaagtactttcggccgggtgtggtggctcacacctgtaatcccagcactttgggagactgaggcgggtggatcacctgaggtcaggagttcgagaccagcctggccaacatggtgaaaccccatccctactaaaaatacaaaaattagctggatatgattgtgggcacctgtcatcccagctactcgggaggctgaggcaggagaatcgcttgaacctgggaggcagaggttgcagtgagccgagattgtgccactgcatcccagccagggcaacagagcgagacttcatctcaaaaaaaaaaaaaaaaaagtacttttcttcatttggttagtattctcttatgagttgatgccttgtaatttatctgaatgttttccattattttgtggtgagctttaaaactacccttcctgactttcaagaatcctagacatgctccttcttgctaggtaattattagttgcactcattagaataaagtatatgcttggagtggggaggagatgaactttttgaagggcggtgaagtatttctcaccaccaggcctttgtctttgctaaactgaggaaggaagattttatttcattagctaacaaagaacctcctatataggccgggcatggtggctcamgcctgtaatcctcacattttcagaggccaaggtgggtggattgcctgagctcaggagtttgagaccagcttgggcaacatggcaaaaccccatctctactaaaaatactaaaaattagctgggcgtggtggtgagtgcctgtaatcccagttactccagagggtgaggcagaaaaattgcttgaacccgggaggtggaggttgccatgagccgagatcgtgacagtgcactccagcctgggcgacacagcaagactctctctcaataaaataaaataaaataaatacataaataaatctcctatataacctcataatatcagatttggagccttttccatagaaatgaaattcagaagaagctgagactcagatattccaagctgcctggtgctctgtgaatagaggagacttgttcttgtgaaatctgagtgcaaagacacaggacaaattgttatctacttttcattcctaaggatactgtatggccctaaaacacaagaactagaattctgtgataccacgggtactccacagtgtgttccttcccctttctgaacctgatttgwctcatctctatgaaaagatgtgggctttggggtcagatgtgggttggaatcctagcgcctgtgtggctgcaattttcttttgtgtaaaattgagataatagtacaaaagtaacaacagttaatattatcaagtgcttactgtgtgcctggcactgtgttaaattctctaagtgtattttctcatttaatttttgtgataggcttatgacactattagtatcttcatattacagtgagggttcagagaagttaaggttccataactagtcagcagacctgggacttcactccaggcagctgattccaaagcctattctaactttaaactgctactttttggagtgttgtaagaaggacaatttatataaaatgttggcacatagtgggtgctgctgttatatgaatgggcacaaaatctgtctacattttgccttttaccaaatttagaatctatttagttaaaaccttcttagggcgggtggrgtgcagttgctcattcctgtaatctcagcacactgggaggccaaggcaggaggaytgcttgagcccaggtgtttgagaccagcctgggcacatagtgagacccccatctctccaaaaaacaaacaaacaaacaaaaacaaaacaaaactagctgggcgttgtggtgcccctgtattcccagctactcaagaggctggggtgggagaatggcttgagcccaggagttcaaggttgcagtgagctatgatcmcagtactgcactccagcttgggcagccgactgagaccctgtctcgaaaaaaaaataaaaataaaaacttcttaggacagagtgattagaagctststagtagatacttagtaacaatgtgggttcctcgggcaggttatcctacgcrgagagccaggtaccaatgggtgcgctgcaatccagacagtaattctgcaaactgccttgaagaaaaaggaccaatgttcgaactacttccaggtgaatccaacaagatcccccgtctgaggactgacctttttccgtaagtggacttttctctaattaattaattaattacttatttatttgagacggagtttcacttttcttgcccaggctggagtgcaatggcgcaatcttagctcactgcaacctccgcctcctgggttcaagcgattctcctgcttcagcctctggagcagctgggatttcaggcgcctgccaccatgcccagctaattttttttttttttttttttttgagacggagtctcastctgtygctcaggctggagtgcagtggcgcaatctcggctcactgcaagctccacctcctggrttcacgccattctcccgcctcagcctcccgagtagctgggactacaggcacccgccaccacgcccggctaatttttttgtatttttagtagagacggggtttcaccttattagccaggatggtctcgatctcctgacctagtgatccgcccgccttgwcctcccaaaatgctgggattacaggcgtgagccactgcgcctggcctaattttttgtattattagtagagacgggctttcatcatcttggccaggctggtctcaaactcctgacctcaggtgatccacccaccttggcctcccaaagtgttgggattacaagcatgagccactgtacccggccttttctctaattttaaagtgtctgtaatttcacaacctcttggcacagatgtgggagtgtttttcttcaagctgtccagagtgttttgcttcgagctcttgctttggtagtttggctcttactctgcagtacatggtaaaagtgtactgtatatactggcatatgacatgtgcgagtatacatgattcacctatgtttttgaaattttttttgtggatggtagagaggagcattgaggacttttcatcaacaggtattgaaaatgattgaacattgttttatttgtgtaaacagaacacactatatataaaaatccaataattaactgaatggataagcaaaatgtggtataagcatacaaaggaatattattgggtcataaaaagaatgaagtactgatacatgctacaacatagataaaccttggaaacattatgcagagygaaggaaggccagayaccaaaagccacatattgtatgattccatttagatgaaatgtccagaataggcaaatccctagaggcagaaagtagattagtgggttacaggggctggggaaagggaggaataaggagtgactgctaatgggtatgagggttttttttggaggaggtgattaaaatgttcttctgccaggtgtggtggctcatgcctgtaatcccagcactttgggaggccgaggcgggaggattgtttgagcccaggagtttgaggccagcctgggcaacatagtgagaccctatctctatttcaaatacattttttatattaaaaaaatgttcttcaagtagttggtaattatttttaaaaatggccaggtgcagaggctcatgcctgtaatcccagcaccttgggaggctgaggtgggaggatcccttgagcccaggaggtttgggaccagcctgggccatacagcaagaccctgtctctacaaaaaatacaaaaattagctaggcatagtgatgtgcacctgtggtcccagctactcgggaggctgaggtaggagaatctcttgagcctatgttgagcctgcagtgaaccctatttatgccattgcactccagcctaggcaacagagtaagactctgtctcaaaaaaagaaaaaaaaaattagggaaaggaagaataattagccaagacttgtaaaacaaaaatcaaatctcttcttttgatcacataaaacttgctttaaacttgcaaaaaagacctgatataaattcataagtaacaaaaaattgaattatattagaaaccattaattcaatgaatactaaagctatgtaggatgtagcaaaatatacatattaagaaaaggattatcataaaagttttaatctccaggctcaaacctagaaaatcactctcctcaaagccagggttaatcatcatgctccaaaccaggtacatttcacatcactttgggatcctggcaactttctcttttgttttttttttttttttgagacagggtctcctctgtcacccaggatggagtgcagtggtgtgatcatagctcactgcagcctcgaactcctcargtgatcttcctgcctcagcctcccaagtagcgggaccacaggcacamagcaccatgcccatctaattaaaaaaatttttttttgtagagacaggggtctctgtacatttcccaggctggtcatgtactcctaarctcaagcagtcctcccacstcagcctcccaaagtgccggaattacagtcatgagccaccattcccagcgctggtgactttctccatcactggtgactttctccatcactggtattcactgcattagtgatgacatcattacaatcttcaatatgcaactttgtagtcctactcttgcattcttactttaaagcctcagcattaagtttgaatgtaatattacagcatccttcattactttaaatcattggtttcaatagtaattcatttaaatctaaaatgttaggctgcagtggctcatgcctgtaatccccccagtttgggagactgaggtgggagaatcacttgaggccaagaatttgagaccagcctgggcaacacggcaagaccccatctctaaaaattagtggcccggcgctgtgcctcacgcctgtaatcccaacactttgggaggccgaggcggatagcttgaggtcaggagttcaagatcagcctggccaacatggcggaaacccatttctactaaaaatacaaaaattagctgggcatggtggcacgcctgtaatcccagctattgagaggccgaggcaggcagactgggaggccaaggcaggcagattgctttgagacctgcctgggtaacatggagaaatcctgtctctacagaaaaatacaaaaattagccaagcatggagaaacctcgtctctatagaaagacacaaaaactagccatgcatgcctgtggtccagctactcgaaaggctgagrtgggaggattgcttgatcctgagaggtcaaggctgaagtgagccatggtgtggcactgcactccagccagggtgacagactaaaaccttgtctcaaaataaataaacacatttaaaataaataaatacaattaaaactaaaattaaaaaataaaataaaatgttaagagaatagctcaaattctccaaaagaactcttgcacaccattcctcctcttctcaaatctctattttccttccccaaagccagtaactgcttctcaccctgaccctgtgctttctttcccgtcattgcgaaagaatggtccttgcttctgtgctgatcccaaacccttttgccctcagatcctcctgtccttccctggccctgctctgtattggctgtggggtgggggtggcggtggaactgacccctggsgtctgcatttctcaggctcccagggctgtggctgactttggccaatgggaggcaaggacgggagactgagagcttgggaggaagggagagaggtatgtttcttctccttactccctgcctgggrtggcaccttgggcaggactctgttttgcccatggcctcagctcccaccagatgcctctagtccctgggctcaggaaatagacaacctccttccactatcgctgtagcccaaggagggaagtattttttttctttctttctttctttyyttttttttttttacagagtctcactcttgttgcccaggctggagtgcagtggtgcgatctcagctcactgccacctctgcctcccgggttcaagtgattctyctgcctcagcctccagggtgtgccactatgcccagctaatttttgtatttttggtagagacggggttttgccatgttgaccaggctggtcttgaacttctgaccccaaatgatctgcctgcctcgtcctcccaaagtgctgggattacaggcatgagccactgtgcctggccgaaggaaatattttcttgctattgctaatctctgggttacctcgctatcccccatttagcttcacttctcctccatcacctgtatgaggaattccctctgtgttaaatatctggagaagtttcctgattggaccctggctgttgcagcttccaaggccacctctctttgtggctggtatccttttcccatgcatcttctccaggacttccattctgcagttmtctctctgaactcagtgtcttcttcccatcagtataggggtggactttagtatctcctatgtttaggcaacatctctcctttgactctgcgtcttctccagtggttgcccttctctgctcctcttcacaataacacctcctgaaagggccacccatgcctgccccctcctttcctcaccccctctgtggctggacttctgttcctacactccaccctggttgacaaagtcactgattacttctctattttcagcttacttgatccttaattgccttcaaaaacagctaactgggccatgcatgtaatcccagcacttcgggaggccaaggcaggaggatcacttgagcccaggagttcaggaccagcctgcctgggcaacatagtgagaccctatctacaaaaaatagaaaaattagccgggcgttgtgactcatgcttgtggtcccagctacaaaggaagctgaggtgggaggatggcttgagtccgggagggtgaggctgcagtgagccatgatcacgccactgcactccagcctgcacaacwgaaggaggccctttctgtaaaaaaaaaaatggttgaccactccttccttgaaatgcttttttcttgaggctyccatgccctgccttatcctgtttcttcctacttctctggttgtgctttttcctctgctcagtatttaacatgttggtgtgaccctggctctggcctgggcccccttctctatctacrtgctttctctcgacgacctccatcggttgcatgggtttaactaccaaatctgtgattctagctccgacaccccaggctaaagtagccacctggtcactccctattacattggtcaatttcatttctctgtgccacctatgattttcctgatttatttattcacttttcattgtctgtcttccccactaaaataaaaacttcttgagaaggggcttcatcgatctgcctctgttctatcccaggccctcaaaacaaggaccagatattcaacaaatatttattgaatgcgtacatgaattaaaactctaattggttgtatgctggtggtttattattttcatggaggaaatgacttgtaggctgtgacactcagcttttgtctctgatgctttgttgccctgttctgtcaccgagggctgtcgtcattgctctggccattttgtgctctttgaatttctaatcatcacactcaacccagaaggcagccttacctttcagcactcttcagctgaatgagtgcaagttggaggcagggtcattttttgataggaaattgaatgtttatatgctggtaaatataaagcttagctttttacaaagaatttctcaaaagtgagctttgttgaagccctgtaaattgttagaacttttatggaaattttaatttaggaaaaaatgtcatctgtttgggctgacttagttgttagttgtttgtcctttcttttttttggtggagggtatggagttttgctcttgtaacccaggctggagtgcagtggcgcgatctcggctcactgcaacctccgcctcctgggttcaagcgattctctcacctcagccttccgagtagctgggattacaggcatgcaccaccacacttggctaatttttgtattttaagtagagaccgggtttcactatgttggtcaggctggtttcgaactcctgacctcaagtgatcacccaccttggcctcccaaagtgcttggattacagacatgagccaccacacccggccaagaggacttcttttaaaaatgatttcttgggccgggtgcagtggctcacacctgtaatcccagcactttgggaggctgaggtgggtggttcacaaggtcaggagtttgagatcagcctggccaatatggtgaaactccatctctactaaaaatacaaaaattagccaggcatggtggcgcacccctgttgtcccrgctactygggaggctgaggcaggagaatcacttgaacctgggaggtggaggttgcagtgagccgagatggcaccactgcactccagcctgggcaacagagcaagactctgcctccaaaaataaaaattaaaatgatttcttaagtaaatttcaaatatagaatgtatatgctagtgataacaaaattaacactgtttatgcaagtctgcaataggtagatgtgaagttgataggtgcaataagtataggcaaacacataggaacatttgacctgtttttttgttgattttaaaacattgaataattgggaagcttttaaatctcttaatttgagcaactagatggctgtatttatctccttatattaaaaaaactattataattatctttcccacatatcaaactccactggtttttttcccatttttctttcatacttcagaaagacgagaatccaggacttgaatcgtatcttcccactttctgaggactactctggatcaggcttcggctcyggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaawtttttaaacatctgaaaaagaagcttaagttttatcatccttttttttctcatgaattcttaaaggattatgctttaatgctgttatctatyttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactytgacttggattgtgaattataatgatatgccccttttcttataaaaacaaaaaaaaaaataatgaaacacagtgaatttgtagagtgggggtatttgacatattttacagggtggagtgtactatatactattacctttgaatgtgtttgcagagctagtgkatgtgtttgtctacaagtawgattgctgttamataacaccccaaattaactcccaaattaaaacacagttgtgctgtcaatacctcatactgctttacctttttttcctggatatctgtgtattttcaaatgttactatatattaaagcagaaatataaccaaaggttaagctgtctcggatctgttgttctaaacccaggaaacagttatttttggccagacgtttctccagaagtcttatcaacaaaacaactttaaacgtattctacagtaaacacaagttttgtaaccagaatcaaatcatactaactagcaaatgaagaaagcaatgatgccttagcaagagggttatatatctcaaagcacttcctcacctgaaagatagttccatctctgttccccttagttctgaaaagcccccttacatcaccatcctggattctgttctgtactgtccagatcccagctccagaactgagtacttactcaaattaatctcctcaggagagagccaccttgcccaaggtcatgctgctttgcagggcagcctgcatccagtgactggctgatgtgggcatatcaaggcctgaactcagaatagtcatacagattcaaaactccccacaggatcagctccagttttgctgggactactttgtagctcagtttcttctttactcaattttacttccttccattccgctcataggtttctatcctgagagtgctcccttagaaattttctgctagtttccatctcagaatttgcttctaggagaacacaacttgtgacaggttgtgccaggagggataagaaatggatgctaagatgggattttggagctagattgcctgctgtctggctggcaatgaggactccatccttggccatagatgagcacaggcacaagatagcagtgcaattgttaaaactttcactggtratgaaccaagatggtataccagtggaagggagtgcactagggtgtgatgtactaggcatctgagaaatgttggcaagtagtaataataaagacaatggtattggttggctattgctggacttaattaatgcttttgaaaaagacaaygaaaggctaaggacaattaattaaaagctaaatgtgaaaaccattgggcctccttggcagcatattaagaaactctcttctgtaatagaaggaattaaaaagctgaggaccaggcccaggacttatgagaatagcagatggctgggtgtggtggctcacgcctgcaatcccaacgctttggggggctgaggcaggtggatcacctgaggtcaggagtttgagatcagcctggccaacatggcgaaacactgtctctactaaaaatacaaaaattagccmggtgtggtgacaggcatctataatcccagctactcyggaggctgaagcaggagaattgcttgaacctaggaggttcaaacctgggaggttgcagtgagctgagatcatgtcactgcaatccagcctgggtgacagagggagactctatctcaaaaaaaaaaaaaaaaaaatagcagagttccaagaatattaaattgtcagcttagcccagtctgttatgcaagctcagagtccttactggggaaaaataggaccctgagagatggaaacatctgggctgatacattcaagttttaaatcctcagattcctttgaacctctgaatctacagaagagtcccatgctttaaggaccgatgctggccaggtgtggtggctcatgcttgtaatcccagtactttgggaggctgaggygggcagatcacttgaggtcaggagttcaagaccagcctggccaacacagtgaaaccctgtctctactaaaaatacaaaaattagctggttgtggtggcgagcacctgtaatcctactcggcaggctgaggtatgagaatcacttgaacctgggaggtggagtttgcaatgagccgagatcacgccactgcactccagcctgggtgacagagcgagactctgtctcaaaaaaaaaaaaaaaaaaaaamaaaaaaaaaacagcaatcaaaaaacaaaaaaactagtgctttcctgttgaagacaatcaagaggcctctacccttaaagacaacactcactctccttcaagatctgtccccacctcccttcctagacagcagataaatatcaaagttaagtcagtataaaccaacaggggagttttgggcttgctcaggaggaaaggtaaaatactctgaaagttctgtagaacttagctaacgtggaccttaaaagctaagagggtgtctgtaagacttaactctggaagtccttgatccagggacggagatagaacacaaacttggataagggagtgtttagcaatgtgagtgtaccctcctgggatacaggttttaatgccctggcaagaaccctgggagaaggtgttgagactctgctaaaatgactcttagacacttggagaaagtgacagcccacacttaagtgaagtggaaatactagaattgtcatgccaggcagtggaaaaaggggtcaataggattaaggaaatgcacatgatagaatgaatggactatataagccttgcaaacccaccagatgactgtcttgcaggaaggccaaagcaataaagaatagcctggtgagagcaatcagcacctytgagccatctgcagtrgctytcctytgaaaggcagggctgatgttgttacataactgggcttattaatagcagtgggaataaagggtaccaaaataatagagaccaggtrgtagtgctcaaccatcagaagccaagaggtgcagttaccttttttttttttttttggaaatggagtctcactctgttgcccaggctggagtgcaatggcgagatctcagctcactgcaacctccgcctcctgggttcaagcaattctcctgcctcagcctcctgagtagctgggactacaggcacacgctgccacacctggctaatttttttttttttttttgtattttagtagagatcaccgtgttgcccaggctggtctcgaactcccgagctcaggcaatttgcctgccttggactcccaaagtgctaggattacaggcatgagccaccgcgtccagccaagaagccaagaggtgcagttatcttaatgagcagcaaggtcagagatgtatccaggggagcctcatgggcactgagataggagatggcatctctagaggcaatgtagttgcacagccagcaaaagtattgctcaatctattgtattaagcagggtttgccagagagacagaaccactaggacatatacttagatatatgagaggaggtttattagggcaattggctcatgtgatggtggaggccatctgcaagctggagaaccaaggaagctggtagcrtagctcagtccaagtccaaaggccttggaccagggatccagggatatggcagatcttccgcacctggtctaccaactcacactctaatctcctgacgaaataacttcacagatacacccagaaataatgctttacctcctatctaggtatcccttaatccagtgaagttgacatctaaaattaaccaccacattattcaaccagaaagatcaagatggtcaggaggcatagggcaattgcctcaataaaaaaacactatggtggctgggcgtggtggctcatgcctatagtcccagcactttgggaggccaagatgggcggatcacgagatcaggagttggagaccagcctgaccaacatggtgaaaccccatgtttactaaaaatacaaaaattagccgggtatggtggtacgcgccrggtgtggtggctcacacctgtaatctcagcactttgggagactgaggcaggtggattacaaggtcaggagttcaagaccagcctggccaagatggtgaaaccccgtctctactaaaaatacacaaattagctgggcgtggcggcagggtcctgtaatcccagctactcaggacgctgaggcaagagaatcgcttgaacccgggggacggaggttgcagtgagccgagatcgagccactgcactccagcctgggcgacagagtgagactctgtctcaaaaaaacaaaaacaaaaacaaaacaaaacaaaaaacaaagaacgcaggaatgctggtccccaatgcacctccatttaattcaccagtctgggcctcacaaaaagcaaatggagagtgctagtggactattacaaattcaaccgagtacagagggtccccaacttacaatgatttgacttaatgattctttgactttatgatagtgtgaaagtgacacacattcagtagaaactaaatttcaatttttgaattttgacattttcccaggttagtgatatgtgatgtgatgctctctggcggtgttgggcagcactagcgagcatggtttttcgctttcagtattcaatacattacatgagacattaaaactctttattacaaaataggctttctattagattattttccccaactgtaagctaatgtaagtgttctgagcatacttaaagtaggctaggctaaataaactatgatgtttgatacgttaggtgtatttaatgtgtttttgacttaagatatttttggctgggtgtggtggctcacgcctgtaatctcagcactttgggaggccgaggtaggyggatcacctgaggtcaggagttcgagaccagcctggccaatatgaaaccttgtctctactaaaaatagaaaaactagctgggtgcggtggtgcacacctgtaatcccagctactccggaggctgagataggagaattgcttgaacctgggaggcggaggttgcagtgagcgaagactgcgccactgcactctagcctgggagacagagtgagactcagactcaaaaataaataaataaataaataaataaatattttcaatttatgatgggtttattgggatgtaaccccactgtaagttgaggtgcatctgtagtagctctattgaagcagcatccccaggtggaacacttttgctagagcagagttacatagctttagatacctaatagtcatttatttgacaaatgctttcttttatatccctatcaaaaaaagaggataaggctgggcacagtggctcatgcctataatyccagcactttaggaggctgaggtgggagaatcacttgaacccaggagttcgagaccagcctgggaaatatagcgagacctcatctctccattttttaaaagaggatcagaggccaggcgcagtggctcatgcctgtaatcctagcattgggaggccaaggtggatggatggcttgagctcaagagttcaagaccaacctgggcaacayggkgaaactctgtctctacaaaaaatacaaaaattagccagttgtagtggcatgcgcctgtagtcccagctactcaggcagatgagrtggaaggttggcttgagcctgggaggtagaggttgcagtgacctgagattgcgccactgcactccagcctgggcaacagagccagaccctgtcaaaaaaaaaaagaaaagaaaagaaaaaagaggatcagaaagagtttacgtactcttggaacagacggcagtatatttacagtctattcccaggactattttaactctcccactctttgtcatagtaccatctaaagagacctgaactggctggacatctcacagaaaatcacagtggtcactgaccagacccccatgtcattgccactgatgcaccagcatttcttcctgggctcacatctatgactgtatgagggcttcctaatgaccaactgccaggataggaataaactccagcttggttcacacatggattggtctggtatatgggagcaagccaaaagtggatgtcagctacactacaatgccattcaggagtggacttgaaaagcagctttgaggggaaatcctcccagtgagcaggagcaytgggtggtgctcctggycatccactctgtgtagagagagaagtagcctgaggttggaagatactcatttgcatggactgtggtgactgttttgcccagttgataaggggtctaaaacagaaagattggaagattgggcacgaagcagctcagggtaaaggcatgtggatggaccaatgagagaagacaaagtgtgaagatgtacgtatc

SEQ ID NO: 13373 - DNA, 24054 bp, Homo sapiens
  misc_feature (1)...(24054): n = A,T,C or G, or insertion/deletion polymorphism (see Tables 1-2)
ccaggctggtcttgaactcctgagctcaagtgatccacccaccttagcctcccacagacctattattttttcagaaatagggtctcatgggtcaggcacagtggctcacgcctgtaatcccaacactttgggaggccgaggcgggtagatcatgaggtcaggagtttaagaccagcctagccaatatggtgaaaccccgtctctactaaaaatacaaaaaaaaaaaaattagccaggcatgttggcggttgcctgtagtcannnnnnnnnnnnnnnnnnnncaggcatgttggcggttgcctgtagtcacagctgctcaggaggctgaggcaggagaattgcttgaacctgggaggtgaaggttgcagtgagacgagatcgcaccactacacttacagagcgagactctgtctcacaaaaaaaaaaaaaggaaaagaaatagggtctcactctgtcacctgggctggagtacagtggcatgatcttagctcactacagcctcaacctcccaggttcaagtgatcctcccacctcatcctgctgagtagctgagactacagcacacgccgccacacctggctaatttttaaatttttttgtagagacaggatctccctatgttgctcaggctggtctcaaactcctgagctcaagtgatcctcctgcctcagcctcccaaagtggtggggttacaggtgtgagtcactgcacctggcccatccttcaggtctctcgaaggtaaggctagagctagtgtcatctgctctctaccctgaccctatctctcctctgcagcctgtgcctgtgacccacagggctccatcttgcccagctgtgattcacacatgggcacctgcttcttcagagagggcatcttagggctgaggtgccaggcatgtgctcatggctccagaggtgccttcccacactgcacctcctgtcccacctgcttcaccttctgagaccaactcctggctctgctcccactgcagctggaagctgtggcccaagaggtggccaccctatgctaggggatgcctggtgggggtgttaggggccagggtggacacctgcaggtcctagattgggtactgtagcaggcacaggctgctccctccaacctgggaccctgcccactgttcagtgggctcttgttgccttccacaactcctcccatagcctggacatagagtcacagccttggagcagcatcaacaacaggtacacagccagggggactgtgggtgggagccatgggggagtcacaggaaaccatggcttggacatggtgttgtaggcaacatattccacatctgacccacgcccaccagctgcagcaaatccaggccatagcaagctccacaggaatccaggcacaggagacatggtattgggaaaggggaccttggggcatgactgccatgacccacatgcaagcagccgtgcagatcatccagcgcttcctcatgggtacatatctgcttgwtgcatgtctgttcacagccaagggcagggttaatagggtatgcaggacactatcatgatactccttccagaatgaggaatattcatcagggctgaccaggggtcaagtgggaacactagtgtgtgcgtaaattttttttttttttttgagagggagtcttgctctgtcacccaggctggagtgcagtggtgcaatctcggctcactgcaacctgcgccccccgggttcaagcgattctcccacctcagcctcccaagtagctgggattacaggcacactgtaatttttttttgtatttttagtagagacggggtttcaccatcttggccaggctggtcttgaactcctgacctcatgatccacccgccttcgcctcccaaagtgctgggattacaggcgtgagccaccgcatctggccatgtgtgtagataaatttttaacaactggctgtgagtcaggggaaactgatttttagcatttgtcaatatccatgatgtaagtaatgctatcatgattgatttcagtccataccatttgacaacttatttgcaaaattcctgaaaatttaacaattggctctttttattttagtattattattattatttttgagagggagagtctcgctctgtcacccaggctggagtgcagtggcgtgatctcgggctcaccacaaccgccacctcctgggttcaagcgattctcctgcctcagccttctgagtagctgggattacaggcacccgccaccacatccagmtaatttttgttatttttagtagagatgagttttcactacattggccaggctggtctcaaactcctgaccttgtaatctgcctgccttggcctcccaaagtgctgggattaccctttttttattatcattttattttttattttttttagagacagagtctcgctctgtcacccaggctagagtgcagtggtgtgatcttggctcactgcaagctccgcctcccgggttcaagcaattctcctgcctcagcctcctgagtagctgggagtacaggcacatgccaccatgcctggctaattttttgtattttagtagagatgggttttcaccgtgttgctcaggctggtctsgaactcctgagctcaggcaatctgcctgcttcggcctcccaaagtgctgggattacaggcgtgagccactgcgcccggccaacaattgcctcttgtaagcctccagcacaccactggatagttgtgtctaaggcaggatcagtgagaggctagggtcagggtttgttggctcagagttcagggttcaggcctaagatccctaccctcttccccacagacaaaggtgtggacaccacaagtgtggagctggctgtcagtgccccttccccaaggtgggggcagtaggcattgctcttctgctgggtcagatccagggtgctctccctgtaccggatgccatgggccagaagctgcccaaagctgaaggcatcctccatcaggcagagtgaaccaggtgaagggccaggaggctggaggtggaagtcagagggtggccagaaaagggatgcctaactgaacacctgtgttcttcaaggagggtacaacctgggcccagcaccaagcactggatgttcagggggtgctggctgaggggggaatggaactcatgcaggggccgcagagcaagggctacaggaagtgaagctggcacttgaaggcctggagggcactgtacaggaggtgataccctacttgtaccctcagctcctttacatcccttgttcaatgactgctgtgatttccattctccctgagatccttgactcactatgataccacagtgctaccaagtaccttgaccgtgataacactcagcctagttgctactgtgctgtgtcctctctgtgaccccctaacctttgccccaggtagtagggcgcctggcccagatggcactggcagttgaggtgaccccagtcccagggcgtctgtccagtgtagctaaggtgctcagggcatgttttgtcctgagtcagcagcaggcccaggaggcagaagaatgggcagcatgagtcgtaggcagggctgagggcctgggcaagatgaaatggggaagagtgggcactggggtctcagggacccctctggaacagtggaaagtggggtttgggctggggctgggctatactggactgaggcgggatctcagttctaaattctccttttctccaggaaccttaggcagtaatatatttgaggcaatatattctgggtggggtggggattcaggtccagccctgccctaggagttgtaggtggcccctttggctgtggccgagctgcaggaggacacatatggcctggtagccactgtgcaggatgcaaaagaatgggtgcagcaggcttgagctgaggcccaggagctcctgaagaaggcataaagcagcttcagctgcctgcatggtgcatggctggcctgcaatagggcaggcacagggaacggcttagggtcagatggaaaggtcagggccagaatagggatgttgtggaagggttaaggctgggtccagatcagatcttgactcatgtagggatcagggctagggtcaaggtttagaccagggatcaagtgttgattaggttcagggtttatttaaggttagggctgggtcagggtcagggttgtgatagagactgggaccaggatcagaggttagagccaggggtcagagcctggctcagatgacctgaccccagggttggagtgccgcctgacacagaatgcacaggcactgggcaagaaggcagccaccctgcaggccctggagcagcaggcagctgagctgcttgggcacatgatgtgctttgccaccaataagtatgccacctgctaattactgtctatggaagccattaagaaggactgtgggatcacctgggtaactcaaagtggccctagagtgatccaggaatctcctggccttgggagaccaaagatcctactgagtgcccactgaccctgagtgacccccccatgtggccccacgatgtcccccagtggccctctgaccttgagaaagcagacagatcatgtaactccctgaggccatctagtgtcccagaccttgatacacctttatctctgagtgatctaaaactgtgagactacagtgctggcattctccactcaaaataaatagatggggcctggcactatttactggctcatgcctgtaatcccagcgctttcggaggcagaggcgggaggatcacctgagatcaggagttcaagaccagccaagccaacatggtgaaaccccatgtctactaaaaatagaaacattagctgggcgtggtggtgggcgcctgtaatcctagctacttgggaagctgaggcaggagaatcgcttgaacctgggaggcagaggttgcagtaagcggagatctcgccactgcactccagcctgggtgacagagcgacactctgtctcaaaaaaaaaaaaaaaattaaaattctcagtaatttctagtatccctgatcccccaggttgactacatgatcctcagggtgactggagacctctactccggatatccagaataactcccagcgatgcctaaagtccaacggattgactgacccccacccaaccctcacccaacccccacccccgccgcccccatgctcctttgtgaagtggggtgattcccctgaggaactatcatcagctttcttccctggatggcagctcagggcactccctgccgggactgtggaggcggcaggccagacccagccctaaagaccggaggaccccatgtttcccccagcttcccgttcccagggccctgggtggggcgcgccccatatcccccacccactttcctccttctctccccctccacgccgccgcgcacattccaaccccaggctcctgcgatcccggcaggccaaaaagtctggagcggataaatagccacaagatccggagtcgctcgccgtagctctggtccaccacccagagcctatttccatacagggaaacccgcagcacttctcgtgcctacttaccgtagtgactagtgggggaggcagtgacccccctggagctgtgcttcgggctgggtgtgcactttccccatctctcccccagccccattctgtccagtccctaggactacccgagagccccccacagccctgaataggggcatgtgttgctcctgcttgtgccctccagcctctctgttgatgctggagccctgggatcaaacggctgagttgatggtaatttccacggcgcccatgacgctgaggggaaaaggctacggtctccttggtccagagttggagatcccgaagatctctcatttgctcctgccatgcccccaacttcgtgagccctcttccaaggatagtttaaagcaccaaaccccttaccttcccctggccctcgtataggtgtgggcttgggggcacaataaagatttgtgggtgaagtggtctgtctctggttcctggggcgaaggcagtttccggagggaaggggtagggttggggtgggggcgctctccgcccggtgttgcgctccttcccagaatccgctccggcctttccttcctgccgcgattcccaactttgctcaaagtcgctggactctaagctgtcggagggaccgctggacagacctgggawctgacagagggcctggwgggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcggtgagagggcctggtgggggctgggggttgtggaatgtgatggtaggtcctggtagttgcccttggggcacatgaggtggagccactggataggaactcagcggaactgactgagctactgtccccagtgctggctgccacactggcacaggcccctgccccggatgtscctggctgttccaggggaagctgctaccccgccacgggcgacctgctggtgggccgagctgacagactgactgcctcatccacttgtggcctgaatggccsccagccctactgcatcgtcagtcacctgcaggtgtggctggggacagggtgtgacgccgagtcagggtggggctggcactgcctgaggcactgattctaatccccatccaacccaggacgaaaagaagtgcttcctttgtgactcccggcgccccttctctgctagagacaacccacacasccatcgcatccagaatgtagtcaccagctttgcaccacagcggcgggcagcctggtggcagtcagagaatggtgaggccatgggtggggcaaaagtgagcagggctgcccaccagtagctttgagtccttgacttccgattcctgtcccaggtatccctgcggtcaccatccasctggacctggaggctgagtttcatttcacacacctcattatgaccttcaaggtgcctgcatatctgggagcctgcccgaatcaccctgcttggctctccattgcccctggacagagcctcagctccttaacacagcctccttgagcatggatgcaggaggctccttcatcccttcacaccttccatttgcctccaggcctttgcacatgctcttctgcctttccaatcccaggctgggtcaggcgctgtctccctgagccccatgaaccctgagtctccccattagaggtggctacctttgctggtcattatctggcttccaccagtcacccccactctctgtgagctatttgagggcagtcttgggctgagcagggctcttgatggctctgggttgggcttgggtcctggtgcctgctgatcagctatgcccccctacccagacatttcgccctgctgccatgctggtsgaacgctcagcagactttggccgcacctggcatgtgtaccgatatttctcctatsactgtggggctgacttcccaggagtcccactagcacccccacggcactgggatgatgtagtctgtgagtcccgctactcagagattgagccatccactgaaggcgaggtgagggctggcatctgggctgggggctggaagctggggatgatgggcctgaggcaaggtccagtgtgactatgaactccctgcttctccaggtcatctatcgtgtgctggaccctgccatccctatcccagacccctacagctcacggattcagagtgagtgctccaccctttgagtctggcacagtccgtgtccggctagggactatttggggcctcagtaactattttgggtgcttcctarggcaggtgccaagcccagtttagctcgggtggcagtgtataggaggtctttcaaggtgaccttggcagctgagcccctgggtggacatggggcagcaagggcctgcctggtcagttggccccccttcccccgcctcagacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtaagrggcttcagacggttgggatagggctaggggcaggggcggacatggctgagcagtgctgacaacctacctgccaacctctataggtgcacggagcttgcatctgcaaacacaacacacgtggcctcaactgcgagcagtgtcaggatttctatcgtgacctgccctggcgtccggctgaggacggccatagtcatgcctgtaggagtgagtgagatcttggcctccatagctccagcactctgcagcctggctgtgccctgggtagaacctagagctagttggtcaagcccctaaaacccaggctgtatccaaagagtatgcagaccttgatgccccttgggaccccctcaatcctcctctgcagtctgctctgggtagggaaccagtatgatgctgaggccttgaagtccctgagcccctacccacaaattctggcctgtgatagggatctaaggtggcctacttcttacccttgtgacctggttcctcatgtggcctttgccctgcccttcctcccctgccagagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctgtgaggctgggattgggcacggggagagaaagctgagcctggggcaggaactagagagctggactgctgtctaaattgcaggaaattggggttaggggcttggratagaacttgaccagggatccagggtgggatcccttaggcttaggagaggactggcagtgagctagttgagatagggtgagtgaccctgtatctctttttgccgtcagcctgtgattgtgaccccatgggttctcaagacggtggtcgctgtgattcccatgatgaccctgcactgggactggtctccggccagtgtcgctgcaaagaacaygtggtgggcactcgctgccagcaatgccgtgatggcttctttgggctcagcatcagtgaccgtctgggctgccggcgtatgtgtctcctgccctaacttctatgctgacctttaacccctgtcctcttactcctgactcagctgaacatgagcactgccacagtttcccaaagtgctgatggttctccttccctgcaggatgtcaatgtaatgcacggggcacagtgcctgggagcactccttgtgaccccaacagtggatcctgttactgcaaacgtctagtgactggacgtggatgtgaccgctgcctggtgcgactggaaggggctggagttctaggggcatgatttgtccttagagcacagggctggggtgtcacatctatgccagtgggtgggtgctgagagcttaggatccagtcctggctgagaagcctcaggtctgggaggccaaggatgtgggccagtggtctggggggcatgttttcactgaggggtgattgaggctaagacgtgtggttgggatttcctgctgggtggtgatggggtctggaggtctgtttctggcccccagcaactcctttcgtgcagcctggccactggggcctgagccacgacctgctcggctgcygcccctgtgactgcgacgtgggtggtgctttggatccccagtaagtgttgtaaagggggcctgggaagggatggggaaagatcctgagcagaagagaaggttcttcttgagtaaccacagagttccctccaggtgtgatgagggcacaggtcaatgccactgccgccagcacatggttgggcgacgctgtgagcaggtgcaacctggctacttccggcccttcctggaccacctaatttgggaggctgaggacacccragggcaggtgtggggcctccccctaagcagagggctggatgtgggtggacacgtctatgactggagaggtggggttatgggcagtaccttgttgaggggataggggtgatatctagctttggcaggagaaatggggtttggggctggctgtggcagaagaggcaaagcctcacctgagcctccatccctggctgcattatctcccaggtgctcgatgtggtggagcgcctggtgaccccyggggaaactccatcctggactggctcaggcttcgtgcgrctacaggaaggtcagaccctggagttcctggtggcctctgtgccgaasgckatggactatgacctgctgctgcgcttagagccccaggttagaccctgttatctaatctggrgctgaacctctgggtgtgggagcatctcctccatcatcccgttttcccaggtccctgagcaatgggcagagttggaactgattgtgcagcgtccagggcctgtgcctgcccacagcctgtgtgggcatttggtgcccarggatgatcgcatccaagggactctgcaaccacatgccaggtgagggcactggtggtagcactcacaatggcagggggttgtggggccagccctaagctccctgcagggcacctggaagaccccacagctcattcatctgttccttctttcaaatacctccagaatgctggttgccaggccctgttgggcatggctctgttcacagaaaggaagtagacagatcaaggcctgctctctcaggggtctaaggcccagaggccaaggcaggaattaatgggaaatcacctggtgtcactatcaggagggtccacagtggtggtggtagagggtggtagtggtggggttgtggcatcagagcactctgagcagggatgtgcctggtctgattaatgttttattacattttgggtagtatttgtttcatgtttcatgtttcttttttttttcttttcttttcyttttttttttttttttttttgagacggagtctcgctctgtcaccaggctggagtgcagtggtgcgatctcggctcactgtaatctcccacctcccgggttcaagcaattctcatgtgtcagcatcccgagtagctgggactacaggtgcacgccaccacgcccagctakttttttgtatttttagtagagatggggtttcaccatgttggccaggatggcctcgatcttctgaccttgtgatctgcccgccttggcctcccaaagtgttgggattacaggtgtgagccaccgtgcccagccctgtttcattgtttcatgttttgtttgtttgtttgtttgtttttgagatggagtcttgctctgtcgcccaggctggagtgcactggcgcgatctcggctcactgcaagctccacctcccaggttcacgccattctcctgcctcagcctcccaagtagctgggaccacaggcacccgccaccatgccttgctaattttttgtatttttagtagagacggggtttcaccatgttagccaggatggtctcgatctcctgaccttgtgatccacctttctcggcctcccaaagtgctgggattacaggcgtgaaccactgcacttgacctattgcttttagtttttgaccatgtaaatattcaaacagaaggaaagagaataacatattgaacctggctgtgcccattatagacattttgccaactgtgacttgtgtttagaaaaaaaattcctctagaccaggcatggtggctcatgcctgtaatcccagcactttgggacactgaggcaggaggatcacttgagcccaggaattcaagaccagcctaggcaacatggcgagaccctgtctctacaaaaaataaaataattagctaagcatggtggtgtgtgcttgtggttccagctgcttgggaggctgaggtgggaggatatcttgaacccaggaggtcaaggctgcagtgagccaaggtcacgcactgtactccatccatcctgggcaacagagmccgcatctcaaataaacaaataaataaataaatcagaaaataaaaagaaaaaagatgagggattgaagaacaatttttgggatgggataaaagaacccaagtatgagtttgcagcacaatgggaaaggaaagccttggagacaaagagagagggggcgacatagtgttgatgaagaggagcagccattgtaggttgtaggtcggggtcagaggaagcgtgaggtggttgttgaggagaattggcaagttcttgggatttccaggctttatgagtatttccagtgagtctgcacaggtggatgtatgattctagagggccacctttatgagactattctgtgcagattctttgttgggctgcccagctgtttgttggcctagcgcagcccaacgcaacccagccatagtctctgctttggccaatggcctggttgctgggagaaggatgggggaggcccagatgatttgtacagggcccctagatgacccactgcacctgtccccactcgcccccaggtacttgatatttcctaatcctgtctgccttgagcctggtatctcctacaagctgcatctgaagctggtacggacagggggaagtgcccagcctgagactccctactctggacctggcctgctcattgactcggtgaataatctcctcttgcccacaccaaccaagatggcagggcccgtggtgtgggacttgagggatagcaggggtctgtggcagaagaggcaggcccatggtggtgccagggtgggcaggcttgtggcagtgctaaggcaagtgctctggcaatgcctacgtggtcccaggtctgaactgcgatcttccttgctcactccttcagctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgcgtgagtgtctgtgatgtgggttgatggggcagaggtggggacccagcctgacttggcccaaccctcctccccacagcatgtcagtgcaaccctcaaggttcactgagttctgagtgcaaccctcatggtggtcagtgcctgtgcaagcctggagtggttgggcgccgctgtgacckctgtgcccctggctactatggctttggccccacaggctgtcaaggtactcttctgccccttgttccctcctatgcttctctctccttcccattactgttctctctcctccttctggacctgctgctggtttcctcaaactaagtcttggaccctctactctcaacctgggtcagttgtagttctcttccatttcctgaccttcccacctagactcccactactcacactcccctgagaccctcccccacccacactcccctcagaccccctcccctggctctggctcagctctgccttgctcctagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcwcacagggggtgagcactgtgaaaggtgagactggagcagctatgagtgggttggttggtgggcaggcttcccagggatgacacatttcttcttcctcctccctgcaggtgcattgctggtttccacrgggacccacggctgccatatgggggccagtgccggccctgtccctgtcctgaaggccctgggagccaacggcactttgctacttcttgccaccaggatgaatattcccagcagattgtgtgccactgccgggcaggctatacgggtgagtggatgggggcaggcrtgggatcagggtgagttggctgggctgagcactcacagcttcctcttaaccgtgggcagggctgcgatgtgaagcttgtgcccctgggcastttggggacccatcaaggccaggtggccggtgccaactgtgtragtgcagtgggaacattgacccaatggatcctgatgcctgtgacccmcacacggggcaatgcctgcgctgtttacaccacacagagggtccacactgtgcccactgcaagcctggcttccatgggcaggctgcccgacagagctgtcaccgtgagtatgagtgtgggagggcatggctgaattggggttctgcttcttggcctcctcttgactactgtgctcatcttggttggcacaggctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccwcccaagccgggccagaggccccacctgcaacgaggtatgggaccctcctgcagatccctggttagatggggccaggtgtctgtcttatctccagggcttagcctctkatagaggctctgaccctgccttgttcccaccccagttcacagggcagtgccactgccgtgccggctttggagggcggacttgttctgagtgccargagctccactggggagaccctgggttgcagtgccatggtgagggagccagcggggccagggtagatggaggacttcccagaatgccccacagtgaccctaactctgtgctctgctctttcttgcagcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcrcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggtgcggaagggcctaagaatacatggtgggatggggcagaggcccagtggaccagggctgaagcctctctaaacacccccctctccatcattgcaggcgtgaaattggggaggccactgagcacctgactcagctcgaggcagacctgacagatgtkcaagatgagaacttcaatgccaaccatgcactaagtggtctggagcgagataggcttgcacttaatctcacactgcggcagctcgaccagcatcttgacttgctcaaacattcaaacttcctgggtgagttgttagccaactaggcaggtggaccagggtcagtcttcagctgactgtctgcctctgcccaatttaggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgaggttgaagtgttgggtggggcaggtgggtgtagatgttcctctcacagggccctgacttgttctgtgcctggcaggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcawctcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggygcgattgcagagcgagtccggagcctggcagatgtggatgcgatcctggcacgtactgtaggagatgtgcgtcgtgccgagcagctactgcaggatgcacggygggcaaggtctgaccccatccctggcccctatccctgacacctggttttgatacctccaggttctgattcccccttctccccaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtgaggtcttcctaggacatcagtgggacaaggttatgggcatgaaccgtagatctgtgtaacctttggctcacccatggcaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcaggtgggttgaggcagagccagctggagaaggtaggggtggaagatgggcctccactgagctaccacgctaacctaaccctctacatctgcagctgctacgcggtcctctgggtgatcagtaccagacggtgaaggccctagctgagcgcaaggcccaaggtgtgctggctgcacaggcaagggcagaacaactgcgggatgaggctcggracctgttgcaagccgctcaggacaagctgcagcggctacagggtaagaaatggggcaccagagacacaagactgcgggaaaccccccctaaactgacacctgcccttcctagaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccactgtgttgtctggactctgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggtgagtggagcaggctgcaactcgctggcttggccgcagcggggaggccgcaacgcgcggccgcggcggcctgttcaaggtcacgggccgtgccagtccctacccctagtgccccgcagcgtgccagcccactgatgccggcagggccgttacgctatgcctgtggccagcctcccacctgggagaggactggcggccagcgagggcaacttcgtgggagaggtggtggcgggctcggggttcagaggctgaagctgggtcgcagctcgaccggggcgctgatctgtggtcagtaaccccgcgctgccatttcaggccggctcgggtctctaaacagccccttacccgcctcgacgtccctggggcatgggggagggacgcgaccttcggctggggcctgggtgcaagaaggaggcgycggtggcaggtgtcattaaagatccagcccaccagtaccacatctgacctgtagaagggtatcctgccatccctccttcctcctttacacacttaggggaacacagactagtcattatctgtcctgctactggttcaggccaggcttgaggctgccaggagtcctggatctgtggtcctccccagcctcatctcagtatctagtttcaagaccttcattttggaggaggaaacagtccagaatccactggtgggtctgtgggaaactgtagtggtccttgtggctcagagctcatgagtgaaggcatctgggaaggaaggtgataatttctgttccagtctcaaactggatgcccatcctgccttagtactggagcagggttgctgctgaagaggtagcgtgacatctagatacacttttcagtccctttctgcttgggacagcagctggggaraggactttctcttgaaatgaagaaggaccaagcagtacataggagcaggttcttgccaagggtgggagctggcaggaggcaggtggagtgccttagccccaggactttttctgggcaatggtagaacctgggttgagcctgtttacagccacagagcctggttctcctgcggcttgtctcctgtcctgccttcctcctccaccttctatttctccagtggtgactaagcagccagtgagagtgaaggaaaagtgagcaccctgctcggagtgccagccctgtgggctggagccgtggctcctctccagattggtggagtagcctggtcccaggccatgacttccttgacctggtgccccctcagtgaggctttcacctgtgtgggactgttatkgtgggtatctatgaggcttggccagaagtggttgctgctacttgcattatttattacctcttcagaatatcctgagagtgtccaggggtacttaagagatgagaagatacagctctgtagcattagtgtcctgtgttgctgagccctgggtgtagctaaagagcaagttgttgggtcttggcagtgatcactggcttctttccattaggctgtccgttccttgctggagaatttggccacaaagagytgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaagsatggagatcctaggaaaggtgggagtggcattcccagagtaattgtggccttctctgcctcccatcttattggtatacagattggggtttgggagatgactttcttgttcttctctctgtcctggtttgatgatgagagaagaaggacccatgataacctcagtagagcctcagctttgaagcctgagtacttggctaagatccagaagatggtgctgttggggggcttgccttctttcctttttaaacttttttcttttttttgaacctgttctttttttccttttttttttgagatggagtctcattctgtagcccaggctggagtgcagtggtgcaatattggctcactgcaacgtccacctcctggttcaggtgattgtcctgcctcagcctcccaagtagctgggattacaggtgcatgccaccacgcaaggctaattttttttttttttttgagacaatgtctcactctgtcatccaggctagagtgtagtggcrtcttggctcactgcgggctctgcctcccgggttcaagtgattctgctgcctcagcctcccaagtagcctcagcctcccaagtagctgggattacaggtatgcaccaccacactcagctaatttttgtatttttagtagagacggggtttcaccatgttggccagactggtcacaaactcctgacctcaggtgatccacccacctcggcctctcaaagtgctgggattgcaggcgtgaaccaccgtgcctgtcccttttttttttttttttttaaaggcagggtctcactcttgcacagattggagtgcagtgcaggtgtgatcgtagcttactgcatcctcaaagtcctgggctcaagcagtcctcctacctcagcctcctcaccatgcttgactaatttttcttattttttttttagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggtcagtaacgaatgggctttttgttgctagggaaggggagggggcacttgcaatttggctcccatctgaagcagtttcattaggctgggtctctgttacctgcttatcaccatcaggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtgtgtccatctgccctgagcacagtagtatgtttgaatcttctgatatctcctatcctacctcatggaccctgctctgtccccaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggtgagttctagtagtacagggttgggtagggataccagtgtagtcgacagggcctgactgctgtatctttggcagaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggtgagagctgggcacctgtttgggtgttaggagatggggggaaagggtgtgcactggagtgggagccacctggcagacccagggctgattctttccacaatcttgccattaataggttgaggctgatgaacagctttgcataccaccgctgaactcccaaacctgyctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatggtaaaggtgggggtgggcaggcagagccctaggttgggttgcaaagtttgtaggtggatagagagtagcaataggctggaacctgtcctggttggggctgagccatggtctcaatatagagcccgagtcgatggtgaacctggcgtttgtcaagaatgactcgtatgagaagggcccggattcmgtggtggtgcacgtgtacgtgaaggagatctgcagggacacctcaagagtacttttccgtgagcaggacttcacgctcatcttccagaccaggtgggtgggtagatgatggggcaaacaatgcctcaggtgggacagtatgtctcatgctcttcctcttgtccttcctcctatcctgctgtgcctctgcagggatggaaacttcctgaggctgcacccgggctgtgggccccacaccaccttccgttggcaggtgaagctcaggtgggtggtgcccggccccaccactgtgcctgtcctaccccgtgggctccatctccctggctcatctatcctgatgctcattcctcctaagtccctgagttcagccttttcccacaggaatctgattgagccagagcagtgcaccttctgtttcacggcttctcgcatcgacatctgccttcgtaagaggcagagtcagcgctgggggggcctggaggccccggctgcacgaggtctgcacacgagctcccttcattgcccagttccacgtgaccaggacccaaacccctgtcacatgctgctaaccaccagccctctcattccccctttttaaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcggtgagaattctggggtgggaaggacgaagaatggaggctggagagtcttggggctgttctctcatgtcgtctttgctcctgcagcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatggtgagggcagggcctggagcctgggttatgggcagagagagtgcctttgttcctcacacctttgctcggctactattcctagaccgctcctttgaggctgagatcaactacaacaacccactagggactggtgggcgtctggccattggctttgccgtgctgcttcgggcgctgtggaagggcacccaccatgccttccagccttccaagttgaaggtgatctgtgaccactgtcacccttggctggagggggcggggagggccagccagctgggtgtgcagtgggtgctagggcttcatgttcacaccttggctcctgtatccaggcc

SEQ ID NO: 13374 - DNA, 66916 bp, Homo sapiens
  misc_feature (1)...(66916): n = A,T,C or G, or insertion/deletion polymorphism (see Tables 1-2)
aattatgtaaagtggttagaaatgggctagtgcatagtaaacaatgcagaaatagtacctgctatttttttaaactttttttcaaggacccgttgctttgctttgatttgccttccacttacccatttattcatttttttgagatagagtctcgctctgttgcccaggctggaatgcagtggcacaatcttagctcactgcaaccttygcctcctgggttcaagtgattctcctgcctcagcttcccgagtagctgggattacaggcacctgccaccaggcccggctaatttttgtatttttagtacagacagggtttcaccctgttggccaggctggtctcaaactcctgacttcaagtgatctgcccgcctcggcctcccaaagtgttgggattacaggcgagagccaccgcacccgactacccatttattcttgatcgttcaggttttcaagatctttatgttttcaacggccggtgtgtattgagaaaggctgagcaattctgttccagggagggaagtkctgaragagagggatgggggaggaactggagctggagagctgaagctgcagcagtggtgacttcragagagtcactgtgtaacctctggcaagggggaaggagtggacaggaagaaagttcttgtctggttccttgcaccctcagccccagcctcctccttcatatcccttctctctcccccacatcgtctcccacacggccccagagggatcttcctccacccagaactgaccctactcacagccttctagggctcccaccacccccagataaagtcccaactcctgtactcagccctgccagatccagcccttgacaccactgcagcctcatgtcctgcctttccttacacactaacttctccagcctgacctcsgcccatgggctgtccctgggctgtggcactggagaggctctgctttgagcagctcgagagagtgagggagctagacatgacggctccaagatatcgttcctgaaccggctcatcaaccacctgctcccgcactccccattcagagaccatctcatcatctacccagtcccaggagtgtacccagggccctgtcctcgccccctccatagtcctgtctctcctgctccttggctgtctctgatatttgtagagcacttgggacagtacctgcacatagtaaacctagtgtgtctgttagctcacatactatacatacataaacatatcaacaaaattcttcaaggttctgcttactggttacctcttccaggaagccttccagaaccacccagtaagctttcaggtggagctgaccactccctttgtatcctcctctcatctccccctcaatctcactctcactactatgggccactatctataatttttttttgttttttggtctttgtctaccccattaagttctgaactgttcaagagccgagatcagtctyggattctaaacgtccagtgaagggcatgcacatagtaggtgctcaataagcatttgttacattggaactgggttctgttaataggtttcagattaggcctgagcttctttgagcttcttgcaagctctaacgttctaggtttctgggtgatgtrtgtgtttgatgctgttccactttcagatctccgagtctctgtttctagaataagtagtgagaaagaagttgcaagaatgtatttcacaatacatgtttaaataactaccggtgaaagagctgttaagagtgtgcttactctgtgctggatgcctttctgaataatttacctatgagatagacactattatgtctcccattttccacatgaggaaactgaggccacagaaaggtgaagtcactcactcaacagcatccaccaagcatcagcagcrcaatggcccagagtccatgctctcgaatcctgtaacagctatcacttaaccagccaccccatgttccaggcaccagggttatgtgtttttctcatgtatgatctcacagtatcctcacaatggccccatgaggcgggtatcgtgataaccccatttcaaaggatgagaaaactgaggcttggagatgtgaagtccattgcccaaagtcacccatccaggaagtcgtggagcatgtctcaggcagcctaaaggcagagcctgtgttcttaagcactctgttcttgtctacagctccccaaccaagggtctcaaactcacacacctactgggaccaggcaggcaaaacaagcaaaagacagtgctagggatgaggcagcagagagtggcagggtttggggcaaacctgggcagcaaagccccatccaagaggggtggccgtctgccaatggaaacatgggctcacctcttccggtgttccagtggaagctggaaacctaactgtgtggggaacaacccctgtttaaaactggggtcagaccaggcaccgtggctcacacctgtaatcccagcactttgggaggccaaggcaggcagatcacctgaggtcgggagttcaagaccagcctggccaacatggtgaaaccctaaaaatacaaaaattagctgggcatggtggcgcatgcctgtaatcccagctactggggaggctaaggcaggagaattgcttgagcccaggaggctgaggttgcagtgagtggagattgtgccactgcactccagtgtggatggcagagcaagactccgtctcaaataaaataaaataaaataaagtaaaataaaattggggtcaatttggctgggtgtggtggctcatgcctgtaatcccagcattctgggaggccraggtgggcagatcacctcagcctccttgaggtcaggagttcgagaccagcctggccaacatggtgacaccccatctctactacaaatacaaaaattaggtgggcatagtggcacacacctgtagtcccagctacttgggaggctgaggtgggggaatctcttgaacccaggagttggaggttgcagggagccaagatcgcactactgctctccagcctgggcaacagagtaagaccctgtctcaaaaaaataaagactaaataaaatacaattggggtccattaaaatacccctggccacctgggtgtgattctggctctcctggatttctcacctgcccctctttgcacagttgtagggaactacctgtgagcttgttcttttaacgtcaatctttctgtccagtcagaaagtaccagaagggcagggatttttgtctcttgcccaactccatcgctccaactagaatatccccagcccacagcatgggacctggccccttattcactgaatagatggatccttttctttatcctgcggcttctctgcagttcagtctccyagtctctgtctcccagtctttgtcacgtgtacaaaacctggctcttctgtttccctggctgtctctggtgtctctgcctccatgtctccatgtttctggaattttccgtgactattttctcctcttggggtgtgtgtgttttacgctctgcctctcgaagtctctattacattctgtaagtcaggccgggcacagtggctcgcggctgtaatcccagcactttgggaggcaagacgggcagatcacctgaggtcatgagtttgagaccagcctggccaacatggtgaaaccccatctctacaaaaatccaaaaattggccaggcgtggtggcgcgtgcctgtaatcccagctactcaggaggttgaggcaggagaaacaacgcttgaactcgggaggtggaggttgcagtgagccgagattgtgccattgcactccagcctgagtgacagagcaagactctgtctcaaaaaaacaacacaaagcaaaacaaaacaaaaacaaaaacaaaaaaccacacaaaaattagccgggcatgatggcaggtgcctgtagtcctagctactcgggaggctgaggcgggagaatcacttgaacctaggaggtggaggctgcagatggcaccactgcactcaagcctgggcgacagagcgagactccatctcgaaaaaaaaaaaaaagtctgtaagtcgggcccacaccatctcttgctccgtgagtatctttgtctctctagctcctcttcttctctcagtacatgtccctccttgactcccgcctctctgcaaggtgtatttggctgcctcagttggcctctccccctctgcatctctgggtggggtgttctctgcccgtctcccacccacacccacccccggtgctccccttccccccagcaggacagcggctcaggttcacgcaccccacggcgggccggctgggcgcacgcacgtccttgcacacaagccgcacgtagctgtacttgagcacgtcgatgagcgtgtagagcgggggcgcactggcccagcggcagcgcgccaggtgcatggagctcttgacgaagaagagcgccagccgctgctggcaccacgcgtcgaagaagcggctgaactcggcccacgagaagaaggcccgctcccgcagctcctgctcctcctgccccgcagccgtgccgggtgggggctccggccgctccatcctgggggcctgcgtggaggaggggagaacaggtggatatcagacccattcccacccggggtatctcatctactccattcttggcctgccccgtcggttgctggtgcctctatcgaggtgggtagcccggggtcggacgtgcctgtttttctccaaatatataaatatcaacctccatcctatctttggcctcctcccaccgccttatccctggttcacttggagcctgtcatcttgattcctaattccaactcgtctcctcctccgcagatgtgacccttaggtacagttggaatctctcctcccaaaatacgacccttaagctcagatgtyccttaaggacatctcctcaaatgtgttctcaaattccagctaaaacctcctccccttccagctgtgtctctcacccaagagtaacttctaactctcgtattcatctggaactcctccttccatgtgccaacagttggctgtaacccctccaaagacgctccatctccagatgtgctcccacatccaggccacggacccctcacccggtcacatgcttcatgcacctgtggctccgcactccccagatgtgcctctggcgtgcagctgttgccccttcccccgattatgaccctatggctcgccacatgcagctgtagctggggcttccctgagacactctcatctccagatgtactccccacawgcagttrtccacgcttcgcctacaggtgtgtgccccacttgtggctagttctcctcggaagtgtcaccagtattcacctgtggtcccctcctcctcagatgcggcccccagtccagctgtgggcccctcctcccagttacatccaccatcccccgcaatatgcatcttcgttctagacatggcccctcgtcctcggatgggctccttcaccccagatgctccccccacgtccagctgcgcgtctcccctcgagcagccccatccagcccgctcccgacsctcctactccccccctccccgcccgctgcggcaccttccagccccgccgtcccacctagctgtgcctctcccctccccaagatgtgcacccttcccgcccctccccactcacctacccgccccggagcggcgtccacctyccacaatgccccgcgcccaggcctggcccggcccttgctcccgggatgccccgcgcggtctcccgcctctcttcccgccgtgcctcgygggggcgcttccaccgattcctcctctttccctgccagtcactyctcagaccctcagccacacccgctcatccagggcgagggaaagcgcgggcattttcccagtgtgctctgcgggagggctcgccccacttcaccccttttcccgccctcctcccattcgggagactacgactcccagtgtcctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcraggcaagtggggccgtccgcaagcagatgggaggcggagggyggcgggtgcgccgaatgcttggggcctatrcttcgccatgtcggggtgtctgcagaggagtgggcgtggggacgctgaggctgccgagagcgcggtggagacggaagagcgcgggctgcgggccgccggagagtgcagagaggtgtctcccagagggaggggggccaggtagagggtagacgagagacagagacagttggacaggtcctctgagaagaggccttgaggtgcgagttcacctggaagggggagaggccaaatggaactgaggggcggggccggggggggggaaaactgtgtgggcggggccagctggaaatcggaaggccccccgagggggcggggctatctgggagggggaggggctgaagggagctaaggggcggggccggggaaaagattgcgtgtgggcggggccacctggaagggggaggtgccaagggtggggctggctgggarccggaagtgctgagggggcgggggccacctggaagtgctgagggggcggggctagaagaaggtaaatcgcgggcagcagcatcacctggaaggagtgggccctactggagggagatgggtggtgtcagggagaggtcagtggtaaggtccaggtctaggtaaagggctcgtaaaagatggagaatcatctgaatggggagacgtctggcctaatgtatgcttgataaagggatggagcttacctcttgtttttactttttattttgaaataattatagattcaaggaagttgtgaaaagagtatatccatcttcccctaatggtgacatcttatgtagtcccaatatcgaaaccaggaaattgacatcaatacagttctgttaactagattacagaccttgttcagttttcaccagtttgtgtggtgtgagtgtgattgtgcatctgtgtgcccgtgcagcttgattccttgtatagatttgtgtaacccccatcgtaattgtgatatagaacagttccctctccacataagaactcctccccaggcccctggcaaccgctaatgtgttcaccatctctagttttgtcattcggagattgttatgtaaatggaatcatatattattaggatgttaccttttttctactctgcacaatgccctggaggtccacccaagttgttgcttgtatcagtgcttcgtttctttttattactgagtactgtttcatccttacttgatatttttcctgtcattatctcttcattttggtaaccgctttattgagatataattcacaattatacagtttgcccatttaaagtgtacaattttgcccatttaaartgtacaagtcagyggttttcagtgtatttaaagtgtatttcagtgtatttaaagtgcccatttaaagtgtacaagtcagtggttttcagtgtatgcgctgagttgtgcagttattaccataatcgattttaggatatttttatcatccccccaaaaaactcctataccttttatccatcattcatttaattttaaccctgaacaatattctaccatatggtattccagtaatgagggaaccagttccctaagggtagacattccaccagtttccagtcttctctcattacagttagtgctgcagcaggtaactttgtgcctcacttggtccacctgtgagggtctctgtgggccaaatacacagaagtggggttgccgttccgatagagacgccaggtggtcctccagaggcatcaaccagtttgttccccccaactcagcagtacacagagttgagaagccagccttgagtaccgtggtaaggagaaaggaacgtgggctttggagccagccacaccgggttttgaagccttgcctgaaccccagctatgytcctctgtcctcaktaccttcatctataaagtggggatgatctcacctgtcttggagggctgacttgaggattgagggtatttgagaatgtgatcagcctgtcaggcatagagtaggcttcccagtaaacgcttatgtatttctccttcccttgcaactcagtctggtggttaagaggtgagctgtggagcaggccgacytggggtggaacgtactatagatgcaggttaagttcctttgaaaacccctctgtgccttagtttctgtaacagagttgttgtggagagtcagtataattgagaatgtcaagtacctaggcagttgagcactcaggagggatcgtaatagttttctcctttgccctcaggattttggtggctaagtccctaacctgctttctgtgtgaactgtttggttgaagcattgcttacttcctgctccccaactggccctgagaaactctgtttggaaattgctgagtttcttttttgtttgtttttkttttkttttttttttttttaagacggrgtctcgctctgtcgcccaggctggagtccagtggtgcagtctcagctcactgcaacctctgcctcctgggatcaagtgattctcctgcctcagcctcctgagtagttgggattacaggctggcaccaccatgcctggctaattttttgcatttttagtagagatggggtttcaccatgcgggccaggctggtcttgaactcctgacctcgtgatccgcctgtctcagccttccaaagtgctgggagtacaggcgtgagccacagygccggcctactgagttttttgattccaaaattgagtttgagttgtggtgccaacatgtggcggccaaggctgtagagagtagtggagacttagaggygtgtggtgcgggacagagagtactgattccagaaaacgaaaggggaccccatgggttgaagaagatttctgtgcaaaggaagggaaagtcaaagaaaaccatttctgttgcccaggctggtctgagctggtctcaactcaagcaatccacgcagaggtcctgctagtccttttttaaaaaatatattcatagtggaaggaaatataatgtaaataattataattacataattataatgtgtaatttattttcttccattataaatattaaagatatagaaaatttataattttttatatctttaatatttataatggaaggaaaggctcagttccaattagaagtttacaagaataaagtcgtaatttctttcctgtcaaatttcatagaccacttgagttctgctcttggactcctgggttttgtggaccccagattaagaaccctttcttttctttttctttttctttctttttctttcttttttttttttttgagacagagtgttactctgttgcccaggctagagtgcatgatctcactgcaacctccrcttcctgggttcaagtgattctcctgcctcagcctccccactagctgggattacaggtgtgcaccaccatacctggctaatttttgtatttttagtagagatgaggtttcaccatgctggccaggctggtctcgaactcctgacctcaggcgatccacccgcttcggcctcccaaaatgctgggattatgggcagcagccaccacgcccggcctaggaaccctttcattagagttactctaaactgtggaagccccagtgactgttattgatttcattaaataacagacttttwaaaaaagtatttaatttttaaaaatatattgtgaaggggtaacgtattccaattgttctgcctgcaaaagcatgcatattaaaaaatctccctccagcgtctgtccctcctgagrcracagcattaccagttttttgtcttccaactgagatgttctgtacatatacaagatatgtggatacatttatagtctttcttttgtttttgttttttgagatggagtttcactcttgtccaggctggagtgcagtagcacaatctcgggtcactgcagcctctacctcccgggttcaagcgattctcctgcctcagcctccagagtagctgggaatacaggcgcgtgccaccgcacctggctaatttttgtatttttagtagagacagggttttgccatgttagccaggctggtcttgaactcctgacctcaagtgatccacccacctcggcctcccaaagtgctgggatgacaggcgtgagctactgtgcctgrcctatagcctttctcttttacacagttcagtagcacacactctgtgatattctgccctttgtttgaaataacagcataccttagaaactgcccaagagctartttatgtagaccagcgggtacaattttataagcttccacagttgtttcacggaattatgtcatcaccttaaaacaatttttcactaacctttaaacttaactccaaaaaaacccatttcaggtcctcagtctattcctcatattagatgaaaaacagtcttcttatggtaaaggaggcctcttatctttttctctgatttggagcttttattctgcaccagtaaatctcaccagcaaattattttggttcataaaaacaggagtttctttttgaaggggaaattcatgtttctgtttttttttttttctttctttcttaaagaaagggttttatgtgtgtttagatctctgcacaaccartcacctcaacaagtgtttggatttctgttccaggagcagctgacagacgaagaaaagtgctggacaggaagggagaattctgaygccaacatgcagcgaagtatcatgtgagcaccctyccttgcccctgagtctttccttctccaagtcctctgtttctttctctaaatctgtacttaaaaaaacaaacaaacaaacaaaaacycttacgttagattttgagttggaatttccaggagtcaagtagtatggaaaatgagccgtgggatatggaagacagtgtattgaacaacagtttttagttgcaaggagcagaaaccctaacgcagtggttctcagtcagcagcaattttgctccccagggaacatctggcagcgtctggagattttttttttttgagttggagtcttgctctgtcacccaggctggagtacagtggcgcaatctcggctcactgcaacctccgcctcatgagttcaagtgattctcctgcctcagcctcctgagtagctgggattataggcacgtgccaccacgcctggctaatttttgtatttttagtagagacggggtttcaccacgttggtcaggctggtctcaaactcctgacctcgtgatccgcccacctcggcctcccagagtgctgggatttcaggcgtgagccacggcgcccggccagtgtctggagatatttttggttgttacaacctagggacagagggtttgccattggcatctagtggctaaaagccaggcatgctgctaaacatccttcarttcataggacagcccccccaacaacacagaaccatcaggcccaacatgtcaatagtgtctaggttgagaaacctcgtgttaatgcagtccggcttcaggaagacaagaaagggcatgacttgacttatatcattgaaacctgctggagtaaacagcctcaggcttggttcgatccagttgccaaaacttcctccctgggaatctgtctctctccattgttcagctctactgtccttgaggttgtcctcaccctcaggcgggctctcccctcttagcggtccccttggaaagakggtgttagagcccagtttcactggcccagcctgggccacatacctatccctgaaccagccacagggatgcagcctggatcacgtgtccacccctggtcacaggcraaagggccagcccactcaaatcgtgtgtactgagagaatgtggggtaagaagcatcccaagaggaaaacggaggggctgttaccaggaggaaaaaatggatggtagagagacccagacaagggcatccatcccagaaacctgggcggtagtggcttacacaaatgctgggttccgtttttctcccgtgatgaggaatctggggattgtctctccagggctgatggtgccttcgattgctttctgtccactggcttttgcatgatttttccttttctttttgaagattaaataaacctcttattctggaataattttagaggtacaggaaagttgcaaagacagtacagagaggtcctgtatacycttggccagtttccattgtcaatatcatacattactatgatccgtttctcaccactgagatactaatgtcagtacattactcktaactgaactccatactttattattcagatttcaccagattttttttttaatgttcacgccttccaacatttttttttttttttttttgagacagagtcttgctctgtcgcccaggctggagtgcagtggcgcgatcttggctcactgtaagctctgcctcccaggttcaggccattcccctgcctcagcctcctgagtagctgggactacaggcgcctgccaccacacccagctaattttttttgtatttttagtagaagcagggtttcaccgtgttagccaggatggtcttgatctcctgacctygtgatccgcccacctcggcctcccaaagtgttgggattacaggtgtgagccaccatgccaggcmccaacattttatatttagttgtttgcttaatatttctgcccttcaccagagtgttagcttcttgaaggcaggaacttcrtgtgtctgggtcactgccaaacccctcaggcccagaacaggccctggcacataataagtgcttaggtaggccgggcgcagtggctcacacctgtaatcccagcactttgggaggcaggaggatcacctgagatcaggagttcgagaccagcctgaccaacatggtgaaaccccttctctactaaatgaaaaaaattagccgggcgtggtggcggccacctgtaatctcagctactcaggaggctgaggcaggagaaacacttgaaactgggaggccgaggttgcagtgagccgagattgcaccattgcactccacccttgggcaacaagagtgaaaactccatctcaaaaaaaaaaatttttttaggctgggcgcgggggcacatgcctgtaatcccaacactttgggaggccagggtgggtggatcacctaaggtcaggagtttgagactggcctggccaacatggagaaaacccgtgtctaccaaaaatacaaaaaaaattagctgggcgttgtggtgggcacctgtaatcccagctactcgggaggctgaggcaggagaatcgcttgaacctgggaggcagaagttgcagtgagccgagatcacaccattgcactctagcctgggcaacagagcgagagtctgtctaaaaaaaaaagatttaaaaagtgcatagttaatatttgttgaataaaacttgggatgtatcatatcttgcaggtgcgttagggcagaaaaattagtgttgcctcctttgtctgagtctgagtttccttatcagttaagttaaagggcttatttgaaattctytgttatgtgctgagatggaaatggtgttagaagttataggatgcggccgggcgcggtggcttaygcctgtaatcccagcacattgggaggccaagcagatcacaaggtcaggagatcgagaccatcctggctaacacggtgataccccatctctactaaaaatacaaaaaattagctgggcatggtggcgggtgcctgtagttccagctrcttgggaggctgaggcaggagaatggcatgcacccaggaggcggagcttgcagtgagctgagattgcgccattgcactccagcctgggctacagagcgagactctgtctcaaaaaaaaaaaaaaaaaaggaagttataggatacagcatagataggcagggtattggtgctgttattctcctttttttacccccttttatgctcctctaggtcatttttccaccccaagaaagagggtaaagcaaagaagcctgagaaggaggcatccaatagcagcagagagacggagccccctccaaagtatgtcacagggctgggatatggtgaattttttcctttagcagtcaggattgtcttggttgcaagtgttcaaacctaatgcaaaatgtcttggggcccaaaaaactttttcagccaggtggccagaagtccaagagcaagagcagctgcaggcacagctggatccagggcctcggagttgtctgtacgtctctgtttctgcaggtcttggcctcgttctagaaccagacattctccataatgcagagaagctggccgctggccactggccacgtcttgatgctgtctcatctaagtagaagacaacagtactcttttttttttgaaatggagtctcactctcacccaggctggagtgcaatggygtgatctcggcccactgcactccagcctgggcgacagagcaagaytccatctcaaaaaaaaaaaaaaaaaaggcatcccaatagatgctggagacyaatggcaaccttaggcagggactccatttgctcctcagcatcacccatcacagggcaggcactctggagacttccagagatgtgtgatgggtgggtgagtggatgagtgggygggtggattaatgcactgatggatgaaatgatgagatttgctgaggagacaaccagaaaatgttcattggatgcttgaaaggaagggaaggaaacagcaaagaaaccaaagtgtttgygggcagtgcccccactctgcctgctgtagtygcccctttacacccccatttccccaccttccagggcggcactgaaggagtggaatggagtggtgtccgagagtgactctccggtgaagaggccagggaggaaggcggccygggtcctgggcagcgaaggggaagaggaggrtgaagcccttagccctgctaaaggccaggtaggtccccatcaccctgcccatttttaycagaagaaactaattcccattaacctttggaacagagtgcagcagctgttcaggagaattctggagaaattgcccgggagaggtagatgtgtttcctggttgtgtcgggggcagacacaacctggtcctaattgcccctgccctaggacctcgggtgggctccttcaccacgttaggtcttggatgcctcaactgtaacatgcagctcctggtaacaccttcctcatagggtgactgggaagatgaaatgagtcgatttacatacagatctgagaataatgcctgatggtaaaacaagggctcaaggcccagcacaatggcttacgtctgtaatcccagcacgttgggaggccaacgtgggaggatcacttgaggccaggagttcgagaccaggctgggcaacatagcgagaccccatctctacaaaaaaatgttttaaaaattagccaggtgtggtggtgcatgcctgtggtgctatctccttgagaggctgaggcaggaggatcgcttgagcccgggtgttcaaggctgcagtgaactgtgattgtaccactgtactccagccggggtgacagagcaagaccttgcttcaaaaaaaaaaaagcaaaaaaataagggttcaaaagtatatctagcctctcctgtggtcagagggctttttaacttctccaaatacattggaccactctcttcccctgtttaagtcatttaatgcttgttcattgctttgtggatgatgtccaaagcgtggtgctgcttattctgtcagtggtgaggtcaggtcctgtgactccctgcccaaaccccctggtattaccaccacaggccaaagccaggccttgtggaaacctcccaggcccctcctgctgctcctctcttcccccgcccatcacatctgcagccgcatccacagctcctcctcagctcrctccatcctggcttcccacaccyaccaggtgcacttccacctctgggccactaccttctttcccagcctaaaactctctttcccagatacacgcctggctcagtcccctgctttcttccatgctttgctcagatatcacttcctcagcgaaactttcctcaccacctatgttagcttcccatttgctgccataacaattgaccacaaacrcagtggcttaaaacagtgtcagtttattgtcttacagtttgggagtcgtgagtctcaaatgggttgcactgggctaaactcaaggtgtcagcaggtctgcgttcatttctgggggctctgggggagaatccaggaattgccttttccagctgctagagatccccttttctccgttttcaaagcaagtggctgggtgtggtggctcacgcctgtaatcccagcactttgggaggccgaggcaggcagatcacaaggtccggagattgagaccatcctggctaacatggtgaaaccatgtctctatcaaaaatacaaaaaattagctgggcgtggtggcgggcrcctgtagtcccagctactcgggaggmtgaggcaggagaatggcgtgaacccgggaggcggagcttgcagtgagccaagatcgtgccactgcactccagcctgggtgacagagcaagactctgtctcaaaarataaataaataaataaataaataagcaagtggcattgcctccttctgtgcctttcttctgtggccacatctcaccctgactttcctctcctgccaccctcttccactttgaaggcccctgtgactatatcaggcccacctggatagtccagggtaatcccactatcggaaggtcagctgattagcaacctcaattaccctttgcyatgtaacctaacatattcccaggttccaggtattagaatagagatctcttttggagcttagactttaccctgaggcttctggggagctaggaagagttttgggcagaagagaggcagagatcatttagtcctgggcagtgtttaaaatattcatctggccaggcaygatggctcacgcctgtaatcccarcactttgggaggccaaggcgggtggatcacgaggtcagaagttcgagagcagccaggccaacatagtgaaacctcatctctgctacaaaagttagccgggcatggtggcacgggcctgtagtcccagctacttgggaggctgaggcaggagaattgcttgaacctgggagatggaggttgtggtgagccgagatcgtgccattgcactccagcctgaacaacagggcaagactccatctcaaaaaaaaraaaaaattatctgagacctgtatctccatcagggtctcaatgggagacagaaaccataccagtgatttgaacagagggagtttaaaggatggtcactaggtatgcagttgttaaataggtaactgaagggctaaaaagagaactaactctaaggcatcatggaggtagcaactgtggggtgcagtgaccatccctgtggcttttgagctgaaattcacacctctgtggtgggactgctggcaggtctctgagcttagagaaggtgccccgagagcctgcaactctgatctttcaggaagggagcactgggtgggagatgccagggtctctgatcmggtaccacgtggcaagccccgtgaatgttagaaaaaactgtcagtgggatccagcagctgcccccggcaagccrgctgtgcctccagtcatgcagtgccctctgcttccctccattggcactgcctgatgcccaggtggcgccagagcaagaagaagatttgtggagtcccggtcctggcagcatgaaggagactggacagtgacaggtttggagctgagagaaaatcacttaataactggcacagggccctgtaagaagataagtgagtggttgaaaccgagacacggtagcagtggcttaggcaagacgcaaacttatttttctctctcctgagtgcagagtccgggattcatgtgaccgtctcacagggtcagaggcccagrcttcctctgtgctgtcrtttgctctctgtagatgcccttgtccctgtgaacatccatattctgccaacaggaagaggagggcaccccactcaacattaagtggatgttatttgaaccaggaaatgcatgttagtccattttgcattgctataaaggaatacttcagaccagttaatttataaagaaaagaggtttattttggcccacggtcctgcaggctatacaagaagtatagtgccagcatctgcttctggtgagagcctcaggatgcttccagtcatggtggaaggtgaaggaggagcaggtgtgtcacatggcaagagaggaattttaaacaaccagctctcatgtgaaccaggagaggaagaactcggttcctaccacaaggagggtacaagccattcatgagggatctgcccacgtgacctgaatgcctcccgccaggtcatacctccaacattggagaccaaattgcaacatgcgatctggagggaacaaacatctaaactgtatggagagaaggctgggcacgggggctcacgcctgtattctcagtgctctggaggccaaggcgggaggatcgcttgagctcaggagttcgagaccagcctggccaacgtggtgaagccccatctctataaaaaaaatacaaaaattagctgggcgtggtggcgggcgcctgttatcccagttgctcgggaggctgaggcaggagaattgcttgaacctgggaggcagaggttgcagtgagccgagatcgcgccactgcactccagcctgggcgacagaatgacaccctgtctcaataaataaataaataaaaataaaactatacgaagaggtgtacatcatttcccctgacatcccattgtgtagagctggccaacatagtgaaaccccgtctctactaaaaatacaaaaattagccaggcatggtagtgcaggcctgtagtcccagctacttgggaggctgaagcaggagaatcgaagattctgttactgtagaaaacagaagagctatgggggtccttgatgggaccatgatcctgcactggagrgcgggatgatggcccaggtgagaagaggccacccctgagttagggctgagaccayagggtcagaaaggagggtagacagagaggtttcagtcccctctactctcaacttttggaaaatggrgtccctccttcccccgctcactctagaactgttctttcctcttccagaagcctgccctggactgctcacaggtctccccgccccgtcctgccacatctcctgagaacaatgcttccctctctgacacctctcccatggacagttccccatcagggattcygaagcgtcgcacaggtgagarcacacgggcccctgccccttcagtcrcctgcctttctttttctcttttttttttttttttttttttttgagacatagtctcgctctgttgcctaggctggagtgcagtggcatgatctcggctcactgacctccgcctcccgggttcaaacgattctcctgccttagcctcctgagtagctgggactacaggagccygccaccakgcytggctaatttttgtatttttagtagagayggggtttcactatgttggccaggctggtctcaaactcctgacctcgtgatccgcctgcctcagcctcccaaagtgctgggattacaggcgtgagccaccgcacccagccagtcgcctgcctttctccccacttggattcccatccaaggtagtcatccttacaacagctctggtcttagtgttgtggttaagagcacgggtccaccatccactggctgtatgacctgggacaaatgactgaccttctctgagcttaggttgctttatctgtagagatgatgataatgayagcacctaccgcacagaaatatctgagttagaagataacacgtgtaygctgctcagaactgggcccagccctcagtcggggctcagtcattgtgggtcattgtgactgtagttatgcgctgagatggaggcctcacagctcatgtgggaacacaagcgcggggccatggctcaagggagacttccagaagagaggctaaccaagctgagccctttaggacaaagaagaggcaacaagcaaaggaggaggggagcatgctaggcaaggggaacatagaaattgagaaggcctgggggctgctgagggcctggtgtgctggcgtgtagagygcaggattggggatggtgagcaatgaggtgagaaggtcctggaaaaccagcttggggaacagcgtctttgtcctaagggggacttggaatgtttgctgtggggkaagaacagggcgagagacccattcgtratgcggggcagtgtgagcccttgccgtcyggtctagcctattgagcgctttagcgtggtgagtgtgacaggggagctgaatctttcatgttagatcctttcagttgaatttacatttgaaagctaatatgtgattcagtgcgtaaagactttgcactttttccacatcattttggaacagctttggtatgtgaatagctgtacattttatgaaacctacacagatcwtgttgccgatgaaaatctggtgtccaacttgagatgtgcagtgagttcattggattttgaagacctagcatgaaaacagaatgttggaatcatactgttttagatgtattgagcaaaayagactcttcaaaccaagttcaacctggttttttccccctttttattaacgtggctgcaagaaagtttaaggttacatacgtggcttgccagatctttccatcggacgatgctgggtgacgcagggtactctgggagctcagaagtcaagcagcccaggggaggtgatggctgagccgagtcktagaagatgggttggggttggccatgttgagaaaggacagatgcatgcatttcagacaagaagggcaygtgcagaggcctcgagatgggaacagcatgggatgtttggggcctctcatctacttccttgtttctggagaatcrgatgcgacctgggaagcagggagagtttgaggatagcacgtggtgagaggtgagctagagaggagagtgggggctggatctcaaaaggtcttgcactcccagctaaggagcctgggcttcgtgctgtgggtcctgggagccatggaagggctgtgaggtggggaggcaggttcatccctgaatgaaaggtggccataaggaagtcacagtgtggctgagggcatgctgggagctccaggtggacgctgaggttggccctgggggtgtgtcaggggatcttgttcagagggagcaacattgagctatgtccyraacctcacatgcygaggcctggaggggtgacacagcttggtgtgtctggaaacaccccagtttagcagtgatataaaagaaggtggagtatgtggtgtgggaagggttagaaggtcagatggagagagattaggtmggatcrgggtagacatcaaaagactttatcctggataaagcagagaatgtggagtcatggaagggttttgagyagggagagacagtgccagccatgctgatagaaggtccctctggggccacstgaaggagccactgggggccgggagaccggggaccaggtggcgcaatggccaacatgagatataacagtgaagatgggtacaactgcctttgtgtgagctcttcatcatgggttagtatctgagtttagaggcttttagaagcaggttctgaagctctgaaacagggattcaagtgcaagtggtttgtttaggaggtgcagggaacagagggtgattcaggacaggggagcagccaacacaggatgtgctgttgggtctgctatgtgttgggcagctggagcttagttttgtgggattctcyggggaacggtgtaaatgctccagagtgacccccgagatgcgaggcagctggggtatttatacaccaactcctgccgatcgtggggtgagggcctctcctggggctagtttattycctgccacttccagacttctgaggttccggggaagctgtctggaacacttggaggcagttaagatctgaggggagcagtggggagctcaggggacctgctggaatcggtactgtgccaagtacattacatcattgtttactcgtggggattatttctattctgcagtcgtgagagagcaaagcacagagaaattaagtaacctgcccaaggtcacayagccaggaagcaggagggattgaagggtgcggcctgcactggggcagtgactgtgtgcaggcagagaaggggagagggcccagagccttccagaggctacatcagtgggtgtgagctctccgggatgggagcacacgagccagcgaggtcagatacaccaagccctttgcctccccagctcggaagcagctcccgaaacggaccattcaggaagtcctggaagagcagagtgaggacgaggacagagaagccaagaggaagaaggaggaggaaggtgagcccccagaaggagagaagtgtgtgtgtgtgtgtgtgtgtgtgtgtgragccaagaggaaggaggaggaggaaggtgagcccccagaaggagaggggtgtgtgtgtgtgtgtgtgtgtgtgtgtgtgtgtgtgaagccaagaggaaggaggaggaggaaggtgagcccccagaaggagaggtgtgtgtgtgtgtgtgtgtgtgtgtgtgtgtgtgtgtgtgtgtgtgtgtgttttggatctgcaaggkcaggggcctgagagctcaggatgtttggaccctgccgatttgatgcctgtgtccaggcatccaggaattccacctaccaatatgggaacttttgttctgaaaacattgtgggatatatttgtttggacatcttaatttagtaataattcaggcacagtttcccatttttatttgctatttttatatttatttaatggaaactattttcctctaaatgatttccttttccttgtaaattttaccataaagttgcagttcccaaacattcttagttcacagcacccttgatgtcttagtaatttttttmtgatgctcctaggccaataccttatcagttctattaagtagttatgtccaaacaactattagatactatacatacattggaaaaaaagtaatatttgtgctttttttttttttttttttttgagacagtctcactgtgtcgctcaggctacagtgcagtggcacagtttgggctcactgcagtctccacctcccaggctcaagcgattctcccacctcagcttcccgagtagctggrattacagacacaccaccacgcccagctaatttttgtatttttagtagagacagggtttcactatgttgaccaagctggtctcgaactcctgagctcacatgatctgcccacctcggcctcacaaagccctgggrttacaggcgtgagccactgygcccagcctgtattttgttcttaaataaccataattacttgtgggaaatgccttggatactctgtaacatcttaaacagtggaattcaattgaaaactgccaacgtcatttcctgttctatgttgatttttgtacagtacttgatttttatagcagcaacctatgaaaacccagctttgcagagatgcaatgtcattgcaaggaatgtgatttaatactgaaaactgaaatacctcgaactagtagttcacacactggccagcaggtgtcgctgggtttcctttgaaaaatctaaaatatcttgcagygcccagtgagttccctgcatgttggtgaacccaccgaaaacagccataaagatctgatcgattgatcatctggggcctgcatgagattacaccaattgcagcctttaacgtcrtttggttttttgtttctgcaaacaaataaaaggtccattttccagggcagatttaaatttggttaagatctgatttcttggccaggtgcagtggctcacgcctgtactcccagcagtttgggaggccgaagcgggtggatcacttgaggtcgggagttggagaccagcctggccaacatggtgaaaccccatccctaccaaaattayaaaaattagctgggtatggtggcatgcgcctgtagtcccagctactcaggaggctgaggcatgagaatcccttgaaactgggaggtggaggttgcagtgagcygagattgtgccactgcactctagcctgggcgacagagggagactgtgtctcaaaaaaaaaagatttgatttcttattgacaatttttagtacaaattttattgtaaactacacttttagccactgtcagtgtccagtgaggggtggcgggggtggcctctttctactaaggcagatttttcccaagttggtttttgtagtttgtattgtgaccctagaggtaagattttttttttaactttgaagatttttatttttgtctataacaggctgtcatttgcatttttaaccctttcagattctattttggggtgaataacactaaaggaatcattggtaaggaaagacacaccatttatgtctcggctacataggcaaacgggctggaccccctcaaggtcgctgccttgcttggggttgacaaggagcagggtcttacgtggcccactgctttacaggcacattggattggcacaagatagaactgtaarmcctgcactttgggaggccaaggcgggtggctcacctgaggtcagtagttcaagaccagcctggccaacatrgtgaaatcccatctctactaaaaatacaaaaaaatagctggatgtggtggtgggcgcctgtcatcccagctactcgggaggctgaggcaggagaatcgcatgaacccrggaggcagaggttgcagtgagccaagatcacaccattgcacyccagcctgggcggtaagaayraaaytctgtctcraaaaaaagaacagatgacagatgagggcagactgtctccagagtcaaaatgcccttgtaggttcaatgggatttttttgccatctgaccgttctgtctatcgtcagaagaggagaccccgaaagaaagcctcacagaggctgaagtggcmacagagaaggaaggagaagacggggaccagcccaccacgcctcccaagcccctaaagacctccagtgagtttctggtcctctcctccgccctgccccacctcctgattttggggtcagaagtctttggaggatgattaatttaaacaaggcatagattctcaaacttattgcttaaatgccgaatctagaagaataatagtttttattactcgggtttttttttttaattattatttttccccatgcatgtgggaaaggaggaaagagccagccattctttaaaaaatcttcctaggccgggtacggtgcctcacacctgtaatcctagctctttgggaggctgaggtgggtggactacttgagcccaggagttcaagaccagcctgggcaacatggcgaaaccccatttctaccaaaaaaaatacaaaaatgacctgggtgtggtggcacgtacctgtagttccagctacttgggaggctgaggtgggaggatcgcttgagcccaggaggtggaggttgcagtgacctatggtcgcaccactgcactccagccttggccacagagcaagaactcccccgcctcagacaaagtaaaakataaaaagtattcatagctttcagaagtcataggtgtaaattaratgttattaattaagttagacaaccaaactgagttacaggattttagaggctgaagttaccctctcagggtggtccaagtgtccatgaggcccctgtgttagaaacaacayttgccgggagaattttagggatacagagttgtatctgattttctgcagctgctgggaggagtgggaatattttcttctcatgacgatgagatttctttttaccactattcctaagtctcctatttcaggccaagtgctagaattcckctagttagcactgaggagtagacagcaggcctgagatctcagctcaaagctaacagaaaggaaaagggtaggtgtagttatatcttccatctgcagggtcagaatgatcttgggggtaaaaaaaaagaaaaaaaaagtctcagggtcaaagagtttgcatcaccgtctgagctctctcaccgcagaagcagagaccccgacggaaagcgtttcagagcytgaggtggccacgaagcaggaactgcaggaggaggaagagcagaccaagcctccccgcagagctcccaagacgctcagcagcttcttcagtgagtttcccttgctcaccccacctcccggggttgtacaggcaggaggctggtgagcctctctccagaggcctgagatgctgcgaagacccttcttcctttcctgctggttggaaagtcggccttgtctctacyagcctgtctcccatctccctgagcrctggggtggtgctgggtgcagaatggatgggaggtgggggctaccggaaggagaaaagacccactgttttctgtcttcattcctagccccccggaagccagcagtcaaaaaagaagtgaaggaagaggagccagrggctccaggaaaggagggagctgctgaggggtgagtcagtgtccaggtctggaaaggttcttcgggatgtgttcccttctctgcattcygacagccccacccccagctcaggcttcctcctcttgsaggacttggcaaaccttttctataaagagccagagagtaaatattttaggctttatgggacacatttggcccctgttgcaaaaccattmttagatcccagaacctgtagaaacggtccagggtyggagtttgctgaccgtggccccagccaccctctgaccctgcctccagtctttcatcctcagtctgatccccgtagagcctgggggatctttctaacacccagagttgactctgcccctctagggttccccagagccgtcaggagaaaatctaagcccatttggccactggctgycacctccctctctrgcctcacttcctacctctctgttcctctggctctgaactcaccagattttttatttttgagacagagtcttgctctgtcgcctagcctgcrgtgcagtggtgctgtctcagctcaccacagcctccacctcccaggttcaagcgattctcccaggtagctgggattacaggtgcatgccaccacacccagataatttttgtattttcagtagagacacagtttcaccgtattggtcaggctggtcttgaactcctagcctcaggtgacccacccacctcggcctcccaaagtgctgggattacaggcgtgagccagkacacctggcctgaactcaccagatttagtgtatgtgctggaagcctgcaggcgcrtctactctgccttaaaattcactgaacaccccttctttgccagccctgggcggcccacgaggatgaaccatagagagccggccgccctgccccakccctcgtgatgtgcttagtgtgctggggctgtgggacactgaataggttgttaagcaattaattgcttcactgtarttttgttaattatttgaagagatgtctgggctgattcccacgacatctaacatgcacacaggaggcygcactgaagactggctgaatggatgattggatgcgtgggtggataaatatcctataaagtaatgaggtcacccccccatctctgccatgctcaaaacccatctgcgattctccccagcatagaggatatgctgggcttcccagtgccctcatgagccagccctgtccaccttacattgcagcctcctggcatctgcagccttttcctgctccctctgcacaccatgtccccacgtgctgtcattcctccctgctttttttttttttttttgagatggaatctcactctgttgcccaggctggagtgcagtggcacgatctcagctcattgcaccttcaacttcccaggttcaagcgattcttctgcctccacatcccaagtagccagaattacaggygcctcgccaccaagcctggctaatttttgtatttttagtagaraccgggtttcaccatgttggccaggctggtctcgaactcctaatctcaggtgttctggccgcctcagcctctcaaagtgctgggattacaggcgtgagccaccacacccagcctcctccctgcttctgaacatgcttgaccccggcctacaacactgtccctaacccaccctgcccakcaggcttccctcaggccccaactcctattgcacctgcttagggaagccgggtgcctctcccttcatgtgtgagaggaggtgygtsyccccagcacttgagtcagactgtcttttatgtcttgtcacatggtaaagagcctccctaaccagacataagctccttcccacagagccagggctgtgggaggtcccagccttcttagtcttcttgcctagctcccagcactggggytggcccytaggaagcccaggaaatctgccatgaaagaaatttaaatgagcactttcagattttttttttcactagtcaatcatggactcatttatttactcagtaagtatttacaaaggactgattacgtgttagctactggattttaggtgcctgagatctggtaggaaacaaatcagacaaaaattcctctttatagaacttargttttttgggttttttgttttttgtttcttgttttttttttaaagacagggtcttgctctgttacccaggctggagtgcagtggtgctcctgggctcgggatcctcccacctcagcctctcaagtagctggaactacaggcatgtaccaccatgccgggctaatttttgtttactttttgtagagatggggtcctactacattgcccaggtcgagctcctggactcaagtgatcctcccacctcagcctcccagaatgctggaattacatgcatgagccaccacggccagcctgatttcttacataatcatatatccatctgaagttatttttttcctctaaagattgtgttttcaaatacaatgtgatggtgttagcagcgtggacttcatcccctcttgaattcttgatgtcctgaaagctaaaaaaaaattaacggaaaaggggtttggaataatccctgctgttcagcagaaaggacaggtgggttaaaaagtatgacgcagtgagtccaaaatctctttgatgtcacgcctctacaaatgaaacagataacgacaagaaattctttcagctttaacrtttcatgattacagtttaagtctaacaaaaaagtgttcggaggattcttgacatcaattttgtacccccaattgagaccttatcaaggaggttaaatagcacgttaacgtcctctctgcagtattcctgtggaggaagggagcactttagccattttacacacattgacatgattagcccagagaggttaggtcgggcctcgccaggtcacacagggaggtgggggtagggccaggcctgggaccctaaggaatgtttttgattcctagcagttatttcttccccattgccatatcgtgcctcctgagtgtgtgtccgtgtttgtgtatttataaatatgttttccaaataaaatcagtgtcctactgtatataaagttctgttttctatttcaagtgatactacgactgcttttctttcttttgagacggagttttgctcttgctgcccaggctggagtgcagtggcacgatttcagctcaccgcgacctccacctccygggttcaagtgattctcctgcctcagcctcccaggtagctgggattacaggcatgcgccaccatgccyggctacttttgtatttttaatagagacagacacttttttgttagacttaaactttaatcatgaaatgttaaagctgaaagaatttcttgtcgttatctgtttcatttgtagaggcatgacatcaaagagattttggactcactgcgtcatactttttaacccacctgtcctttctgctgaacagcagggattattccaaacccctttaatttctccatgttggccaggttggtctcaaactcccgacctcagtgatctgcctgcctcggcctcccaaagtgctgggattacaggcgtgagccaccacgccaggcatgactgcttttcttgcaccattcctagcctggtcacttcccctctgtctccaatggctgcctccaagagacaggcaaactttcccactctccaatttcctcacctctcagatgggggcacagtgatgagaggaagcatgttcttccacccactcttccccacgtgccaggcactcagcaacgggctttccctgacscaatgctccaaatcctcacaacactgctgggagtagattctgttgttatcctggtttcctgggtgagaaaagtaaagcggggaggtgggacagtattgaggacyggctaggaatcccagctccacctctctcagctgtgtgaccttgaggaagtgacttagcctttctgtgtctctcttctgaggatgtgaaacacttagcccagggtctggccttgattatgaccagcatgttgtcacggtaactgctgctactattcttatttgtttttaatgccatgctcaggccacacaggtggggagtggcagcattgtggttctagccaggctgactggctctagactcccctgcccaccacactctgctgcctcattgtaatgccggccaccgcttgttaaaccccaagttcataccaaaggccatgcacagccctgcagtggcactrtctgtcttggccatccatgccctgtgtgagcatnagaatcagctgaagagctgaaaaatatcctgaggtctctttctcccccccaacccttgtccccattttggtacagatgtaggcctggggctggggagtcctcattgttccatgaagtgcacccaggagtgggaaccctcactgtcattttttatgtaaccttcaggacaacctgtcatagtagggaccccttagctccccagacagatggagatgctgtggttcagagaggggaagctgcttcctcagcaggtacagctggccggggcagagcagattggaacccagatgagtctgaatgcagagtttggctggggtcagtgtgagctacttrcgatataaaggttgaggccgggcgcagtggctcatgcctataatcccaggactttgggaggtcgaggtgggaggatcgcttaagtycaggagtgagacaccagygtgtgcaacacggcaaaaccccatctctacaaagatcagtcggrcatggttgcttgcacctgtagtcctagctactcaagaagctgaggtaggagaatcccttgagcccwggaggttgaggctgcagtgygcattgctccactgcactctagcctgggcgacagtgagaccctgtctcaaaaaaaaatagaggttgggaactgtctctagagctgygctgcttaccagctgtgtggccatgggtgagttaatcactctgtgccccagtttccttatccggaaaaggaagttagaaaggtcccttctggccaggcacggtggctcacgcctataatcctagcactttgggaggccaaggcaggcagatcatttgaggtcaggagttcaaaatcagcctagcgaacatggtgaaacctcrtctcttctgaaaatacaaaaaaatcagccaggtgtggtcgtgtacgcctgtaatcccagttacttgggaggctgaggcagaagaatcacttgaagccaggaggcagaggttgcagcgagccgagatcatgccactgcactccagcctgggcaacagagtgagactctgtctcaagaaaaaaggaaaggtcccttcctcccakgtctgattgttaatcgatgtggtgttagcatggcacctggcactttgcgacacccgggactatacgcacctccctctgtcccagctcagctacgcaatcccttttctgtttctcaagtttgtctgcacctcagcgcctttgcacacgctattctctctgcctggaatgctcrtcccctgctgcccactgtgctaacccctccctcattctgcccagatgtctccrgccttccctgaccaccctgtgaagcagcaccctcatctcatcctcttcctctactcggctttcttttgttttctgaaagatttttttaacacctaaaattaatgwtgtgtttatgtgggggctttttgcccactttcctctgactctcctgctggaatgtgagctccaggttagcaaactttgttttcatccagctctgcaccgtgtgccttgaacagagcctggcacatcacagttggaaggaatgactttgctttgacccagggctctatgcaattcartctccgttttgcctcygtagacccctggatccatctggttacartcctgccaagaacaactatcatcccgtggaagatgcctgctggaaaccgggccagaagtgaggtttctcccttttcagactgtccccctccggtccctgttgccaccggaggctctctaagcagagtcttggttgggagaaatggtcaagtctctccctcctgtgttttggcgacaatcagcagcattgaaagggacagagagrcagccctgggaagtgagctcatgcatttgggtattggcaagggtgtcccgaggaggcgtgaggaagcaagggtgcagacgggcagcatggtatagcctgcaccactgtcrctcttgcgtctcttttccttccctagggttccttacctggctgtggcccggacgtttgagaagatcgaggaggtgtctgctcggtaactaatgaggamtgcctgggtsgggggcggggtcgcttctgggtctgtcctctgcatggyggtcygtgctgccttgttccgccaaaccctgtcaacttggcctctgaccccgctcgggcgtatgatcatggatgtcagacatggtcacaaaagcggctgcaggtcctcttgactttctgcctcattctcatggtcagagcaagacacaaggggcgagcccagatgtgcarggtaaggagacaggctccatctcgggatgactggcaccattgcacacagtccgtgattacttctagtccaccctgagtcatcaaaagtgacttcagtcttgcttacatgtctccatattcacaaaagaaggtgaggtctcagttatagcgaggaccccctactcattcacagaggttccctgcagagcgtcccaccccagtgatgcccagtgcatagcactgccccaccctggtccttctcarcagcatgttagcatcgctggtccctgccagcccccttctctgtccccatttcctcttctctccttgtcctcctcacccccagcactcgcccctgtgtatttagtttatataaatattatcatggaggctgggtgcagtggctcatgccttaattccagcacatcgggaggccaaggtgggtggatcacctgaggtcaggagttcaagaccagcctggccaacatggtgaaaccccatctctactaaaaacacaaaattagcccagcatggtggcgggtgcctgtaatcccrgctactcaggaggckgaggtrcgagaatcacttgaacccaggaggcagagattgcastgagcygagatcacgctattacacyccagcctgggtgacagagtgagactctgtctcaaaaacaaacaaacaaaattatcatgggtacggctcattctgcttgccttcactatcaaacccgtttccacatgtgtccatgttggttgagtggttcgagcctgttgtgactgctctgtagtgtcccttcgttctcacatggcacatgccatttctcagttccccaacatgagtggagcatttcaggctgttcccagcactctgtttttttttttttttttttttttttttttttgagatggagtcttgctctgttgcccaggctggagtgcagtggcgcaatctcggctcacttgcagctccgcctcccaggttcacaccattctcctgcctcagcctcccgagtagctgggactacaggcacctgccaccatgcccaactaattttttgtgtgtgtgtttttagtagagatggggtttcactgtgttagccaggaagatcttgatctcctgacctcgtgatccgcccacctccgcctcccaaagtgctgggattacaggtgtgagccaccrcgcccggccctaattttgtatttgtaatagagatggggtttcactatgttggccaggctggtcttgaactcctgacctcaagtgatcsgcccgcctcggcctcccaaaatgctgggattacaggcctgagccaccacacccggccctcttctgtattttgtaaggatgctttttggattcagagcctaccttmattcactatgctctcatcttaatctacaggtacatccgcaaagaccttctttccaaatgaggtcatgttgtgaggctctgagtggacctgaattttgggggggctgttccatccactgcaccatccaatggtggcttttgcctacaatgattactgagggatttccctgatgttggtttttgtatttcttctctgcaccttaaaaacctcggtaatgagacttctgtaggaaaaacccagcttctgtttctaatgaggcyccctaagtttttcagtaacaaagccattctttccagctttgaagttttagacagaaacacggttttcgttttagaggtggtgcagcttggtggctgggagcacagtcctcaggcacacggccttggtgtacatctcagcttcatacttactcgctctgtgaccttgggcaagccacggactctttcggtgcctctgtttctttatccgtaaaatggaaataataatggtacctacctcagaggggagctgtgaagattctatgagttaaaaggtgcaaagggctggccgtgttggctcacgcctgtaatcccagcactttgggaggccgaggcgggcggatcatttgaggtcaggagttcgagaccagcctgaccaacacgttgaaaccccgtctctactaaaaattaaaaaaaawtagcygggcatggtggtgcgcaccggtagtcccggctactccggaggagaatcacctgaacccacaaggtggaggttgcagcgagccgagatcgtgccactgcactctaccttgggcgatggagcgagactccgtctcaaaaaaaaggtgcaaagtgctcaaagccagctcctgaatttagaaaatgctccgtagcatcagctgtcgtttctctgggctgatcatcaccatcttcatcattgttaccgtcacaccaagttactcccccactgtaaccgyccggtgggttcaccttgcccgctgcctagacagagccgatttatctagacgggggaactgcagtggagaaagagtcattcccrcagagctggctgtgcgggagaccggagtttcatttttactcaaatcagtctccctgagcatgtggggagcagagtttttaaagataatttggcgtgtaggggcttggtaagtggggagtgctgattggtcaggttgaagatggactcacagggggtcgaagggaggttttcttgctgtcttctgttcctgggtgggatggcagaacttgttgagccagattacagtctgggtggcgtcagactgagtgcagggtctgcaaactatcttaagcactcatcttaggttttacagtagtgatgttatccccaggagcaatcggggaagccagaggctgcgtgacccctaaacctaaatttctaatcttgtagctaatttgtgagtcttgcgaaggcaggtccttaggcaaaaaggggtcttttccagaaagggctattaccaatttcgtttcagagtcaagccacgaaccaaattccttcccaaagttagttctgcctatgcccaggactgaacaaggacagcttaaaggttagaagcaagatggaatcggttaggtgtgatttctttccactgtcataatttcctcagttacggttttgcaaaggcggtttcacctccagcaatctgtgattgtcctcatggctccaggccccagagcctgggactgttctgagccctttcctcttctttctccatttctttctagtgtccacccccttaaacccaccccaccccgacaccacactttgaccttgaggaaccacgtgttcatacccccgtcccctcctccaggctccggatggtggagacgctgagcaacttgctgcgctccgtggtggccctgtcgcctccagacctcctccctgtcctctacctcagcctcaaccaccttgggccaccccagcagggcctggagcttggcrtgggtgatggtgtccttctcaaggcagtggcccaggccacaggtaagggggactgtggttggagggaccagaaggacaggagctcagccagagaaaatgcagaggtcaggtggatcggagagatggtggagagaggctgtgaaacrgggttgaggagaaggctgagagggaggagagcctgatggggacagatttgcaggggtgtgggagagaacacaggggcagcagttcaggtgagggaggaccaggcatgtgctgggacrgggggtgtggggtgcagggaaggggagggctggggaaagatgctggaggcagagacagcaggatttgggggctgagatggaaggttggggcttagagaggtctgaaaggactttgactggagggattggaaggagtgggaggaaagaacatggtgtgtggggggccagcagcctgaaggggcccagccgccagtgstgggtggaaaggctggtgatgcggatggcccgcctgccaagggcctggagtgctcggtgcttatcatgaggacactggggagccatggaaggattgtgagcaggcaaggggcagcatccagggggaagaggagctggaccccagctgtagagaagagagaagagggcaggagagatctggcagacagtggatgtcagggtgaggaggcaggaggaatgcctccaggatctccctgggtgactggatggatgacaaagccgtcggcagcttgggaccctgrtgaggggcaggcacctgcagggggcattaatcaccccagygtggggcaggcatgagcaacctctatctgtgggcccccagggccatccaggaagtttggaaacgggtctgaggctcaccaggtctggctcagagcccagggttcgggctggtcagtgtaggagggatgaccacccactggtgggttctcatccrcctggggagaggatgtgctgggagcactggagctggcttagggccatgggcaccaacatttagggaagkcrggggtttcaggctttcatgagaggacagagggactgagaaaggttgacttggatcaggaaagagttacgggcttatgggagccagaggagatgagactcaagattttctcactcattcactcaagatgtgtttcgggagcactgacgtcataccagacccagcacacacggggtcggttaagaatactctgagctgcrggtaacagaaaacccaactacattggcttgsacaaagaaggatctgtttttcycacaaaagaagttgcagatgctggctttcctgcccaacaatccatggcagctggggcctcttccactgtctcatgcctccacccttgatgggtcgtgttcacactcacactgctctccgtgccgccttgtggcccccgtggctgtccaagtcccgggtttgttgtgagttgttggccactttggagaatcccgtcccctttgatgtgtgattcgataacatcccattggtgaggctcacactgtcggctctcccatttgtggcagtttcgcttcaggcgcgaggcccaccttcatgtgctctgtgccgcggctgagcatctgtggactgaaacgcgcacttgttcgttcattacggattgctttccctttcattcttttctgtgttagggttagggcgttatctcgataggtgtaggcaggttatgttatctccacatttyatttcagaccagaaaagaggtgacacacagtatctggtgacaagggtgtgttggttctgataggttgagagctgcttgtcacagctgtcaccgtgacttgaggctccatctscccagctcttacacccaggcgcccatgggacccagctctggacagtaagtggggccagagcacatcccacgtgtgtaagctggtggctccaaaacaagccgaagggtctttggtcactgccagagatgttcatgacccgccaraggaaagggtcccttggccttctctgctctgtccacactcacttccctagtgaccttgtcccgcctgtggctttaaatcccatccgcgccctgatgacaccggcccagatgtctcccctgagtgtggtcatgctcgttcwtccacygctttcctggctccacgtgcatgtttgctgacttcctacagccagcrtggctgggggcacgttccccaagccatttctaccaagtgggtgagcgttagacacagggaggtgcagggactcgccacaagcacacacagctggagaaaattcatccaggccgcgagagaagggagacacgcagccacaactgtcaccctygacacccccacccgcgctctcccctgaaggtcggcagctggagtccrtccgggctgaggcagccgagaaaggygacgtggggctggtggccgagaacagccgcagcacccagaggctcatgctgccaccacctccgctcactgcctccggggtcttcagcaagttccrcgacatcgccaggctcactggcagtgctgtgagtggggcgggccgctcatcccggaccccagacatcttggggacctgaggccacgcgtgtgtcaggaaggcttctgggtagaycatcagctgggtcgcatcagtccttctcatggggtgcacagcttcctctcctccttcctgcacccaakcctaggggagtctcctcttcagagtctagcagacctaatgccatggctgccacatgacaggactcagtaaatacttcctggataaagggagagggaggcaaggaggagagctagctcgttcttactgccctaagagtgggcggccatgggagctgggacatggggatggggtgagggaaggagggcaggtattccaaaatgcagggcagcagcacggctggtggggtggaggtgtggtccctgccttcaccaggcactgacrgctcttcccctgactctccagtccacagccaagaagatagacatcatcaaaggcctctttgtggcctgccgccactcagaagcccggttcatcgctaggtaagcgtgtgggcctgtgaggctacagagsgggactgcaggctcggaggtgaaaggagggagggactggcagctggaatcatcacaaatgccctgaccatccttggatgagaaaarcatgagcaggaggcccagcccctaaagagtgggaagggacaccatttcctttcacaggccagcttctgtcccttggtagtgctgtctagagaaggcccctgggcccctgtgggtgaagcatgctgtgattgattggtgaggtctgcctcggcttgggcgcgggccctgcagcaggaagccagggtttgtttgccatgacagtgagagcaaatccattgagggctcacatcatggarcatttcttgggagccctgccctgtgccccgtgccttacctcatcagttcctaccagcaactctgtgagactggtcttgttaccctcacctccagtttatagaaggggaaatggagacatggggaggcaaactaagccacttgtctcctgccactggctcaaagcaaggaccatgctggggtcctgaccatyacagtcaccagggcgggcgccaggctyagttctctccctgactcatcctcctcaagcctcgccaacccctcagggcagctgagatgggaggtgctggtgcacctacttgtgcccctccccagtctatgctagtgggcaggatcattactgcctggctcagtttcctcatctgtcacatggggctgtgtgatatctggggtcccttccaggctctgmagattcttctggtttttgaggagagggtctacrtacatcaaggtcgaggagatcagagaagggaggaggcaagattsgggaggtgcagacaagcccccttccctggcctgctctctccccaggtccctgagcggacggctgcgccttgggctggcagagcagtcggtgctggctgccctctcccaggcagtgagcctcacgcccccgggccaaggtgagctcctgtggcccgtctctgcatccctcgctggagttacctcaggcttcccycctcctcttcagaggcccatgcccgccccttccccagcgggcccctgccataccaggctcctctctcctgggtrggggggagggggcgtcttgggccgcggcatctgcattccttgccatacagcaaaccacccactgcaccctggtgtagccaaggatgtgggtgccttccaaagcctctggtgggtcttttcttagaattcccaccagccrtggtggatgctgggaagggcaagacagcagaggccagaaagacgtggctggaggagcaaggcatgatcctgaagcagacgttctggtgagagctggrcagtgggtggagttgccaggggctgtgggcagagtgccagggtgggggtggagccagaggagcagtgggtggggccagtgaagtgacggacaggcatcacgagtgccggtcacggggtgactgagagcagaggtggtgatctagacaaggctggtgcttgacacaaggatggtgacaaagatcaggaaggtggcaaacagtgaagggtcartgaccccaggagaggtatagaaagacrctggcagcggccaggcacagtgkctcaygcctgtaatcccagcacttgggagcctgaagcaggcagatcacttgaggtcaggagtttgagaccagcctggccaacatggtgaaaccctgtctctactaaaaatacaaaaattagcctgtaatcccagctacttgggaaactgaggcacaagaatcatttgaacccaggagttggaggctgcagtgagctgagatcacgccactgcgttccagcctgggcaacagagtgagactgtcttaaaaaaaagaaagacgctgacagcaagggagggcagccggcaacatgaggtttctgagtkccagacagggctgtgcatgcagaaaggccttaagggacccagagaggagcaggtgactgacacatggtgaagggtcttgacagtcatggagaggacatccgtggagcggccacgagggctccagagagagccatgtggagggacctaggccagcagctgacccagggctggtgactccaagatcatgactgccccagagaggatgtcagaggcaggagggccgatggcagttccacagatggcctcagagcacctgctctgggccagggccccccactgggtgctgagcagagagtggtgaacaggcccgggcagcaagctcaactctgcctgcacgtggggctctatcagctgctgacctcaggcctaccccacaccagctacatcaaaatctttgtaggtggaacctagccttgaaaacctttgtctatttttattttgtttgagacggagtctcgccctgtcatccaggctggagtgcagcagcacaatctcmgctcactgcaacttccgcctccagggttcaagtgattctcctgcctcagtctcctgagtagctgggactacaggcgcgtgccaccacccccagctaacttttatatttttagtaaagatgggatttcaccatgttggctaggctggtcttgaactcctgggctcaagtgatgcacccacctcggcctcccaaagtgctgggattacatgcctgtaggcatgagccaccatgcccggccaaaaacctttttttaaaaactgtattcttgagtggtctcmtgtgtagccgagtagagaatcgctggtctcgtggtgacagatagggaacaggggcaaggccagactaagggagacaaagcaacagatagtgacacgaagggagagcacagagacagggtggcaagaggagcttggcaggtggtgactcagtgggcagaggcatccaggagcccaggcttctgggagcaggccgagctctctttccaaactgtgtgagttctagaaaggcttcccctatcttgttctcacccgccaccccagcgaggttcccgacctggaccgaattatccccgtgctgctggagcacggcctggaacgtctcccggagcactgcaagctsagcccaggtacaggccccaggggcgctcaccagcctggcagcagccctgctccctcctgagtcggcgtgagggtggccatcgtaggcgcccctctcagaacttgcagagtcctctcccccaccaaaaccaaatgctcctccctggtgctgaaacccactgcttttctccttggaatttccccttgtggagtagatagggtgtaggtgacactgctgtgataaacaggagccgggcgtggtggcgtgtgcctgtgatcccagctactcgggaggctgaggtgggaggatcgcttgagcccaggagttcaaggctgcagtgagccgtcatcgcgctactgcactccagctgggcgacagagtgagacaataaataagtaaataaaaatgggccagaaggcagtgggtcaggccagatagaatttctttctgtcacacagaagtgtccagagcaagggaggtggccagggaaggtacaggtgtgcagytgtgtcccagggatgaccyggggacccaggttcctgtgtccctctgmcctccaaaggttgtcrccccaatgtctgtgatcaaatgtggctcacttccctgttctaattgtgggaggagggacgcagaggagggaggggaggcaaccagattccttgcaaggatgtgagccagacattgcacatgctgcgtgggttccaatcacatggcctttcccacctggaaggmaggccgggggctgtagtccccagtgggaggctaggtccccttctaaaacgtgggaggcttcgtgactgaatagcaagaaagcagaatggtcctggggcccattagcagttctcctctccatgttccccctctaatccattgccttccctctcctctaactcactctcctcctttcccagggattcccctgaaaccaatgttggcccatcccacccggggcatcagcgaggtcctgaaacgctttgaggaggcagctttcacctgcgaatacaaatatgacgggcagagggcacaggtatggggagtgggacatgtcccttccayagacaggaaaacgtcaaagagcaggggtgtggggtcactgaggcctgagcttcaagccggcctgcgccacagactgccgagccctcgctcatctctctgggcttcagcatccacctccatgcagtgagtgtgttctttttttttttttttttttttttttttgagacagagtctcactctgtcatccaggctggagtgcattggcatgatcttggctcactgtaacctcyacctcctrgcttcaagtgattctcctgcctcagcctcccaagtagctgggactacaggcgcccgctaccrtgcccggctaattttttgtatttttagtagagacgaggtttcaccatgttggccaagatggtctcgatctcttgacctcatgatccacccacctcagcctcccaaagtgctgggattacaggcatgaaccatcgtgcctggcctctagggtgtggtcttaactacctcaccagcttatccgaagctacaatcctccagagtcctgacygatgatagtgggagctcatgaaacgtgggctccgctgatgctgctggtgggtgtgttcattttaacagccgttctgggaggtgcctacatgaccccttcatgccgtgacgtgcatgtgtgtcctgtgatccagggcctcaggcgtccttggtcctggggtctgtaagaatgtgttgtgtctcttctgtcctggcaagtgtggggccttctcacctggggataggtaagcaggcaaagtgggtgggagccacagggctcggggcagttasaggaagtggacccctgaggagaccagcctggccaacatggtgaaaccccatctctactaaaaccacaaaaatgagccagtgtggtggcgtgtgcctgtagtcccagctactcgggaggctgaggcaggagaattgcttgaacccaggaggcagagggtgcagtgagccaagatcgtgccactacactacagcctccacgataagagtgagactccatcttttaaaaaaaaaaaaaaaaaagggtggatccaacagacacaggatcagagatggatctccaaaatagtgttgagaaaaaagacacaagatgatttacgatagtgacaatgatttcttgacaactgttcctggaaataataacaaacatataagatgctatatatgccgccctgctcaagggctgtgaccggactgtcttaaaataaatagacatagaggctgggcgcagtggctcacgcctgtaatcccagcrctttgggaggctaaggtgggcggatcacctgaggtcgaaagttcaagaccagcctggctctactaaaaatacaaaaattagccaggtgtggtggtgggcgcctgtaatcccagctccttgggaggctgaggcggaaggctctcttgaacccgggaggtggaggttgcaktgagcagagattgcaccactgctctccagcctgggcgagactccgcctcaaaaaaaaatcagaatgagatctagagcataatgacatttaaacaaatcagcacccacatgcagcaaggtgcaygtgcctacatggggagaggtgtagggattggaaatgaagaagaaaatgatggtagggccttccagagcagggctgggaggtgctgttggaactgaggagatgattcgctcaagtctctgcaccagttcctcctccagagcttccagaaccttctaccagtgcaggtggggtcagaagagaaagctgaggccacatgaggggactcagctgatttcccctcccttctcccatcgtgacagatccacgccctggaaggcggggaggtgaagatcttcagcaggaatcaggaagacaacactgggaagtacccggacatcatcagccgcatccccaaggtgggcgtctgccwcacacttgcactctgccaggrtctgtggtcaggggtgcaaaggcctgaggcccatctaggccagtgtggcacagtgcggggtttattgggaggagatcaggttgcgtttggctgcaaatgacagagcactcagtcctgcgtggtgtragcccatrtgattttttctcacatctagaggtgggcaccccagcaccgacttggctgagcactgatgtccccctgaaccaagcttatcgctacctctatcccctgctgtccttggctggttggcttttagtgccaatgcttgtccccttagagtttcccaaacagatgtcattcttccagacagaaagagggaaaagggattctagcttgagttaacactttcctggacacctcccacccacaacccctcccccgccgtggactgcagctgggagtcactgtccagcactgggttccatggccaccctagtgcaacaaagcctcrgaaagccagagtctaactctgcagcctctccagccaggaacgcggggaggaggagtcaggacgagtttggagggggccagcctgtggataggccccaagcctcagaaatagcagctcagagtcatacagggctgggcctcacaggccccagagttggggacttctctgcacccagtaggggtctcgtgcctgttcgaggagtmccctatcaaagagcctttctctttgcctgcccctaattaaataggaaataagttatttaagaaagyagggggcacggtgcccatcattctgcctgttagagacagtgacrgagagaggcacagttcagtgcacgtgttaggggagctcctgttccgtgccaagcactgttctttaaatcaattttcttaagatgtaatttccctaaaagttagtgattttcagtgtgcactatgctgtttgatgagttttgaaaagttcatacacccaagtaaccgacaccccaatgaatgtataaaatatttccacattctcatcattctaacatatttccgctgggcgcagtggcccacgcctgtaatcccagcactttgggaggctgaggcgggtggatcacctgaggtcaggagttcaagaccagcctggctgacatggtgaaatcccrtctctactaaaaatacaaaaattagctgggtgtggtggcacgcacctgtagtcccagctacttgggaggctgaggcacgagaatcgtttgtacccaggaggcggaggttgcagtgagctgagatcgggccactgtactctagcstgggtgacagtaagactccatctcaaaaaaataaaaataaaaaatcaaatatttccttgtgtccctggccaagcaaggccccctcctctgyccaacaccatgcatccaccagaggcaaccccaggtctgctttttggtcgccacaggttggttttacctgttctagagcttcctgttggtggtataatatggcactagtctcttgcatctggctgcttttgctcattcgttcagcaagtatttactgggcatctgctccgagctaggccccatgctggaggctgggagtgtaacaggcctgccatggtctctgccctcactgagctcacagcccagcagagcaggcagaccttcaccagagagtcctgcagctggctctgtaaattatatgtggagatccgggctccacaggaaaggaccagcattctgtgagcctatgtaacaaacaggcctggcyggtgacagtggctcctgtaatcccagcactttgggagggcaaggcgggtgaatcacttgaggttaggagttcgagaccagcctggccaacatggtgaaaccctgactactaaaaatacagaaattagctggatgtggtggcrtgctcttgtagtcccagctacttgggaggctgaggcaggagaatcacttgaacgtgggaggcagaggctgcactgagcggagattgcaccactgcacgccaggctggacaacagtgggagactgtctcaaaaaagaaaagaggccaggcgtggtggctcacgcctataatcccagcactttgggaggccaaagcaggcagatcacttgcggtcaggagttcgagaccagcctggccaacatggtgaaaccgtttctactaaaatacaaaatttatccaggcatggtggcatgtgcctgtaatcccagctactcgggaggctgaggcaggagaattgcttgagcctgggaggcagaggttgcagtgagccaagatcgcaccactgcactgcagcctgggcgacagagctagactctgactcaaaaagaaataggtgtggcttagacttggtgtcagggaagctacctggctccaggatacaacatgaatgctgcccccggcttgggcaacagtgttcccttgagggaaaagaaggcttgccagtggaggagacagacaggggcaggggttctagagggaacggcacatgcaaaggcccagtagtggaagaggcattgcccayttatttgagaaacagagaggctcacgtgctggggtgaagagaggctcagggggccaggtgaggcgagggacgacccaggctgacccgggagagtccccccagctttggggaatcatggggatggtttttagcagggaggtgctgtgatcggatttggggcttgccagtgtcaccctggctgctatggggaagctggattggaggggatcggtgcaggacagggaagcccagtaggcgaggctgagcagggagttggtgggaagtggayggcttaggaaatcatcaggttcactgaggaactgaatgtgggtgacaggaggagggagatgacaagagctcctaggtttccagcttgtgagaccaaatattacattctcagagacattagtttctgtctcctcttggtggggaataaaagaaaagcatctrtgtgcacctgcctctttgttagtgcatcttgagagctgcagaaggaaaagggaatttatctccccgtgtttgtctttccacctcatcttcyacctctctcaggccctgggtctctcccttcacttttcagattaaactcccatcggtcayatccttcatcctggacaccgaagccgtggcttgggaccgggaaaagaagcagatccagccattccaagtgctcaccaccckcaaacgcaaggtagcatcacccgctccactgcctgccaaggccccstacttcctcatcttccacccagtcctggctgtgggtcctgcccagtgcccagaagggcagagtgtcagtctggatgcacttctctcagccttctgcagaatggctgccacagctccagccatcgcattctcatcccagcatcccaagtaggaagaggggaagggcccttttcgggcatctctgttgttttactatgaaagaagatctgttctggaaaaccccacaacctgcaccccacaggtttccccttttccatctcattggccagaactgtgccatgtcactgccattagctgcagaaaagtctaggagagcaaatatctgstgaaggggaatgaggttgtcggaattagctragagccgttaasgatccagcacctggagccagcagcatggccgccytcacagatgggcagccagttaggtggcgagagggagaccggtagatgaatgctgtcggcctcaggcacagtgccccgtctcaccttcctgcactcacgaactccgttgtgccccaacccaggaggtggatgcgtctgagatccaggtgcaggtgtgtttgtacgccttcgacctcatctacctcaatggagaggtgagttccagcttcctgtccaggggcagctgaggggtgacggggtggggtgtgagcctggcagctgcccctctgacttccatttccgactctgccacttcacatggccaggaagccacacttgggcagcagttctcaaagtgtggtctgaggacccctgaggttccttaagattctttcaaggacatcttcaaggtccctctctttccaactccacattggcgtgaggtggatcttcctcaggtcctgcaacgagaagagtgtgtcgtagaagcacgcaggagaatccrgcctctgttaagccagatattagaggatttgcaaaagtgtaaaataatgcctctagtctcaccactttctcaaaacttgggttatgtttcatcaaaatatgttatttagagccaggcactgtggttcacgcctgtaatcagagcactttgggaggtgggaggatcgcttgagcccagtagttcaagaccagcctgggcaatatagaaaagaccttgtgtctattcmaaaaaaaaaaaaaaattaatattatttgggtgagcatattggatttatttttttaatttctcattttaaatttctaataggtgtaactataatattatgtaacccacatgaacaagctctatggagtgagtcttgaatttttttttttttttttgagataagagtcttgctcagtcacccaggctggagtgcagtggtgagatctcagctcactacaactgcctcctcccaggttcaagtgattctcctgcctcagcctcccaagtagctgggattacagatgtgcaccaccaggtccagctaatttttgtatttttagtagagacggggtttcaccatgttggccaggctggtctcgaactcttgacctcaggtgatctgcccaccttggcctcctgaagtgctgggattacaggcgtgaaccaccacgcctggccttgaataatttttaagagtgttaaagaggcctcaagacaacagtttgagaacagcttgctttaggatgtcaggaatctggagccaggccacatgccgtcatatcccagccctaaccttcctagcggcatggctacagatgaatgactcagcctctctgtgtgtcagtttcttgatctacagtaaggagctaacagtggcaggtgctttrtctgttagggtgagggctaaacagtgggataggggtgtggaactcagtagttagtacatggaagctctcaaaaaaaattagctgyaatcatcaatatcccagataatcttttttttttttttttttgagatggagtctcactctgttgcccaggctggagtgcagtggcatgatctcagctcactgcaacctccgcctcctggggtcaagcgattcccctgcctcagcctcccgagtagctgggattacaggcgtgcaccaccacgcctggcgaattttttgtattttagtagagacggtgtttcaccatgttggccaggatggtcttgatctcctgacatcgtgatctgcccacctcagcctcccaaagtgctgggatttacaggcgtgagccaccacgcccggcccatcccagatgatcatctggtagatgaaccacgatcttgtggtaacttggtcacttctgtcttattaatggatattgatgatcaatcatcttttcaggtttgttggccgcgtgcatttgttccgtgacttgcctccgcgtgtcttttgcctgcctgtctggtgggttctcactcatgtcttcctggtctgtaaacgttttttctccgttaggcccatctgtccttcgccgggacaggtggagctggtagtggttctaatgcagagatgcctttgatgctcaaacccccaatttcatgatgcagactgatgtttcactacatgaaattactgtaggaagacagtcagagtctgatttttgtttcccgtgatgtctggggagaggaaagtcaagtatcaggtgctttccaaacactggatactttgtgggtttttctgcaggatttgatcatccctgctcagctggttcctttgtctcccatgagcatttcaaatatttcttctcattccttcaaatattccttctttaaaatttattgatggcctattttgttgtataggacttgtttgagctattacttttacaaatttttttattagtagtagttgaacatggatgaactatttttatgtagtcaagtatatcattttttttctgtttaatgtgtcctcatccccatgattttttttttttttttgagacacagtctctgtcgcccaggctggagtgcagtggtgtgatcttggctcactgcagcctccgcctctggcgttcaagtgattctcctgcgtcagcctcccaagtagctgggattacaggcacccaccaccacacccagctaatttgtgcatttttagtagagtcggggtttcaccatgttggccaggctgatgttgaactcctgacctcaggtgatccacccacctccgctttccaaagcgctgagattacaggcatgagccactgcagtagcctacatttctaattttagagcttctagtagccatattaaaaggtaagaagaaacagrtaaaatcatattttctttaatccaatgtctaagatattatcctttcaatgtgtgatgaatataagaaattattaacatggaattttacactcttttcttggattaagtcttctaaagccagtgactgttttgcccttggcacatctccgattgaacttgctacatttcaagggctcaattgctacacatggctggtggcggctacactgggtagcacgggctcagctgatcttcccagacgtgccctgagtaggtattgctgcattttacagatgggagctctgaggtacacagagggaaacgcttgcctgaagtcaccagctaggaagcgtgtggctgggatgtaaacctgaaatggtctgaccccagataaattgtacctgcttaacccttgtggctcctctctctcatcttttcatacaaaatgttcatgagcacaattttacaacagaaaaaagctgtccatggaaaacacgtgaatgtccccctggagggcaagtggtgaaggtagtttaacatcatcacagagaagccctgagcaaagggcagaccagaaacactgcgcgtgggtggggaccgatcgaacaaaagagaaaagcaattcaaagccacaagacggattagtcagtgttgacatgtggagacaactgctttgtcctttgtttaaaaacaytcagatcacctccttcctctctgacacacactcttgcaaggtccagctggaactgatttcaaagcaaaacacaaaactgtaaatgtgctggaaaaactcagtgaaaacttttggaattctaaggaaaggaggactttttttttttttttwwaattatcttggggatgaggctggatgcagtggctcacgcctgtaatcccaacactttgggaggctgaggtgggtggatctcttgtgatgtgcacctgtagtcccagctactcgggaggccgacgcaagacagtcgcttgaattcaggaggcggaggctgcagtcagccaagatygcaccaccgcactccagcctgggcgacagagcgagattccgtctcaaaaaaacaaaaacaaaaaacaaaactgatgagatgcccgtaaagtgttaattcaagctccagcaaggccgcagccccccgtctgatgctcctgaagtcaccgactctaaatggtgtcgggccctcttgccagtgactagccccatgctttaagctctcagaatccttctgacatcagggttcttccctctcaaggctttccacgaacsctgtcactagttgtgacccgcacatgtcctgttcgcctcacatttagggcttattgtctttattctcacaaagatgtctyatctctcttctccctgccggccctgcagtccctggtacgtgagcccctttccckgcgccggcagctgctccgggagaactttgtggagacagagggcgagtttgtcttcgccacctccctggacaccaaggacatcgagcagatcgccgagttcctggagcagtcagtgaaaggtgagggtgctcacttttctctcctgaggtctgcagcttgcrctgaccccggcctcccagcctgtccccagtcctggaccgtttgaccagaatcctgcctgctccggcgcttrtgagccagggcttcccaaggaccacgcttctrtgtctccctcagactcctgcgaggggctgatggtgaagaccctggatgttgatgccacctacgagatcgccaagagatcgcacaactggctcaaggtgattctcracccccaactgggccttctccrccccgggtctggaggtctgtcccagctrggcagtggatttcgagcctccactgtgtaccctgtctgagctcagggccccttttcacaatcccaccccagccccctgctgcaactgagttcagaccttctccctgctgcgagcccttgctcacgagttctgatggagaacagccccagcccaagcaccgcacatcccacgaggtgcagcgtgatgaggtgtctctctcctgagcctgccgcccgtgtcgggccaggctcttgggcaggaattaagccaggacatgaataagagaaagtcaggcaggagtgggcgccatgaagaaaagcaagtcagctccgggccagcaaggcggggctgggagtgccycggatgatcaggaagagtctttcccaaagtgagggacagagcactasggaggaaaacccccggtgcagagaccctgagggaggagcagcctctgcgtgtgcagggagcaagggcaggcgaggcgggaggtgagctcagagtggggagcaggccccagatgaggcagcacctggggccactgtgagataaaactggatcttcctcttgaaggtttcaggaagtcagtgggggttccgtgccgggagtcacaggttgtcattgtgcgaagctcctggggtttcccctygagtggaggacgggtgtgttgagggccagcgagcaggagcctgtcatcagtaagagttgatggatgtttgagtggagaggggcagtgaggggtggacaaggggactggagcgggaggcattgtggcactgagccggccaggcctgctgactagctcttcctgtgtacttatgtctgtctgtggctggtttccctccagcacagacctttcctgtctcaggaaatagcactgttgtgcccccagggctgagcttctgcctggcacatggttagcacttagtgaacgtttctgaaygaatgggaaaatgctctccctttggaggagtggccagagtgagttggccacgtctctgtcctgagggaaagacggcggcaaggctgactcctgaggtcccatcgatccygcctgcrtttcccatttgttcttatttatttatttatttattttaagacggagtttcactctcattgcccaggctggagtgcaatggcacgatcttggctcactgcaacctccgcctcccgggttcaagcgattcccctgcctcagcctcccragtagctgggattacaggcacacgccaccacgcccggctaattttgtatttttartagagacggggtttctccatgttggtcagactggtctcgaactcccgacctcaggtgatccacccgcctcggcctcccaaaatgctgggattacaggcatgagccaccgygcccggmcccatttgttcttatttaaacctagaaacccttcccatgtccagtctcttcycaggggccatccttggggttccttctggaagttcccttcagacttacttctagtccctcctcagtccactgaggagcccctccccagcagtgagggccccrccttgggcgctcccccttctcatctcttgcctccccttctcccagctgaagaaggactaccttgatggcgtgggtgacaccctggacctggtggtgatyggcgcctacctgggccgggggaagygggccggccgrtacgggggcttcctgctggcctcctacgacgaggacagtgaggagctgcaggccatatgcaaggtcctggggaactggggctgatggcagaagcaggagggaaggagattagactcccgggggtatttcctattgcacaacccagaccgaggggtgctcacatccccctgtgaaggatccgttctccccagtttttatttactttttctggttctatgagcaactcttgcttcatatagaaaaacaggctgggatagaaagatgtcaggaatgtgtgtcagtgagagattgagattagctacaaatagtggtggctcacataagaaaagaatttttttgttatgaaatgagaagtgtggagggggcagtctgatgccattagggattcaggttcctcctctccccacatttttttttgtccccacattttttttttmtgccatgtgcctctggcctcatcatcacaatgtggctgcaggagttccagccctcatggccatgcctgctccacgcaccagggaagagcaaagggggttsgaccytgagtcagcctcagccagtgaacaccttctgctcaagttctgttgctcatcactttgctccatggctcacccctagctgcaaggaattctgggaaatgtaaagtgatttactttttttcaagttaaagtttttcttaaagctgtgcacattttggactagattttcttacgtatttcctatattcccctctccaacaaatttgggtcttttgccacagaaacagaacaaaatatcacctagaatyktaccacccagagacacgcagtagtgacatttgagggaatgttttatttacatttttgcaaagttgtgatccttctctatgagtaattttcttttctgcctttttaccctggaagtactttgttttcagtgttgtatatgcccttaagcaatatggcaacaggacctgaatgcccgcacaagagttttcaagtgctgtgccccatagcacatagtgctgtgtcctgaaccagctccccgtggctgtgtggggaagttgttgccggctttgttctgatgggtaatgtgattacttagtgtccgttaacctaaacgatcagtgayagaagtgacttttataaatcacaaatgttttggccaccaatctacattgtcaccattttgcattatttagaatagatttttaaatgagctattgtcaggacaaaaggcaaaaagaatccttaagactctcaatgcaaaargggctttccaggtgaygtttatattggtgattattgcccacttgctgcgtatctgccagcatccagcattactgctaatttttagcctttcctattttggtaggtgaaagaagctcttggcagtgttaacattggagatgggctgggcatggccactcacgcctgtaatcccagcactttgggaggctgaggtgggaggatcacttgagcccaggagttcgggaccagcctgggcaacatagtgagaccccacctctacaaaaacttttttaaaaaattagccaggcgtggtggygcatgcctgtggtcccagctacttgggaggctgaggcaggaggattgcttgagcccaggaggtggaggttgcagtgagccaagattgcaccactgcactccagcctggataacagagctacaccctgtctcaaaaaaaaaaaaaaaaaaaaaaaaaaagactggaagtgaggacagccagttactgggcagtgaggatgtgggtgagcataagrgagtgacttcctggggccagggagacagtggaagcagcaagagtttctccataaagcagaagacagggagtggttcacggcaggcctgctgggagaacattcccacccgggagtctctggatggatgctccgcacccccagctccctacttccctggttttctgtrgatactgcrtagaccagagyggggtgggggccatgagtgtacacagctttagatggcaggagcaagtgctgggcctgtggcyggctgagcctctgacctcccgcttcctccctgcagcttggaactggcttcagtgaygaggagctggaggagcatcaccagagcctcaaggtgagccatggyggctgcrcctcagcctccacccctctccyccctgcccctgacagcacagtccttccatgcagggctcttggcttccaccatcttggggctccaggtgtgggcaggagggcagcaggcagtggagctggctttggagtccagcatctccaggttcatgtctcagcactgccrgctactagctggtgaccctgctcaagcagcctcacctccccaagccctgtgcctcattcacaccaggggttagccaaaggacacagcaggtgccatagctgctccttgtgaagtgcctgtgagccctgatcaatgtgaatgaatgttgtcatggtcacaggcatttcaggcatgagtgtctgtcctacatattggatctgtattagtttattttcatactcatactgctatgaagaaataacccaagacttgccgggcgtggtggcgcatgcctgtggtcccagctacttgggaggctgaggcagaagaattgcttgaacccaggatgcagaggttgcagtgagctgaaatcatgccattgcactccagcctgggaaacagagtgagactctgtctcaaaaaaaaaaaaaaaaaaaaaaaggatcatttataaagagaggtttcctggactcacagttccacacggctggggaggcctcacagtcatggcagaaggcgaaagaggagcaaaggcacatcttacatggygccaggcaagagagcgtgtgcaggggaactgccctttataaagccgtcagatctcgtgagacttcctcactatcacgagaacagcacgggaaaaacctgcccccatcgttcagttacctcccaccaggtccctccaygacacatggggattttgggagctatgattcaagacaagatgtgggtggggacacacggaccctgacaccatctctgtcccactctttggttctctctctccattgccctctctctctacatctctgtccctgtcccactgtgtctctgtctccttcctccaggtctctggccctttctctgcctctttttgtctttaatgtcctgcctcagcccccagggcctttcatttctttccatctcccattcctcccaactcccacctttctcaactttttacttcaagggggtcttgtttcttttcccttctttcactttctgtttctmtttctatttctgtttacttcaagggggtgtcttgtttcttttcccttatttcacttcctatttctgtttacttcaagggggtgcctgtttttttcccttcctccctctccccagccctccaacacttggccttgactttgagattccagaccctctgttcctctcttcctctgctcactgcaggssctggtgctgcccagcccacgcccttacgtgcggatagatggcgctgtgattcccgaccactggctggaccccarcgctgtgtgggaggtgaagtgcgctgacctctccctctctcccatctaccctgctgcgcggggcctggtgagtggcagaggacctggccgtggccctgtgtgggattctgggcgggcacacagagagcagagtagggaggggaccttggctcacatctgctcttccaggtaaggatcaggaagatgagcttgcattttatttgagtgtcagataaaaagatcaaaacattttttctttaaaaatgggccgggcatgggggctcgtgcctgtaatcccagcactttgggagaccgaggcaggcagatcacttgaggtcaggagttcaaggccagcctggccaacatggtgaaaccccatctctaccaaaaatacaaaaattagccatgtgtgatggcgggtgcctgtagtcccagctacccaggaggctgaggcaggagaatcgcttgaacctgggaggyggaggttgcagtgagccgagatcacaccactgtactccatcctgggtgacaaagcaagactctgtctcaaaaaaagaaaagaaaattcttttcttaaataaaagaattcccagggcaagcacagtggctcatgcctgtaatcccagcactttgggaggccgaggcaggcagatcacttgaggtcaggagttcaagaccagcctgaccaacacggtgaaaccccacctctaccaaaaaatagaaaaattagctgggtatggtgacccgtgcctgtagagacggggtttcaccatgttgactaggctggtcacaaacacctggcctcaatccgcccacctcggcctcccaaagtgctgggattacaggtgtgggccaccatgcccagccaagaacttacatttttgatctaatttttaaaaatgttttaccatgctgcacgttagacagccagggacccttagtaacaaggcacaggagccggtgtgtatccagcccttgctgtgcagtgggcactgtgtggtcatcagcgtgtcactcatagacactcatttaatcctctcaaaatccgtaagacgtagtgacacaaacatctccattttacggtgaggatgtagagccctagagagcctgagtaactgcccctgcatcacgcggctcctgagagttgggagctgggattggaatcccacagtcagattctagaacccataccctggcgccgtagttcagcctctcagcccgaattaccgtcattatcgtaacggctgtagcaggtggcattttttttttttttttttttgagttggagtctcgctctgtcacccaggctggagtacagtggcgcaatctcagctcactgcaagctccccacctcccggattcacgccattctcctgcctcagcttcctgagtagctgggactacaggcgcccgccaccacaccyggstaatttctttttgtatttttagtagaggcggggtttcaccgtgttagccaggatagtctccatctcctgacctcgtgatccacccgcctcggcctcccaaagtgctgggattacaggggtgagccaccgcacccggccaacaggcagcatttcttgagcacttactgtgcccgggtactgttccaagcactttgtcaacttgtttaatccttatgacaacccatcgttcggccccgtcatgtggatcaggaaacagtccagagtggaggagggaggagactgagcagggggtcgctggggctggaccgcaggagtctccatcccgcttccgcaggtggatagtgacaagggcatctcccttcgcttccctcggtttattcgagtccgtgaagacaagcagccrgagcaggccaccaccagtgctcakgtgaggtcctgggaagcaggggtgggccgcccagctgcttggccctaccagctttttagcgtggtggcctctctggaaccttgtggaggtgggagcagccagggagcttctgaccaccccgtcccaccctctctccgcaggtggcctgtttgtaccggaagcaragtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactcyggagtctgggattcatcccgtcatttctttcaataaataattatyggatagctactttgtgacagggtctgtgctgggctctgggggcaaagctgtcatgggtgtcacctgcatagcatgtagccatgtagccatggcctaggaactgccagagccagtgccagccatggaactgcctgcagtggtgggcgtcttctctatctgctctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtgattctcttgcctcagcctcccatgtagctgggattacaggaatgtgacaccacgcctggctaatttttgtatttttagtagagatggggtttcgccatgttggccaggctgatcttgaactcttggcctcaagcgatccaccctcctcrgcccccctaagtgctgggattacaggcgtgagccaccacacccagccataccaaatattttatttaattgtattggacagcagtagtctaaaatctttacatacatatatttttttaacttgtttaaccttccagccatcccacagggaggcaccatcgtgagccctgttaaggaagacaaatgcagtgtcttaaaataacacagatgtattccctaaacagtttcggaggtcagaagttcaaaatcagttttactgggctaacatcaaagtggtggcagggccggttccttctgggagctccaggagagaaactgtgtcctttttccagcttccagaggccacctggttcctaggctcatggcttcttcctccgtcctcaaagccagcagcatcgcacctgcaaatctctctcctgaggtcatcaggtcacgtcctctcctccatcagatctctgtttctctcttccaagtactcaagtggttacatttagggccccctggatgatccaggataatctcatttcaggatcctaactcaatcccaaagtccctttagtcacataagatcacacattcacagaggccaggcacagtggctcacgccttggggaggacttggggaggctgaggtgggaggatcacttgaagccaggagttcaagactagcttgtccaacacagccagacttcatctcctctaattttattaataaaattaataaaaatgtaaaagggccaggcgcggtggctcacgcatgtaatcccagcactttgggaggctgaggcaggtggatcacctgaggtcaggagttcgagaccagcctggccaacatggcaaaaccccgtctctactaaaaatacaaaaattagctgggcatggtggcgcgtgcctgtaatcccagctactagtggggtgaggcaggaggatcacttgaatctgggagacaggttgcagtgacccgagatcgtgccactgcattccagcctgggcgacagagcgagactccatctcaaaaaaaaaaaaaaaataggtcacatcaaaggtttcagcgattaagacctggatatctatgggggctgttattattgcagccaccccacatgggatgatatgttagaggaaaaccatcgggaaatggtcagacaaggcaagcaggatgcctggaacacccacccagccctgggcaccacggggctggcttggggaaaayggctgcacgcggagcggggcccaggctcgggtcttccagagcaggaggcctctaaccccggggcccagcgtggaacaggagcttccgggcatgagagtgtcagggtgtcctgatactcccgcaggggggacacagggctcccagctgtcccctgcccctcacactctgtttctgcctctcacatctgccctccctccttcccttctctctcatcaggttcctctgcccttgtctcccacccgccctctctccccttccttctctatctgcgaggctttgctctctgccgtgcaagtctgtgccaggcttactttgctgtctgtcactgtgactcakcctccctgtctctcttcctgtgtctccatcatggtctcttgtgcacacaatctcttgggcattctgtttctatttgttgtagcccaagaagacaacattgccttccgagtctccttggggctagcagtggccctgtagccctgtgtgggcagacccaggggacataagcacaggggctgctggggacttctggagaaacatctttcctgaccaaaaaggacagccctggttgtggcagctcctcccctcctcctgccttgactagagatgatggctggagccaagtcaccaccttgtaatgatgaggaaaaagagtaacaaactctcctgacgaccctaaaccggcgaacctagggcagcagctgcctaactgtgggcttttgttcatgggagtaggggaagaataagccccagggcgattatgccactctaaaacatggctttcagccgggcacagtggctcatgcctgtcatcccagcacttcgggaggccgaggcgggcagatcacctgaggtcgggagttcaagaccagcctgaccaacatggagaaaccccgtctccactaaaaatacaaaattagccgggcgtagtggcacatgcctgttaytcccagctactcaggaggttgaggcaggagaatcgcttgaacccgggaggaggaggttgcagtgagccgagatcgagccattgcactccagcctgggcaacaagagcaaaactccgtctcaaaaaaaaaaaaaaaaaaaaaagacttgtttctcatagctaagagttcctgatacagctctgccttaaagaactggcaaattagtgtgcatttgtgtttcaatttcaaataaaatgtttaaggcaaaaaaaaaaagtaaatgttgtatgtcaggggatccccacattactggctttgtgtggagaccatggttcctttgggcttggctcttcctccctgcaccagtgcagggccccaggaacacatctgccacacacggccgccatgtccctctgctgaagctagtcagggtcatcctcactcctcagtgaccctcatgatggctccaccaggtaggtacttttattctccccatttaacaggtgaggacactgaggggcacagggatgtaagttaccttccctaggtccactatctaggaagtggtgggccagggtttggtccatgctgtcagctccttgaccctgcatctataactactaactatactrtggagagcctcatgagctcctgcgaggtgtagaaccttatcccgcaggcggggcagtggcatggtcaggtctaggagtgaaaagatcctgcgatggttggagttgcgggcactgaagaggtgagcctggcgttagggggagcaggggagaccatcttccccctggtgaaatcctgttctaaaattggtgatactcctgccttggcctcccaaagtgctaggattatggcctcatatctatttttaaaaaataagaattcaagctgggtgcggtggctcgcrmctgtaatcccagcactttgggaagccgaggcaggtggatcacttgagttcagcagttcgagccagcctggccaacatggtgaaaccctgtctctactaaaaatacaaaaataattagccgggcgtggtggcagatgcctatgttcccagctactcgggaggctgaggtaggagaatcgcttgaacccaggagacggaggttgcagtgagccgagattgcaccactgcacaccagcctgggcgacaaagagtaagactccatctcaaaaaaaaaaaaaaaaaaattcaaaacccatcgagttgggatgacgcttartgctgggcttcaggaagagtaggcaggagggtagtaygggaggtttctaggagccactcttggaagcggtgctccccacagatgcccgattgcactgactggaactcggtcacatgaccacataactsgctcacatgaccacacctagctgcaaaggtgctgggaaatgtggtaccctgttgggaggccacttctgggcttcaaaccttcactgtgaatggagctcacaggttttctaaaaatggacattaaatgaaccagagttggccctaaggatctgrctcactgcaacctccacctcccaggatgaagcacctgcctcagcctcccgagtagtagctgggattacaggcacaygccaccatrccgagctaatttttgtatttttagtagagaaggtgtttcaccatgttggccaggctggtctcgaactcstgacttcacatgatccgcctgcctcagcctcccaaagtgctaggattacaggcgtaagccaccacgcctggcctcaatatttctttttctgggtatttgagtatgatattatatatgatggttattagacagccagatgcataggaggattagctaatctgttttgaggaatacttatctccaatatagttatataacgacaacattctttttttgaatactggtctcgggtgcctaatgacagaagggtgacatcactaaggaagcctggaaagtcccagccctccacgtgatcccacggatgaaaatagctccgggtgagctctggaacagctgaaaaagctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccragcctccgcaccggattccggagcmcaagctccaccgcgcatgcgcacacgccccagacccaggctcaggcaagccgtgggggcagggagggctgtttcatcccgctggggyggccataaccaagtaccagggattgggtgcaattaaataacaggatttctttttcttttttattttattttattttatttatttatttatttwttttgagacagcatctcgctctgtcgcctaggctggagtgcagtgacgcgatctcggctcackgcaagctccgcctccggggttcaagcgattctcctgcctcaacctcccgagtagctgggattacaggcgcmcaccaccacacccggctaatttttgtatttttagtagagatggggtttcaccatgttggccaggctggtctcaaactcctgaactcgtgatccaccccactcggccttccaaagtgctgggattacaggcgtgagccaccgcgcccggctaggaatttattttctaacacttctggaagctagaagtccaagatcaaggtgttggcagggttggtttctcctgragcctcttgcagaggccctaatctctccttataaaaccaatcaggctgggcgcggtggctcacgcctgtaatcccagccctttgggaagaygaggcgggcggatcctgaggtcaggagatcgagatcatcctggctaacacagtgaaaccccgtctcaactaaaaatacaaaaaattagctgggcgtggtggcgggcgcctgtagtcccagctactccggargctgaggcrggagaatggcgtgarcccggraggcggagcttgcagtgagcsgagaytgcrccactgcactccagmctagggcacaaagcgagactccatctcaaaaaaaaataaaataaaataaaccaatcaaaccaaattccaggccaccctcaggaccccactttaacttagtcacccctttaaragcctatgtctggccgagtgcgatgactcatgcctataatcccagcgttttgggaagccaaggtggaaagctctcttgagcctaggagttcaagaccagcctgggtgacataacaagacctgatctctacaaaacat

SEQ ID NO: 13375 - DNA, 26667 bp, Homo sapiens
cagttacttgggaggctgaggcaggagaatcgcttgaacccagaaggtggaggttgcagtgagcccagatcatgccactgcactccagcctgctgacagagggagaytccgtctcaaagaaaaaagtaccacagatcaggtggcttaaacaaccgacacttattgtctcacagttctgraggctggaagtccaagatcaaggtgtgaacaggggtggtttctcctgagrcctctctccttggcttgcagatggtgcctccctgtgtctacacatgattttcctctgtgcctgtccactccycaccttctcacctgtagaactcagggcttatttatgcttatttgttgrctctctctcctcataataaggtgtgcagcagtgtggggtcaggaaccacatcactttgctcaccatggtgttcattcttycattcattgattccacaaayatttcctggatgcctgctagrtccagtccgcccaggtcctgcagccgtggctgcatacaggtcagatgaggctcttgctcttgtagaatgtacctcctyccgggggggcaacatgacataaacaggtaaacaaagaagtcaacaggatggccatggagagtaagtgccatggagacgaccgaacgtgcggtgtgctgaggagtraagtgaaagctttttaggaaagggtctgggggtctgggaaggcatcctgagggagagacctttcacctggggctgaatactgagaaggggtggccatgaggaagtcttggggaacagaattctgtgcaaaggaaaagtaaatgcaaagtgtctggagtgggaaagaccttgatctgtgtcttacctatgtctataacattctgtactaatataaaggcatatctgaggctcrgtaatttataaaggaaagaggtttatttggctcatggttctgtaggctgtgcaagaagcatggcgcctgtatctacttctgrtgaaggcttcagagagcatccaatcctggtggaaggggaaggggggctggcgtgttacatggtgagagagagcaagagagagagaagggaggaaagcaccagtttccttttaacaaccagatctcaartgaactaatagagcaagaactcactcattaccgcagggaaggcaccaacccattcatgaaggatccactcccatgatccaaacatctccctctgggccccacctccaacactggggatcacatttcaacatgagatttggagrggacgaatttccaaactatatcagtctattcgaggaacagaaggaaagctgttattgctggatcagggtaggggaagcacggaatgaaatgtgattggagagatggacagagatcagawcttgtgaattctggcaggtatcatgacattcgatgtagrccaaagagttacctcctagcccagctcctgatacatgcttaataagcrtagtgttggataaataaacgtttacgtggtaaaagtagatcacaagagctccacaggaggaggtggtggagctccaggtcttctcaatgaatgaaagaatggatgaatgtctttctcctaagtcatgtatgacctgtagaggcttccaggtcttctaatcttatccartgtgcaacactgcctacaaagcacagtggtaacttctaactttcctttctccccaggctctactacccgaaggatagtgcccgaagttgctgcttggcatagatgagcctcagcttccagggcactgtgggcctgttgrtctactagggccctgawgtccacctggccttcctgttcttcactcccttcagccacacgcttcatggccttgagttcaccttggctgtcctaacarggccaatcaccagtgaccagctagactgtgattttgatagcgtcattcagaagaaggygtccaaggagctgaagrtggtgaaatttgtcctgcaggtcccycgggagatcctggagctggagcatgagtgtctgacaatcagaagcatcatgtycaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatggattagctgtgtgtgtgtgtcttggtctgccaccacccctgctgcggcccttttcaccctctgtgtaccctttacttgttcctttcttcccttccccctttcctttccatcttcttccatctatatctcagcaattaagcatggtggttccacagctgggtttggatcttacttctgttatctgcttaccatgagaacatgggcaagagccttcgcctccatgccccagttccatcrtctgtagaatagaccatcacrgagcctgtatcctagaaaggcttaaatgagttmatgagtctcaagaccttagaatagttagtctggcaccgacggagttccagagcaattattattcatacaggctttccagaattaaagcaggactgttatgggatgaattgtgtgtcccacccccaccaaaagatgtggccattgtaacccccagtgcctgtgaatgtgaccttgcatggaaataaggtctttaccaatgtcatcaagtgaagatgaggtcaytcgtgtggaccctaatccacaatgactagtgtccttatgaaaaggrgagatttcgccgggcgcagtggctcacgcctgtamtcccagcactttgggaggccgaggcaggtggatcacaaagtcaagagattgataccatcctgaccaacatggtgaaacctcatctctactaaaaatacaaaaattagctgggcatggtggcacacacctatagtcccagctactcgggaggctgaggcaggagaaccgcttgaacccaggaggtggagcttgcagtgagccaaatcatgccactgcactccagcctggtgacagagtgaagactctgtctcaaaaaaaaaaaaaaaaaaaaaaaaaaaargaaagaaaaggggggatttaggggagggagagcattatgacaaatacctaatgcatgcagggcttaatacctaggtgacgggttgattggtgcagcaaaccagcatggcacatgtatacctatgtaataaacctgcatgttcrgcacatgtatcccagatttgaaataaaattcttttaaaaaagbgggggggwtttaaagacagagacaggcatgtatacagagaggaaaccatgtgaacatggaagcagggattggggtgaggctctactgaccaagggcygccaaactattgccagcaaaccaccagtcatccgaaagaagaccttgatagcagaaggatcctgttcagaattctgtgttgcattcagtcgtagcttttttttttttttttttttttttttggacagagttttgctcttgttgcccaggctggagtgcaatggcacgatcttgggctcactgcaacctccgcctcctgggtttaagcgattctgctgcctcagcctccygagtagcagggattacaggcatgtgccaccatgccbggctaatttttttgtatttttagtagagacrgggtttctccacgttggttaggctggtctcgaactcctgacctcaggtgatctgcccacctcagcctcccaaattgytgggattacaggtgtgagccatcgcgcccagcctcggccatgtcttcttagtctcctccaatctcgaacggttcctcaatctttccttgattttcatgaccttgacatttttgaagcttacaggccagttattttgtaaaccatccctccatgtgggttcgtctgacgtctgattatgatgagattcaggaatcttacagaagcgatgctgttctcgtgacatcctgtcaggtggtgtgaaattccaacttgtcacattactgatgatgtccactttcattgactaagatggtgtttgccacgtttctccactataamgtaactcctttgaaattggtattttgtagggaggtattttgagctctgtaaatatcaaacttctcacttagctttttatttatctgagtatggactcctggtttcttctgtggtcctgtataatttgttactatcattatttattttgactctcaaactgcccagtatggccaatggagcttcttcaagcagactcctgtgttctttccacatgttctcacaacactttgagcaatttcttgctttaagcataggacgtttgtaggctcatcttgttctttttttgctctagacatggaatcagccaaatttcctaggcactctggttccatttggtggagaatggtatatagaagtcaagatttggatgctagtggtgctcattcrtatgggccatcattgtttctatgttctcttagtggagagagctagagaatatgtgtacaaatgttcctatacacactgaaactatgtgtttatttttatctctctatgtataattgagatccatgaggacataccaacgcctccagttatagtccaacaccacagggctcattcgactttcctcctttctgtcttagtaactcccttttccaacagtaggagacctggcccccattccccttactcactgtgtgtagccaatttcccttttcctttgccatttcacccctgtggggatgtctttcccagcctagtctggcttcaacaccatacaccatgctattcccatgagtggacatttctctctctgcttgggttatgacaacccatgccagatcccctctatgtggcctccttcctaattgccttacagtgcaaacctccaccccagacaatgcctgcatataaatgcccccgccccactcagctcatgttccaacactgcacaccaagctgcccrtctgtggatttatccccaccatctccagccccaacaccctgggtcatgctgcccctctatgtggacttctcctcaccccactaccccactggaatgctggctctccacgccagatggcccccagccccctcctcccctaaccctacctagtgtrgagtcgcaaaacccctttgggctttgacaccaccataacttcacaccctccctgacacccccaccttgctttttccctctaaatcattcaggaaagacagaaggaaagagatgaacagaggaagagcaaatgccatgctcttagtcaccgtgtacgcccacttcctgaagtccatgcttgcatcctgctcactctcacacattcccgactcacccaggaaaactccctgaggccaggggtgctgagctctccatctcactgcccagaggccagtgttggagtgacccttcacatgcttgttggaacattgaataaatgatgccgtctgctctaatcctccattttcttttcttttttttctttttttttctttttttcgagacagggtctcactatgtcagccaggctggagtacaatggtgcaatcgtagttcactgcagcctggagtgcaatggtacaatcatagctcactgcagccttgaactcctgggctcaagcaatcctcccatctctgcctttggagcagctgggactacaggtgtgygccaccatgcacggctaatttttttattttttgtaaagacagcctctccgtatgttgctcagctggtctcaaactcctgggctcaagcaatcctcccacctcagcctcccaaagcgctgggactacagacatgagcaccacatccagcctctaatccccatttataaaatgcactttccarttccactctggggataaaggcgtcacagaacctgactctgcatttccccacccatatcattcaagccagatggggaggcagggacagctctggtccctccccaacccgggtagagatttccarcccagctgtcacagctctaagacaccgggaccgaaggagaagccaagagaggcaggaagaggtggcaaaggagtgctggagaagataaggaggctgagctccgacagggagcagggaggaggggccatcttgagactggtgccctgcgagctccaccccacccctccatgcagttccccatgggccccgcctgcatcttcytgaggaaaggcattgctgagaaacascgggtgaggtggggagtgagggggaagggcggtgggcggggcaaagggagcaggggtgtgggacaaagaaggggacatgatggtgccacagaaccaggggaacaggtggatagagcaggagctgagaaggtataagaaattccaaggaccctggtggggtcatgtaagccagtgagataaatgggtgggggtaaaatcaaaagtcaggagcaaagagaaggagagaaaaggaagaaaaatgaaaagggaaagtgggatgatgtcattgttgagattaccatcattcttttctatggatgctcattgtgataatggtggtgatgatggtggtggtggtgatgataatgatgacgttaataacaatagctgccacttattaagtcattgttctgtgcccagccctgtgcaaagggatttgcacacctgatgttatttacacctcagaacaactcatgaggtcagtgactttcattcccattttacaggtgaggaaagtgaagctctgagtcatgaagtcatttgccttaagcttacacagttagtaagtggcagggtcggccaagtatagtggctcatgcctgaatcgcagcatcttgggaggcagaggcgggaggatcacttawgtccaggagtttgagaccagcctgggaaacacaagaccccatctctactaaaaatacaaaaaaatagctcagcatggtggcatgcatctgcagtcccagctactcaggtggctgaggcaggaggatcgcttgagcccaggaagtggaggctgcagtgagccctgattatgccactgcactccagcctgggcaacaaagtgagactttgtctcgttaaaaaaaagtaagtggcagggtcgggtttgcttgattcctgtgggcatgctttttaaaatttttttatttttccatatataccaacttgtccagatatgtgggcatacttttcattgttaggctttaagatcaccaaaaaaagagaataaaaaaggccaggcagtggctcacgcctrtgatcccagccctttgggaggccaaagcaggtggatcacgaggtcaggaggtcaagaccagcctggccaagatggtgaaaccctgtctctattagaaatacaaaaattagccgggtgcagtggcaggcgcctgtaatcccagctactcgggaggctgaggcaggagaatcgcttgaacccgggaggcagaggttgcagtgagccgagttcgtgccactgcactccagcttgggtgacagagcgagactgtgtctcaaaaaaaaaaaagagagagagaatgaaaaaaagggtgataagggaccgcaaggaggggatcagatgaaagagaagctgagggaaaggctccagggataaagggagatgggaaggctaaagagaccagaggtcagtagaatttccttgttaacatgccatgtatatgtaagcccaacccttcaggtatgtgcaggagtaggtggggcagcaataactggacattctcagagtgtttaggaactggtcatgctggcactgaccctcctgcctgaaagccattgaatgctgtttccatgcacagagattctaacctttggcaggaagattggaggcaggtgagaaaggagtgaatgggggctagtgtgaagaattctgacttgggagtcaggagccctgaattcaaatcccaatactgtgtctgacttgccccatgacctccagggagcaggtgaatgccttcctcccttgggaggggatctgctgcttgtgagctgtgtgaccttgtgcaggttccttaacctctctgttcctcagctttctcatgggtaagatggaaacgagatgtagatctgcatcacagagcagtactgaggtttaaatgaaatgattgtggaaactgcctggcacagagtcaccactctgaatgagttagctgtggttgtgaagtctcacttttttcatctggagattggactccccagtgtttaagaccccctttgacacaatgtgatgggtgtttgtctcagaaagggagaaaaagggagattgggattcgtgggtgggagagagacatcgagargggggtggggagccaagaactgtggaacaggagtcaggagatgggaaaaggaatgggagggatggaggaggagagagagaatggaaagagaaccacgagagcgtggggaggagcttgggagaacaaggagaccctttggagaatgggtgaccctctctccaaattccctctcatctgcattcctttccaggaaagaccactgggacaagatgarattgaaggtaacaccgtcttccccagttgcttccacgttgccatccacccacctgacctgccctcagtccctttgtgcatttcygtataaattccattacatggaatttttacaatccctctctcttcccactcaactgtaattttgtagaactctttctcgtggcagttgaaggacttcccaaagtatttcgaaggcatatccatcctcaagtatctccaagactcaggagtgaaaacaaatgagtttctctcttggtgactttgaggttccccataacttcatccaggaatctgaaggacgccagtgctctcatttagtggtctcaggaatgatgcctcttttgctaacacatttcatacatcactcctttttgaatttttttttcttttttgagacagagttttgctcttgttgccaggctggagtgcaatggcacgatctcctctcactgctacctccgcctcccaggttcaagcgattcttctgccttggctgaggcagcctccctagtagctgggatcaaaggcatgagccaccatgcccrgctaattttttgtatttagtagagatggggttctgccatgttggtcagtctggcctcaaactcctcacctcaggtgatccacccacctcgacctcccaaagtgctgggattacagccatgagccaccacatccggccttggtttttttgttttgttttgttttgtttctaatgtacgctcctttaaggagtctctagttggagcctcattgatagcttcaagagatgccactcttccccactgactgcttcaagttcccccaaagttctctcttaactttcagagctgcgggaagcatttcttgagttcgataaggaccgagatgggttcatctcttgtaaggatctggggaatctcatgaggackatgggttacatgcccasggagatggaactgattgagctcggccagcaaatccgcatgaacygtgagtccagggaatgggagggatggccggggttagggaagggatcagggcagaattgggaaggatgtagaggttaagagtagagttsggggtggagaggaggatgagagggactagaagtctggaagaaaacaggtcagattcgactcaggaaggcagcatttgaagtggttaaaagcttttagagataggtctgggttcaaatctcagttctattatttactaattacagtcattttgaaaagtgaagttatccgctactcttsagtttccatttcctcatctatagaggaagatgcctctctccttacctcatgggactgtggaaaggaagagaaggaagagataaagatgctgatgcagttaaagtcttagcctccagtaaattcttattaaaggtagttattactatcaccactaagattcatcagtggagcacgagattggagctgtattggatgttggaaacaaacttggagctgsagctaatgttggtgaatacagctgcaaaaaggatggatggatttttggatggagatcataactgatttttagattttagctagaataaaattcctattgaggctgggcgcagtgtctcacacctgtaacctgtaattccagcactctgggaggctgaggtgggcagatcacctgaggttaggggtttgtgaacagcatgggcaacatggtgacaccccgtctctactaaaaatacaaaaaattagccaggcgtgatggcgtgcacctgtaatcccagctactcgggaggctaaggtacgagaatcgcttgaacccgggaggcagaggttgcagtgagccgagatcgcaccattgcactccagccttggcaacagagtgggactctgtctcaaaaaaaaaaaaaaaaaaaaaaaaaaaagctattgggtttgcttctgggcatgtaacgaactaaacaaggttgaattcaaggtaatgatagtattcatatctgaaaaaaawttgtatgctcatttaattcatgctcctctttgtacaggtctacagaggaggagaaacatcttaaccaactgtctgaaagtcacacaggcagttacttccaccataccacaccctatccactcctgttcaggctagagggacatgagtttggagcttggagttagctgctggagggaggaagtcaaagacggctcttatagggcagggagaagggagctgatctaactgactcgaagcacaaagtgaggtaatggaaggccagggcttgtggggtctcgctaatcctgtgccatcytcctcagtgggtggccgtgtagactttgatgactttgtggagctgatgacccccaaattgcttgcagaaacagctgggatgatcggtgtccaggagatgcrggatgccttcaaggaggtgagttaacagtgtcatggtgctggtgatggtagaggcagaccctctgakgtctgcctgtaattagccaatgccatggacagcacccaccaaccaggcccccacctttttttttccagccatggtgggatcrataaatagggaagaaaaataacrtattccaaacacctgcaatggatcaatgcctctgtatactttatctgatttaatcctcaaaaaaacaaacaaacaaaaacaaaaacacrcacacaaacacattaggagtaagcaagcagtcatgtatcccaattaaacagatgagaaaagtgaggctcatgaagattataaatyttatccaagatcctgccatctctagaataaatgttaggactttwtttttttgagacggggtttcactgttgtccccaggctggagtgcaatggtgcaatctcggctcactacaacctctgcctcccgggttcaagccagtctcctgtctcagcctccyaagtaactgggattacaggtgcgcgataccacacccagctaatttttgtatttttcgtagagacggggtttcaccatgttgaccaggctggtctcgaactcctgacctcaagtgatccacctgcctcggtctcccaaagtgctgggattacaggcatgagccaccgtgcctggccagggcctctattcttagtgcctgtaacaggaagaatccaagaatttgagatcccagaagggaatgcaaagtggtcatmtggtacgaaccacttgctgcagacatactaaaaaatatcagacccagtgagaataacagacttgcttatatcccctgataaaataccttctcgttctgagagctttcagcaacacaaggtgaaaataaagagtagtagagtgtttgggagcaaaggatttggaaccaggcaaacatgggttcaaatcctaggaggcytccacctattggctgtgcaagtgcctcccccagcttcttataaagatctacagctggccgggctcagtggctcacacccataatcccagcactttgggaggccgatgcaggtggatcacaaggtcaggactttaagaccagcctggccaagatgctgaaaccccgtctctactaaaaatgcaaaaaaatttagccagacatggtggtgggcgcctgtaatcccagctacttgggaggctgaggcagggaattgcttgaacctgggaggcagaggttgcagtgagctgagatcgcaccattgcattccagcctgggttataagagtgaaactccatctcaaaacaaaaagaaaaagttgtctggattgagaagtgctgtaagtgtaacgtgaacactgtattaagacttagtatgctaatataattagcataacgtacttgtatacttaagtaaacttctaggctaagtatcctaattaagcatgctaagcacctactaagaacttagaacttactgccttatgaaatccagtgtgtataaaaagaatgctacttacatagctaaattaataatttttaagtggattacatgatgaaaggataacactttagatatattgtgtcaaataaaagagaatattaaaaattagtttcatttgttccttttaacatttttttaaacgtcactactagaaaattttaaggccaggtgcagtggctcatgcctgtaatcccagcactttgggaggctgaggtgggtggatcacctgaggtcgggagtttgagaccagcctgaccaacatggagaaaccccgtctctactaaaaatacaaaattagctaggcgtggtggtacatgcgtgtaatcccaagtactcaggaggctgaggcagaagaatcrcttgaacccgggaggcagaggttgcagtgagccaagatcgcaccactgcactccagcctgggtaaaaagagcraaactccacctcaaaaaaaaaaaaaaaaaaaaaaaaaaagctgaatagtattccattgtgtacttatgccatgttttctttatccactcttctgttttgatggacacaggttgcttccataccttggctattgtgaatagtgctgccatgagcaggggagtgcaaacatccctttgatatactgatttcaattactttagatacatacccagaagtggtattgctgggtcatatggcagctctaggtttaattttctaaggaacctccataccattttccataatagctgtgctaatttccatacccagcaaaagtgtaccagggttcccttttatccacatcctcaccaacacttgttattattcatctttttaacagtagccatcctaacagatgtgaggtgatatttcattgtggttttaatttaaatttcccaaatgattagtgatgctgagcatttttttcacgaacttgtttgccatttgtctgtcttctttagagagatagctgttcacgtcttttgcccatttgtcttctttagagagatggctgttcacgtcttttgcccatttgtcytctttagagagatggctgttcacgtcttttgcccatagttattagattgatgcaaaagtaattgtgattttgccattaaaagcaatatttgtcattatgcagtattattaattataggcacaatgccacacagcagatctctagaacctatcttgcgtaactgaaactttatacccatggtacaatatctccccatttccctgtcctcctaacccccagcaactatccttctactctctgcttctatgagtgtggttattttaagtacttcatatgtaagtggaatcatgcagtatttctccttctgcgtggtatatatttaaatgcaatattcagccttacaaaagaaggaaatcctgccccacacaacaacacaaatgaacctggaggacagtatgctgggtgaaataagccaggtacagaagacaagtatttctaagtgtcttgcttgctgctccgtgctcagtcccaagaacggtgccttccacatgggcactactgacacatttttttttagcaatatggatacatatgtgttgaattaatgaactgcctccaaagctctgccctgcacacccttaactagtctaccagaaagtctagtacgttcaatttccaaaacatcggggagtgaactctccttcttgagctctgctggtgctaactggctcaaaccacaaccatctcctaccaggatgatcatggcggccctctaattggtttcctggctcccatcgtggtcctactgtggtctgttctctacacaacagggtttcatgctcacattcttttaaaatgtatatcagatctggtcactcccctgcttaaaattctccagtggcttcttgtcttactcagaaccaaatcctgacaacgtcccatgacacacaagcccctacgtacttgggccctgccttctgcaacactgagaccttgtctatttcatgctcatttctccccagctcacgcctccctaaacactccccacttctgcctcttcctcaagtacaccttcctgccttacggcacttgttaacttgcagcttcctcagcctacagctgtgtcatccaaaataaatacaatgtaagcagcatgggtcatttaaaattttctttctctttttttgagacagttttgctcttgttgcccaggctggagtagaatggcacaatcttggctcaccacaacctccacctcccaggttcaagcgattctcctgcctcagcctctcgagtagccgggactacaggcatgcgccaccacgcctggctaattttgtatttttagtaaagacggagtttctccatgttggtcaggctggtctcgaactcctgacctcaggtgatccacccgccttggcctcccaaagtgctgggattacaggcatgagccactgagtccggcatattcagcttttaaaaagaaggaaactctatcatttacaacaacatgaataaacatgaagcacattattctaagctatataagccaggcacaaaaggacaaataccacatgatgttacatgcagaatcttaaaaaattgaactcatgcaaataaaaagaaaggtggttagcagaggctggggagccacagagaaggaatggacagttgcttgtcaaagggtacaaagttttggttagacaggaggaataacttttgagatctattgcacagcaggataactatagtaaataataatrtatgtttcaaaaatcacytaaaaagtaagttttaaatgtatcgctgggcactttggctcaggactgtaagcctagcactttggaaggacaaggtggaagggttgcttaaggccaagattttaagaccaacctggccaaaatagtgagaccccgtctcattaaaaaaaagtttcggccgggcacagtggctcaagcctgtaatcycagcactttaggaggctgaggcaggtggatcaactgaggtcaggagttcaagatcagcctggycaacatggtgaaaccctgtctctactaaaaatacaaatattaaacaggtttggtggtgcgcgcctgtaatcccagctactcgggaggctgagggacgagaatcgcttgaayccaggaggtgaaggctgcagtgagctgagattgcaccactgcacttcagcctgggtgacagggtgagactgtctcaaataaaaaaaaaaaaaaaaagaaagaaaaaarraaaaaaaaaaacagaacaaaactgtcttttggagctgacgttctagtggctcacattcccaaagcttttatctcagtgcttgacccacagtaagcgataggtaaactccatcatctcgtggctatcatcattgtcattgctgatataatctatttctgcttctattcagtttgacacgaatggagatggggagatcaccctggyggagctacagcaggccatgcagagactcctggggragcggctcaccccccgggagakctctgaggttgtccrggaggctgatgttaatggagacggcacagttgactttgaaggtgacattgacggggcgtggtggggagcgggggcagccaccgcaggaatccacttccaactcactgtcagattttccaagttggccactccttctcactcctctccaagtttgagaatggaagcgggtggcaggttttggaagcatytgttctgtccctttcttcccaggctattcatttcaaagagctgggtgtcscycacttctggtggctccgaggaacacctcagccaaggccctttccttcccatgctcaggacgcccttcygccttgcccattccttgttagtttgcagggcacctttkatcctaggaagaacttgtcccatcagaaagagactggactggctagcagctggagctctggggtcaggttcaggrgcttcaaattcaggatcatcgctgactcagcatgtggcttatgctactccctttttctctttaagggtcagttttcccatctgtaaaatgaggtggatgatgacaccttttggagaaaactaaaagaaatcatgcacaaagcaccactgtatttttaaattwtccttccctgtctttgctcragttgtccttccgtctggaataccctttcccctctcccctggctaaytcctagttatgttcctggaaggtacctcccacctctcttactgggctccgtgtccctctkctgkctccccagtaatacctcccgcttgcttctgcagtaatacggattcgtggcatctctagagtttattgcctattkccttctgagaccatggaccaattccttcatcatcactatatccccaaatcctagcactgagcccagcatgagtatattggatcactgaataagtgaaaaggattggggttctacatggatgagacgtggggttcttttttatgtgaggcataggaaggcatgtcggccggacatggtggctcacgcctgtaatcccagcactttgggaggccgaggygagtggatcacctgaggttagtagtttgagaccagcctggccaacatggcgaaatcctgtctctactacgaatacaaaaaaattagccggaagtggtggcaggtgcctgtaatcccagctacttgggaggctgagacaggagaattgctagaacgctgggggcggaggttgcagtgagctgagatcgcgccattgcactccagagcaacactccgtccaaaaaaaaaaaaaaaaaagcatgtcaagttctaattgtgacattctttggttcaaagatctcagcacctatctgctgcttatggacaaaaatccaaaattctggccrggctcagtggctcatgcctgtaatttcagcactttgggaagccaaggttggcggatcacctgaggtcaggagttcgagaccaggggggccaacgtggtgaaaccccatctctactaaaaatatacaaattagctaggagtgacagtgcacgcctgtagtcccaggctatacgggggctgaggcaggagaattgcttgaacccaggaggtggaggctgcagtgagccgaggtcacaccactgcactccagcccgggcaacagtgagactccatctcaaaaaaagaaaaaaagaaaaaaaggccaggcgcgtggctcacacctgtaatcctagcactttgtgaagctaaggcaggcagattgcctgagctcaggagttcaagaccagactgggcaacaccgtgaaacccatctctactgaaatacaaaaagttagccaggggtggtggcatgtgcctgtagtcccagctacttgggaggctgaggcaggagaattgcttgaacttgggaggcggaggttgcagtgagatcgccccactgcactccagcctgggtgacagagcgagactccgtctccagaaaaaaaaaaaaaaagtccaaaattatttgtctgatatgcaagtctatccatcatctggcctcgcccacccacccagcctgtatcttctgtagctattctctgaacttttaagttctggcacaaacttggtgcctgctttatgttctccaacctccgttcctaggcatcagatgctccgtccacttaccacatctttcagtctcatccatccctcaggaactcacatcaaggcaacctttgtcaggaagcttctctccatccttccctcatgtcttcctcccagctgtgaagtcttacagaagtttttctgttcctctccatggaagttatcacagcagaccttgctgtgttgagttgtattagcttccaagrcctccatcctagatagagaggaggaagggccattctctaaaccatatatgctgtatgtcccagtatggaaacayagtagaggctggttggacacctgctagatctagccaggattaggtgtgcagtggacatcaagtgacatctggagaaggtggggtgggggtgggagatgatcctcaggccaaccaaaggcaagggaaggtcaggatgacctcaagaccygggtgggcagcaagatcgtcttgagccacagcaaagtcaggtgcaacctgcrttccttccagggttcaccattcactatccacgtggcctcaggyatgttggtgaccctcgctggcgtaagtttccttatctgtaaagtgacacttatccctccaggatggttgagatgatgaaatctsatagtgacaatcacaggttttttgggttttgttttttagatggagtctcactccgtcacccaggctgcactacagtggtgcaaccttggctcactgcaacctccacctcctgggttcaagcaattctcctgcctcagcctgtggagtagctgggattacaggcgcccgccaccacgcctagctaatttttgtatttttagtagagacggggtttcaccatgttagccaggccagtctcaaactcttgacctcaagtgatccaccctccctgacgtcccaaagtgctgggattacagttatgagccaccgcgcccggccaacaatagctgtttatgggatacttaatctgttttgtgagcattatgccattaatggtcttaaaaaccatataaggaaatagcaatactaggattcccattttttaaatttaatgttttatttacatgcaagattattttcataacagaaatgaagaaactgcaacatactgaaattagtctttcagaagtaggagcataataataaccacagtagtttacatggggtgactgtgatggcaggcacggttctgagcaaattttatttacctatttaattttttaatttttttgtagagttgggggtgtcgctatgttgcccaggctggtctcgaactcctgggctcaagcgatctgcccacctcggcctcccaaagttctgggattacaggcgtgagccaccgagcccagcctgtaagccaattttatctcaacctcatgaggtagmtctattaaacatgccaacttgacagatgagaaactgaggcacagggttaagtaacttgccacagagatctgattcccatttcatagatggagaaatggaagcatagagggattaagtaatttcccagggatcaccagcagtgcctgccacataggaagggctcaaaaaataatgttgggggcttttacaacgagatgccttactggggattyttttttttctttgcagagtttgtgaagatgatgtctcgctgaggaggtcctggaagctccagaccctctccacctggtcaacatggagcaagcgcttgtggagaaccaaagcccmaaagccccagatcsccttaaagcagagagggagggcaggcgggagggagggcattggcatgcggcgctgtgcatggggtgagacccagagcggtatctttgccaggatgggggcgtctgcagaactagrttaagaaggaagagtctgtggatggaaataggaagcgtgggagggtccagttgccacccccaaaaattccaatgattcttgacatcttttcacttcacgtagtcctaagtccctgtgacctgccagagtctcttccccagcttccccttgggtgaaaatagtctcttctcctgttgggtatcaaaaggttcagaacgtagtctctactcttcccctgcctgcatcaactgttgcaaatcccgtttctctctcccggtaaggggacaaattatactttattcaggtgatggttacatgaacagcccagacttcaccactacgcaatatatccatgtaacaaaaccgcacttgtactccctaaatctatagaaatacaaaatgaaataaaaaggatgcaaatcagtcacagagctggaaacagagttgttgttgaggctgggcttggaaatggctcgtgcaagtggcattcaaagtcaactccttccttttcctgatttcctggaagcactgtctggtttctctctctctctctctctctctctctctctctctctssctgtctgtctctgtctcccctcccacatcccttcctttgtgtaagatactcaggggactgaattaaaccacaaatctggattatcaaggtttagagctagctgatccttggggaattaatcccctgaaaaaatgtcatcatgcaaagagagagatgacaggatcccccaaatccccagttcagccaggttgttgcaaagtctttcctagaagcctcctacctccgcgctggtctgtcctggaccacccagaggctgtgtctctgttagatgggtcgtctgttccgtccctcacgtcctgacatcgatctgtgccatgaaacagaaaagagagattcctcctgacctccgcccaaagcaagacactccagcaatgcaaaggttaaaataaaagtcaaaataaagaattaacttcatgccttcctccaactttttcttgctttgaagtccatgaattagatgtttaaaatgagtcatctggttcaatagctttgttttattttattttattttatttttgtatttatgtattatgtatgtatgcatgcatttatttatttatttttgagacagagtctcactctgtcacccagactggagtgcagtggcgcgaattcggctcactgcaacctccgccttctgggttcaagcgattcttacgcctcagcctccagagtagctgggattacaggcgtgcactcgtgtgccactatgcctagctaatttttttttttttttaagtagagatggggtttcaccatgttggccaggctgtcttgaactgacctcatgtgatctgcctgcctcagcctcccaaagtgctaagattacagacgtgagccactgcacccagcctatttatgtatttatttttgagacagggtctcactctgttgtccaggctggagtgatctcacctcactgcaacgtctacctcccgggctcaagccatccacccacctcagcctcaccctcctcagctgggaccataggtgcatgccaccaygcctggttaatttttgkatttttttttttgtaaagacagggttttgccatgttgcccaggctggttgcaaactcctgggctcaagctatccacccttttcagctcccccaaagtgctgagattacaggtgtgagccaccacacccagccaatagctttgttttataaaataaaaaaattaagaaaaagtggagcccttggggaagccgaggagggagggtcacttgaggctgggagttcacaaccagcctggcaacatgagaccctatctctacaaaaaaaaaaaaaaaaaaaaagaaagaaagaaaagaaaaaaaaaatagccaggcatggcagtgtgtgcctgtgatcccagctactcaagagactgaggcaggaggaaagcttgaactcagaagtcaaggttacagtgaaccaagatggcaccctgcactcagcctgggtgacagagtgagtccctgtctctaaaaaagaaaaagtggaagcagaataatgttatttcctaatctcaasctctttcctcagctccatcmcattccatccacacatgcacccatccgccccttcatttcttcagtcacccattcaaaaaagattttctaagtacctggtctatgcctgacattgtttcaggtaatggaaatagagcaaggacaaggtatttggcctcaacartctcatattttagaaccatgcaattcaatagaatcttctgcgasgatagaaatattccagaccygcgctgtttattatggtagccacatgtgactactgagtattaaatgtgtgagcaaggctgagaaactaaattttattttatttttatcaagtgagmacagttttattaatgaatacataaktgcattagtctgttttcatgatgctgataaagacatacccgagactggataatttataaagaaaaagaggccaggcatggtggctcatgcttgtaatcctagcactttcagaggccgaggtgggtggatcatctcaggtcaggaggtcaagaccaacctgatcaacatggtgaaaccctatctctactaaaaataaaaaaattagccgggtgtggtggtgcatgcctgtaatcccagctactcaggaggctgaggcaggagaatcacttgaacttgagggggtggakgttgcagtgagccgagatcatgccacttcactccagcctgagtgaaagagcaaaactccatctcaaaaaaaaaaaaaaagaaaaagaaaaagaaaaaaaggtataatggcctcacagttccacgtggctggggaggcctcacaatcatggcggaaggtgaaaggcacgtcttacacagcagcaggcaagatagaataagagccaagagaaaggggtttccccctataaaaccatcagctcttgtgagacttattcactaccatgagaacagtwtgaaggaaacykcccccataattccattatcttccaccaggtttctcccacaacatgtgggaattacgggagctatgattcaagatgagatttgggtggggacacagccaaaccacatcaataggtaacatgggaattatgggagctacaattcaagatgagatttgggtggggacatggccaaaccatatttccatcctygcagaagattctattgaattgcatgtttcaaaatataagcttgttgaggccaaataccttgtccttgctctatttccattacctggaacaatgccaggcatagaccaggtayttagaaaatcttttttgaatgggtgactgaagaaatgaaggggaagatgggtgaatgtgtagatggaatgagaattgtgggagctatcattcaagatgagatttggttggggacatagccaaaccatatcggtaaggaatgttattaattacttaagttaaatgtaactagctccttatggctagtggctactatattggacatcacaatttcatgttatatgcctgggattattctaggtcctggaatgtgcccagcaataaggtcttttggtttcttgcaggctacattccagtgccaggggagtaaaaaattaaatccatcagaagcagctcagattgggacaaatactttgaggataaattgggatggttggatacaaagataatttggggaaggggcttaatcagagtggtcagaagggacatctctctatttttttcttcagacagagtcttgctctgtcacccaggctggagtgcagtggtgcaatcacagctcactgcagcctcaaactcctggactaaagcaatcctcctgccttagtctcccaagtagctggaactacaggtgtgagccaccaaacccagctgatttttgtatttttttgtggagatagagtgttgctatgttgcccaagctggtctcaaactcctggcctccagtgatcctcctgccttggcctcccaaagtgctggggttacaggcatgagtcaccatgccctgccagaatgggcatctcttaaagatgagctgtctcaggttgggttccccagggctcctcctctgtccaagagcagagacagcaggcaggaggcttatcagggagtttccttgggatcagttatggaagggaagggaaggaactgggattggacagagggagaggttgagccacggtgcaggctctacaacctcagcggaacagacgggagctctggatgtagctctttttgagttatctcacttggactggaatagccaggcctttaaacmcmgcattggtcattcgttagttgtggcctaccctgggaagggcatggtttgggcgagggaggccattttgaagctgagaccatctctgatttgggctgaacaccaaaggctgcctgcagacagcactcactggagctgggcagcaagtcctttcttgaagggggatctaggaagcccacgtctatctccatcacaggggcaattccacggacaatgagtgaagggaggaggakactgcaggaagacaaggggtaagagaattccagcacaaggaagacacggaggcggggggaggaggaggagagggagaaggagagggaggaggagaaggaggaggtgaagagggaaaaggagaaggagagggaggaggagaaggaggaggagaaggagagggaggaggagaaggaggtggagagggaggaggagaagagggaggagtagaagaaggaggacaagagggagtaggagaggagtaagaggagacatggaggagaaggaggagaagatggaggaggaggagagggagaagaagagtgaaaggaagaagaagaaagaacaagaacaacaatgtgaatttccatctggrctgagagggaatcagattctgtaatcagttcttgatatctgccatgggcacagggagggaatggttgaggcagtcttgtggtgaattttctaccctctgtttacttcctaatttattcattaataatttaatatgtatctacaaacaccccacccaaatctgtgatttccctcagaagacagagcaggctgtaatgactcctagaggtccctggcctgagagtctgacctctccacactatgagactcgacagcctggctaccaatctttccttccccacacattcaccatcggtctcatcttaggaagcagaaaaggcagatcccagggttaaatcaagactcctttattggtggttatgccgcattctctctacgttcttcacaaaggaccagctgattgaagcaggtggtgcagagggtatttctaaaggtggttatttaagcttgacagatgcaatgaaaaagacaaatctgtgctcagcctcagtatggcggcagtcttcctctgaagatatttctcctttccttgaaaatagaagcaaagatctgagtttaatgaataagtaggcattgactcaaagaggaaggtgaattaaaaatgactttgtattggttttccagacttagtcggaagcagctgagctgagaggaatcagacgcccccacccccacatccctgcctagctcataggagcaaggagatcaatgaacaatgagctcctcaatctcacctctatgctaaggggaaggggacctgcaaagtgccagttctgctgtgatggacagaagtcagaggctggacgctgttcctagtcctagccacagactgaavgccactgtgggtgttttttaatatctaccctgttaagatggtgcccagagttccaaaccccctcctttccctctcctctattccaggaagatgattttcattaccaaggcaaaattcaggaagggcccgctaatttagtgtcatccataagccacatgcattgtaaggacagacattgctagaaccaccagggttttccaccccaaagggaggagggatggggttttgtctacacatctgatgataagggcttctctttttttatttagattccagaagtcacagagcagtgaggtcakttgatccatgcgggagatttaragmccatttctacaggctggagaacatctttcaagcttaaataaccacctttagaaataccctctgcaccacctgcttcaatcagctggtcctttgtgaagaatgtagagagaggaaaagactagaagaaaaggagggataggccaggtacagtgactcacgcctgtaatcccagcactttgggaggccgagttggatggatcacctgaggtcaggagtttgagaccagcctggccaacatggtgaaaccccgtctctactaaaaatacaaaaaaaaaaaaaaaaaaattgctgggcatggtggcacacccctgtaatcccagctactcaggaggctgaggtgggagaatttcttgaacccaggaggcagaggctgcagtgagctgagattgcaccactgcactccagcctgggcgacagagtgagaccccgtctcaaaaaaaataaataaataaaataaagaaaaagaaaaaaataaagaaagaagaaagaaaaaagaaaaaaagaaaagagggataaagttggttctgtggaggtacttgatgaccagcgggctgaggtggggcaggaggcccaaatggtgaaggaagagaaataaaccccatttttcccttggtcagctactcagtgatgggggcaatggatgcacaccatggtgtcttggcttctgggttatccttcctttccttgcttccttccctccttccctttcttccctccctcctttcttcccttcctctctcttttcctccctctctctttccttccttccttcatctttcttccttctttccttcctttcgtccatctttctctttttctttcttagacaaggtctcactctgttccccaggctggggtacagtggtgtaatcatagctcactgcaactcctgagttcaagggatcctctgacctcagcctcctgagtagctggg

SEQ ID NO: 13376 - DNA, 13884 bp, Homo sapiens
tgagacctccaagagagagctccctcccacggggccgcgagctgagccccagggaggcagcatcccgtgcttctgctcccagcatgacctgcgtccatgccactcttcccctggattaaatgacaattagagtgtaggcagaggagctgggcgtgagcgagcaccacagggggaccgcctgtgcactcctgaggggactgtttcccattttatgtccacctccctccgatagcgcaggccatgcagttcatcttgtgtcccagcggcctggatcatgtgtctcagcaattttttcttttctttttttttttttttttttcctgagactgagtctcactctgtcgcccaggctggagggcagtggcacgatctcggctcastgcaagctccgccacccgggttcacaccattctcctgcctcagcctcccgagtagctgggactacaggcggccgccactacgcccagctaattttttgtatttttagtagagacggggtttcaccatgttagccaggatggtctcgatctcctgacctcgtgakccacccgtctcggcctctcaaagtgctgggatgacaggcgtgagccaccgcgtccggccacagttttttgaggcttatccgatttgccatcaggtcaaagccaggtgcaagggaattcccattctctgaaaagggtggccttcaaggccacagagctggagtccaggccaccctgggtgccagcctgcagcctgtcatttgtgagctgcaccatgagggctggaggccaggaaatggcgctctgtgcccccagtgtggggcacctcaagctagcatctgcagygactgtctctttacggccaggagcggacaggtgagcccaccacagctcaacggccaggagcagacaggtgaacccaccacagctcacctgtggactgggaccaggcgaggtcccctctgcggctgctcagcccccggccacagccctaggcacctcagtctggagctgggtttgaactcgcaccgggtggcagtggaccccaggtgtggctacccatccctctggctcttggacactggtgcagaggggcctgtcctaggagggtgactgcccccatgtggtctagtggagaggatgtttggtcaggcagctgggaaggacggccttgctgtgtgacaggcatcgatgggcgtccacgccctccagggacgtcctgctccaggtggttggcactcacgttctcctcgctccccatgcagtgactagaaagcctgtgtgggattctggcaacggcatccgcccgccagcccctcccagggggtgccccagggcctctgccctctgcccgcagctcctcccccacagccacgcttccacccacccgttcggctgggctttgggtgggcaggcagacgtagaccctgcttggaggcggtggccctagagggatccacagatggggaaaaggccgagacacacgagaccactcctgccggggaaaacccatgagggggtgggggcggccgcgccgcagggaggggccctctgctgtcccagccaacgtcccatgacgattttgcacccccgccagcagtgccctcggctggacacacctgcgttgtgggcagccggcagcgcgtgacccactgtgcacctgcgccttgatgtaggggggagaccctgcagagagcgcttccttccgccctgtccagtgccctccctgcctcacccctcttcccgcaggcccgctcagggcgctgaagggctcctgaccgtgggtccgtccttcgctgcgtctggggggcgtcccccgcgctgcctctgacccgcccggccctgcgtttgtctgaagcccctcgttccgcatctccggaccagggtccgggggcgtggtctgctgggggcgggcccgggttgtggtttgagagccgctcggcctgtctgggcctccgcctccgggtcgccctccagccttcctgccgccgcttttccagtcttgcccaacccggtatttctgcgcttgcctcagccacccgcaggagcgcaggccgcccttcgtcctcccgtcctctgcgcccacrggaccccgggccccgcccagtccgcaggtcccgcaggtccccccgggcgtgtcttcctggccctgcgacccccgggacagcgctgagaacacgcggaaggtggggagacgcgcggcgctggccgggtcccwggcgccgttctcgcggtgcagcctgtgcctgsgagtccggccgtcccacctcagaaccagagcaaagcgggagatggggcggcggccgctggggagaaggcagccccgggtcggaggaggaaggaggcgggggcggagcggagtccgcggtggggctgccttcttccatcctcccctgggcggggcgcaggatgcgggggcgcccagccgagggagggaggccggggaggacactcctgtgcccgagggctccggcttcttctgctcactccctcctgccgaacttttccactcggccatttacctcctcaggcactggctgccctcatcaggccgaccaggtcctgcccgagggaacggcgtgtgtgacccacgtgtggacagacctgttccccatgccaggagggagggtcactggctccaccgggggatgggggacgagggcactaggccgaggtggggggcttctcgctctccccgtcttttcctggcgttttcctccattccctctggctcctattccctcccccttcctctctttcttgggtatggttgagcaggtcgtgcactgcacaaggactmccagcagaggacgaggactgacatcaatttgtctttccctcccaacactgtgcgttccctaaccctgcacgaaggcaccctcctcccctcctcaagattccccacccggcctggcctgcagccctagccccaagccgcagctgggcaggttgggcagagcactggggaggccaggcccggccatgctgagcccggtgactcgtcagggtttscacaaaacatcttgagcacccagctgcaggcccctcgggacgtttccaatgaggctcccctgggcccctctctgtggcagaagggaccccggggctgcttcgtaggtctcaacccaggggaggcccccagagactccggagccagggaggggcccagccccctacccccaggctgtgcttggcatgcagagattgcggggggtcttgagtttttgtccccagaagaatggctgagtggactctggagaaaagacaaacacccctgccccactgccgccgccctgtctcccaacagtaagagtgcttgtcagcctcctggcggcaggtgctgcggcctgcgaccacctgagccaggcaggtgatgctaatgcgcctcagggcagccctggcactggagctgctatcatcccactgtacccatggggagagccgctctcctccctcctttttccattctgtgttatttacagagcaccctcctgtatgccctgcacyactctcaaccctgggtacacagatggggctgccacagacgtggccctcaaggcgctcaggccgccttttggggagggccgtgaggggctggaatttttctgagacagccaagcgcccgtgcagagaggcctgtatcagcccagcctaaggcagggccaacccacacaggagcacctgtcctgctggggatgcagtgggttctgctgtgtcctggaaaaggctctacccacaccctaacccaacctgtgaacgcgcgctcatttggaaaaggggcttttgctttgatgtaattagggaaaggatcttgagatggctcatcctgggttaaggcaggtcccacgtcctgagaaggggggagggattatcttttagactgggccctacatccaacaaccagtgtccttataaaccacagaagaggaaaaggcgggtgcagcagagaggccacgggaggagccgccagcccgggaaactgagggctggaagagcctccaggaggacccagccctgaacacgcccagctccacggcctcgtggaataaacttctcccatttcacaccccccagtttgtgktgcatggttagcacagccctaggaaaccagcacggatagtgagctccccgtcacaggaggtatgcaagcagagggtgggtgggcaggggcactgtcgggaggagcagccctggggactccagcaatctgtctttgattcctcccagactgttaaccctgggrcacagcctccttcacccccagaggcccacagcagacaagctgagagccacacagcggccaagaggaggtgctggagggcccaggggtcccagtgctgcctcagccccacccgacttgggagcttttgtgttcagagagactgaggttttcagcttagaggacacctccgtggaacacatctgcaccgcggcaggggaggaaaggctgggggcacacaagcaccctccctcccgccctcaccccgaagctgaggggaccagggcggacagattcccccacctctgatgtggccaggggccctggggactccaggacaaccctcctcaggatgacgtcaaacccccggcattcaaaccttcccaagttctggctgcagctgtccctttccggggaaacaaaggcacctccagcgcccccacccccagccagcctcaccgatcaaggaggccaaaggcagctcccggccccgcttacataaagcttcctgtgtgtgctggtcacacctcacacctcacgcctcayrcctcaygcctcaytcacacctcacwcctcacwcctcacacctccaactcagactttttagcttgaacttttttctcaataaaaccacagaagcccaggccgggtgcagtgactcatgcctgtgatcccagcactttgcgaggccgaggtgggcagatcacgaggtcaggagatcgagaccatcctggctaacatggtgaaaccccgtctctactaaaaatacaaaaaaattagccaggtgtggtggcgggcgcctgtagtcccagctacccggcaggctgaggcaggagaatggcgtgaacccaggaagctgagcttgtagtgagccgagatcgcaccactgtacyccccgcctgggcgacagagtcagactccgcctcaaaaaaacaacaaaaaaaaaaacaacmcagaaacccaacagagacctgaagacgtgcctgcctcccccatctccgggacctctcccacctgggtgaagggggcacgtgagcctcacctgatcttgaccatctcagctaaaacactgaaccacccttggcacccaccagcagcagacggagaagaactgtatagggtgcaaaagygccccgccaccatcaggtccagatgaaaacctacaagttgaatcagcaaggtgctgasggatacrcaagcagaaaccctcttataggaggttcaaggctgggcgcagtggctcactcctgtaatcccagcactttgkgaggccaaggcgagcagatsacttgaggtcagsagcctcagaccagcctggccgatatggcaaaaccctgtctgtactaaaaatacaaaaattagccaggcatggtggggggtgcctgtaatcccagctactcggaagcctgaggcaggagaatcgcttgaacctgggatgtggaggttgcagtgagctgggacagcaccatttccctccagctcgggtgacagcaagaccctgtctcaaaaaaaaaaaaaaagtttgagaatgtcagacaaggcagcaccctgtgtaggtgctcaggttgggcrgagtctctctcgggggaggggggtaacaggacagcgcctcccggggcctccttgcatgtctgtgtcctgatgcacagcaggcgggggctgcggggaccagagaaggaagaagcgcmccagctgggcacttcccgaggaggaagtggtgccggaatttcccccaggtgtggcctcaggtataagagcggctgctgccaggtgcatggccaggtgcacctgtgggattgccgccaggtgtgcaggccgctccaagcccagcctgccccgctgccgccaccatgacggtgagcctctccacatgccgctcggatggatgctgcttggatgtgcagcctggcatggaagggctggggttctctgagcctgggaggagggtgttgggatggggtctgggaaacccctcagtctgggggtaggggaggcagctgcagatcctcggagcgctggcatgctgggtgtcttgggctgaagggctagcctctctgggcttcagtttccccatctatagagggagggctgtactccatctttccgctgggaacaaggaaagctgaggtggaagtgaggtgccycctgccctgggcacctcctaaccacccacctgcctgtttcaccagctcctccccggcctcctgtttctgacctggctgcacacatgcctggcccaccatgacccctccctcrgggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccggtgaggacctggggattccgctgtggcgtggggctgcccctcccctggcggggccctgactgcccggagagctctctgggccttggyggttctcacctgtcaagtgggcgtggccacctgagctccctccctccggccctcctgacctggackgctgagctgctgcttgcggctggccgtgccctgcctsccactgtcctaggtggccagggtcccctggggaaattctgggcccktcacctgagctcctgcagaagtggggctgggtgatgaagtggaagggagkctcctagaggcctccggaccctgctctgtgctcttggagggccctggggagacgtggattaccaccacatgtgagcccgactgcaccccaagcccgtgtggctcagccctcgctgcctcaggtcctatcctgagtacacggagaggggccctgaggggagaggggcctccaggaggacagggtagggccagagactcactgtgcaccccgtcccgcagtgtggacacggatgaggaccgctatccacagaagctggccttcgccgagtgcctgtgcagaggctgtatcgatgcacggacgggccgcgagacagctgcgctcaactcygtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcrgtgtgaccgccgaggccrtggggcccctagactggacacgtgtgctccccagagggcaccccctatttatgtgtatttattgttatttatatgcctcccccaacactacccttggggtctgggcattccccgtgtytggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggcccccgcaggctgcctcttcccaacctccttggaagtacccctgtttcttaaacaattatttaagtgtacgtgtattattaaactgatgaacacatccccagaggccaacattcaatgcgacattctcccgttcagccctggtccaggccagccatggacccaattctggggtgtccttccagaaaggtctacgcagccgcgagcartgcatgcaggtgggactgagctgtagcacgggggggtcacaggtgtccctgctctgcccacacagtgtctcccctgaggacacccctgggaacaggaaccagcctccttcctcaagcagtgccttgagccctatgctttgtaatgatgtgagcgcctaggggcaccctctcggcccccaaggcaagtctctgaggatgaactgcagggctgtcggctcaaggcagggcccccagccttcgtggttcggatcaacatccaaggccaagcgccctccctgawggtgaactagccacgcttcgggacccaggctctgttggagattttagttaaggggccccggggggagcagccccagtcgtggaaagggggcccaggcctgtgacagtctcagggtctcagtctctaggcccccggccccaagggctgacattgccatggggctgctgggcagttgttagcccctcccctgcctggccccctggctcacccacctactgcgtccaggtgcctggagatgggggtgggggtgctgcacagaagaacaaggactccactcagactcccaaagcaagaggcctcagggaagacttcctggaggtggtggcccttgtccaggagatggaattttcattcaacacatttattgagtttcttttctttcttgaaaaagggtctcgctctgttgcccaggctggagtgcagtgtggtatgacttcagctcactgccwcccccaccttctgagttcaagcgatcctcccagctcagcttcccagtacaggygtgcaccaccacacccaactcatatttgtatttttagtggaggcggggtttcgccatgttggccaggttggtctcgaactcctgagctcaagtgatcctcccacctcggcctcccagagtgctgggattacaggcgtgagccaccgcacccagccatatgagtttctactaagcacctggcactgggaacaggccgagaacaaaatggtgaaaacccttcctgcctccacggtgactaatgaaacaagtggtgtgtagtctgtgagtgagtccaggacagaggctctgggggaggggctgcagttcttttttttttttttgaggagtctcgctctggcccaggctggagtgcartggtgcgatctcggctcactgcaagctccgcctcccgggttcacrccattctcctgcctcagcctcctgagtagctgggactacaggcgcccgccaccacgcccggctaattttttgtatttttagtagagackgggtttcaccgtgttagccaggatggtctcgatctcctgacctcatgatctgcccgcctcggcctcccaaagtgctgggattacaggcgtgagccaccgcgcccggccaaggggctgcagttctaagcagagggtcagggaggcctcgaagacctgaaggggaggaggaaggagccaggcagccatgcagggaacagctccaggcagcaggaagagcccatgcaaaggcyctgagaagacacatgctgcgtgtgtccaagggtcagagagtggcctgcgtggctgatgccaggtgagagggggaccgcaggggcagggcagggcgctgggggtgcagatcatgtctgccctggggccatcagaagcttgtggctgtcactggaggtagctgagcctgtgggttctgagcctgcggattctgagccgsaggcactggggtgaggctttgggtttcaatggcagcatcaggatggtttcaggggatgagggcagagcgggaggcggcaggtggcctgggtggggatggcccatgtagctggggtctggatttgggccaggattggatgtggggtgtgggggtttcaagggtgacctgaagcttggtgacctggggggacggctgagatgaggctggattgagacgtctgtatggtgccgagtgttggctggtggggggtggattctgaaggcccccaggaacagaggaccctggctctgaagtgtgagttgctgggagagcaggtggacaagcagcaggcaagggcttctccggcctcaggggagtgggtgccttggcgagagcccaaaggtgggggacgtggctgaygccgggcaaagctttgggggcaccgggctggggtggtggtgaggacctgtgggcaggtgtgtgtgcagccagccacagcctccgcacaagtgaggggaaggggtggccagaagcccctgcaacttggcctgagcgtcctgggcagctggggggccccccagcatcagtgtgggggcaaacaaggccacatccgccaccagcttcaccccagcttctacggaaaagaggcgcagggtagaggctcaccacgtggctccgrccctgttcccttttcacttaacgccagcggcctcctctggaatccaagccccttagggaggcgttaggtgtggagggcctgcagggcctgcaggagctgtcaagggaggactctgctgcctcctccaggcccgggaggacctttctagggaggcacacacctggaatccaggtactatatttcgtggaatatacggtacccgggatttcgtgtgctgctgagaaggaaggcgatgctgatgttaatgaaactggaatgcggcccggctggcaggaaacggggtgcctgcccaggcctcgggaaccatcgctaccccagccccgcccaccggccccaggcagaggctcacgcgctcccggcttcgctgcrtttattgcaggtgggtgcacctggygggagggcaggtccggggcgaggtcacacgacctcgtcggtcaccgggatggggttgacctggggacctcccgggggtccccccgccgccrccgcagcctcctcctcgctgggcttcttgcgggcctcggccgggggcygcggckgggggttgctgggcggctgcttgatggtgcctccgatctgcggccgctcccggggcttgggctcgatgggcgtccactgctcgccacgcacagccrcctgcggggcactgaagggttgagccgcgccccagcgcccgccctccctccctccctccctccccggaggcccaccccgctaggggccctgggacaggctcaagtctgaatcccacrcaggatggtgtgactgccactcagagaggttaagtgacgcgcccgaggccacacagccaggacctgggtcggcctgacaccagcccaagctatttcttcatgccaggagtggggcccgaacccctgggcttctggaagatcccgtggtggacactcccagatgcaaattctagtactcaaattctcctctcaaggtgccaagggcagggaaggcagggaggcaggcccgaggtccagcaggaggggtggcccaggagagtagcaggccctgctccgtctggtgggcgccattcacccacgctggccggcagccccccaagggtgcccaggcatttctgcacatgggggtggtggggggagagcttgaagaccacgggattccactggcttttactaaaaatacagactcctgggcccatgcccggaggttccactgcaacaggtcaagtggacctgggagtgtgtgcttttcatcttctatcccataatatctggtggaaaaatatgtcacatcatatacgtcatgaacagaaagagaaactggacatgtgtgatcctacctgactccaaaacggaaacattccattctgaaaagcaaaactagaaggctgatagaagaaaaggcaggaacgtgaaggcaggacccagggccagggaaaggtgttttcacaaagcacagaccatagagcaggtgaacagggaaacctctgctcttccgtgcagtgaaggactccacgsgccaagttaacagaccctcaccagaaagcatgaaggcatccccagtgtytaaagkttacaaaggctaaatagctaaaatatatgtggacttcctgcaacttaagaaaaagacaatcaggccgggcgcggtggctcacgcctgtaatcccagcactttgggaggccgaggcgggcggatcacaaggtcaaggagatccagaccatcctggctaacgcggtgaaaccccgtctctactaaaaataccaaaaattagccaggcatggtggcacgtgcctgtagtcccagctactcgggaggctgaggcaggagaattgcttgaacccaggaggcgaaggttgcagtgagccgagatcacgccactgcactccagcctgggcgatggcgcgagactccatctcaaaaaaaaaagaagaaaaagaaaaatacaaaaaccacaatagaaaaatgggcaaaggatttgaacaggcaactcaagggagaagaaactccaacagctcaaatccacagtcagagaagggcgagtccaagctccacacggccagctcgtgctgtgaaactggcaagcgtgggagaaagcctagtgcatggtgggagagatggggccacatggctggtggtgggttgtctgctgrggagcagctgagcccggcagggtgaacggtgcagaggctgatgcctgacccagcaattcctctctgggtttagcacaaggaattcctcccgaggtctccaggagccactagctgtgcgtggcagcagggagacgggggggatgcgggtggcccccggaaaacaaagcaacagcccagatgagcacttggcaacaggaaggggttctaaaggagagttctgccggtggcaggtcagtgaggcttgaaacagaactccacttccatacgcggaaggcgtacacagaaagtgctgcacctttcccacgcacacacactagaagacgcacagcaaggggagggcagttgcctctgckggcaggagggacttggctctatggacaaaaggatttaaataagcaaagtctgagggctctgtccacccagagacccccgcagtgagaggtggcctgcagccgtctgttccggagcccagggcaggcagagggcatttcacccaaggcctggccaggctgcgccctgtcctcccacccatccctggcctctcagagagatcactgtatcccatgggatgggcagccttctaacagggtgcagcagtcataaaccaaacgcaggtgtcggcagtttaagaaaatgtctgcgtcctggcaccgcccatgaatcagcgcgaatagggtttaggtgagaaaagcctgataatgggacccaagcgcaggcacggtcttcggccggctgcgtgaccccaggccagtcacagcacctccctgagcctccgcatctttgtctgtaaagtggggaccccagtacccctcccagggctgtggtgcgggttaatgaggaaatgcaaggaaaygacccgacacactagacacgccaaaaatggcagcagcaaccgctgcgtccccgccgtgctgtgagcacacgcccaggctcacacttgctcccagccttggctcagcctacagagccggcttcaagggccatgcgtgtccgagggtgtcagggcaggggctggggatgggggtggccggggccgacctcagagggcgccactcaccagtaggtagatgcckctcgcaatggccaggcaggcggtcccaaggatggtggccagcaggaagccggcgggcaccgagagcctgggggacagcgggtgagaggcagggacacagaagggcactcagaaaggggaacggagccccaggtctgggggccaaggccacaaagtctcaggacaaggcagactgcagacccaggggacgtgygyggaccggggcttgtttcggtcctgggtgttctcrgccttgatgtggmcrctagcggctctggtgcacttgctcggaggaagcagccacgtgtgggtgtcctggcctcagccggcagtaaccagcagacacacagcacggaaccctccacc

SEQ ID NO: 13377 - DNA, 23208 bp, Homo sapiens
  misc_feature (1)...(23208): n = A,T,C or G, or insertion/deletion polymorphism (see Tables 1-2)
ccagctgatttttgtattttttagtagagaggggggtttcaccatgttggccaggctggtcttgaactcctgacctcaagtgatccgcccgcctcggcctcccaaagtgctgagattacaggcgtgagccaccgtgaccggcccctttgactttgaaggcagagtagggtatctgatcaggaccgcaaatatggtgctgctttttatagtggggccagtgtgtggggtgatatggtgggaggagctgcaggaagacagcggattgagatctggactcaagcagtcctgtggggaagccaggtttctctactgactcttgtgtagaggagaagactaggcgtggtggctcatgcctgtaatcccagcactttgggaggccgaggygggaggatcacttgagcccaggagtttaagacaagcctgggcaacatagcaagaccctgtttctacaaaaaaacaaaaaaattaaaaaattggttgggtgtggtggctaagtctgtaatcgcagtacttcaggaggccaaggcargaggaktgcttgagcataggaggccaagtctgcagtgagccgtgaccttgccagtgcattcagtctgggyaacagagtgagaccctgtctcaaaacaaacaaatgaaaaataaaaagtaagtatctaacgcaggaatagraaatcaaatactgcatcttctcacttataagtgggagctaaatgataagaatttatgaacacaaggaaayaacagacacgggggtccacttgaggggggagggcaggaggagggagaggagcagaaaagatggggggagggcaggaggagggagaggagcagaaaagatggggggagggcaggaggagggagaggagcagaaaagatggggggagggcargwggagggagaggagcagaaaagatggggggagggcaggaggagggagaggagcakaaaagataactattgggtactgggcttagtacctgagtgatgaaataatctttacaacaaactcccgtgacatgtgtttatttatgtaacaaaccttcacatgtacccccaaacctaaaataaaagttaaaaaaaagtatcaaattgttaactcytctggaataaacatttccttgtctttttttaatttaaattattatttttaaaatgcccatattccctgagtcctcgcttctttttacctctccaatcgcctggcttcatggtgtttcacatttgctgactgcttccagaaaaacattcccactgaaggcctcccaaygcaaggcagatatagagcaagctagacacatgccttcctttccagttgctttctgactttttaaagtcccagatgcctgggcttggggaaaggacaggaagcgccaggacgcaggaagccccggggatcagcagtaggatgctgtgcaggctgtgctcggggcccctctgctggcctgtccaggccaaacccccagggctgcaggcctggaaccaggcaggacatgctcagccctggctgggcttcccctccttgccccaacaccaktcagggcccacccacgggctccagctgtctggcttcccattcatctcccagaccctctcccctcatgaatcagtgccacacacagcctacccataccatactcagcaaagcacccatgcctgtggctcaggtgcggtggtgtgatcagagctcactgaagctttgaactcctgggctcaagcgatcatcctgctttagcctctctagtagctgggagtacaggtgtgcaccactacggccagctaattttgaaaaaatttttttgtaggctggatgcggtggctcatgtctgtaatcccakcactttgggaggcctaggcgggtggatcacgaggtcaggagatcgagaccatgaccatcctggctaacatggtgaaaccccgtctctactaaaamtacaaaaaaattagctgggtgtggtggtacacacctggagtcccaactacttgggaggctgaggcaggagaatcacttgagcctgggaggcggaggttgcagtgagcctgggaggcggasgttgcagtgagcctgggaggcggaggttgcagtgagccgagattgcaccactgcactccagcctgggcaatggaacaagactgtgtcttaaaaaaaaaaaaaaaaaaattttttttttgtggatatggtggagtctcgctatgttgcccagactggtcttgaactccaggcctcaagcagtcctcccaaatcccaaagtgctgctgggcttacaggcatggaccaccatgcttggcctattttcgacacacatacaggctgaggttcaggagagctgggctacaggcgtcagggtggggatcgatgtgtgacatctttcagggaggtagtttatcctagttctccactcaataagggagtctgcccacaagcacactgtcggcacccattgctacatggctcaactgtgagtataacttagataattgtaataatgaaaataaggaatgctgatggagggataggataagaaggtatgtgactgggagatggaagagaattccttatttctattgagtcataatcaatagaggttatctaaaacttaaaaaaatagggccaggcacagtggctcacgcctgcaatcgcagcactttgggaggctgaggcgggcggatcacamggtcaggagatcgagaccatcctggctaacacagtgaaaccccgtctctactaaaaataacaaaaaaaagtagccggtcgtggtggtgggcgcctgtagtcccagctacttgggaggctgaggcaggagaatggcgtgaacgtgggaggcggaggttgcagtgagccgagatcacgccactgcactccagcctgggtgacagaccgagactytgtctcaaaaaaaaaaaaataataataataataaaaacgccaggcatggtggctcacgcctgtaatcccartgctttgggaggccgaggcaggcgtatcacttgaggcaaggagtctgagaccagcctggccaaacatggcgaaaccccgtctctactaaaaatacaaaaatttgccgggcctgctggtgcacgcttgtaatcccagctacttgggaggctgaggcatgagaatcacttgaaaccaggaggcagaagttgcagtgagctatgattgcccccctgcactccagcctgggtgacacagcgagactctgtctaaaaaaaaaaaaaagagcagcctgggcaacacagtaagacctccatctctacaaaataaaaaataaaaattagtcaggagtggtggcacttatcacagctacttgggaggctgaagtgggaggatcacctgagcccaggaggttgaggctgctgtgagctgatggtgccatcgcactccagcctggacaacagagtgagaccctgtctctaaacaaaaataaattgtttttttttctactggacttaaacaatctgccctccttggcctcccaaagcaccaagcctgtgtcttctttttcatcacagccgtggcagaaggaaggaggtgactggaagccccactctctctgagtagctgagggaatacaccctgactataggccgagacagtccacatcagctcttcaataggatttagtggctttgcataaaatggaaaagcagctgtgattgcaagagaaattaaaaataaccaccatctgaaatgcaaattgaaaacagtgagacaacacatgtcactctggcaggtgacccactgtgctggtgaaggcatgcaggcactctcagacttccgcagagagacctgagtaatcaattgacttccacaaagggcgacttgccaacagctatcaaaagtactcaggcacatcccacttggcccagcaattccacttccaggaatttctcctgcagaaatacatgtgcacaaacaacgtaggaaagcactgtttatagtaacaacccaactaggacagaccaggtatatttagacaacaaacaaggaagctttttactaaattgggatgatctctaagaagaaggtacgtagaaaaagcaaggtgggagaacacgctatgtgcttgtactatgcacgtcaatgaaaaaatacacaaagaattgacaggccaggtggagtggctcacacctaatcccagtactttggaagactgagatgggagggttccctgaggccaggacttcaaatcagcctgggcaacatagcaagacccccccacatctctacaaaaaaattaagaaaaaaattagccgggcatggtggtgtgtacctgtagtcccaactactgaggaaactgaggtgggaagatcccttgagccaggaggtcgaggctgcatggagctttgatcgtaccactgccctccagcctgagcaacagagtgagaaaaaaaamagactttttttctatttctggaaaaaaataaagaatttataagtatgatggttctggtaatagaagtaggtggctaggcagagtggacacttcacactgcatactcccmtattttccgaaatctgagcttttttttttttttttttttttttyttttttttgagatggagtcttgctctgtcaccctggctggagtacagcagcaccatctcggctcactgcaacttccgcctcctgagttcaagcaattgtcctgcctcagcctccccagtagctgggattacasgcgtgcaccacacgcccacctaattattgtatttttagtagagacagggtttcaccatgttggccaggctggtctcaaactcctgacctcgtgatccgcccacctcggcctcccaaagtgctgggattacaggtgtgagccaccatgcccagccaatctgagctatttaaaaactaaaggtaaaattttaaaaggggaaggggaaaatgggaagtcattgttttaaggggacagagtttctgtttggggtgagaaaactctagaaatagtgggggcgtggcacatgattggaatgaatggcagggaacggcacgcttaaatgttcctgtacgtttcacaggagaagtcaatgcacacacaagcgccgcaacccagtccaaggctttgctcctacagggccttacagggggtatttgagacgcccaccttaatgcaggttggacccagctccgggctgcsgggcttccccgccccggggtctttcgtgtgagccccgtggcgggggaycctggcccaggacatggcgcggagaaggctgtgggcggcgggacagggtgccttcggctgccgggttaagagtggatcccgggatacatcctccagcgcctgccctcgggcctgtgtgcacccccatacccagcggggccgtccaagagcttcaaggagggcacagcgcgacccgccctcccctcagccccgcacaccgtcccacggccccgcacagcctccctcccacacagcgccccacggcacccrcacagcgccccacggcacccgcacagcgccccacggccccttcatggtccccgcacagcgcctcacaacccgcacacagcgcctcacggaccctttacggcccccgcagagtctcccayacggcgccccacacagagcctcacggaccccgcacagcgcctcaaggtctccgcacagcccccagcacagcgcctcacacagcccttcgcacagccccccgcacagctcctcacgggccccacacagctgycgcacagcsccgcacaagcccgcacagcaccagcagacaggtagcccccacaggyaacagcgcccacctcgccgcgcccagaccccgratcrccgacgcggacgccaggcgcctgggcacacggcgcctgcgcagacaacaccacgccccaggcctggcgagcgcaycctgcgggtggggcggacctacgtcagcaacccatcgtmcgatcccgtccattggctgrgaggkaatgcgtgcgcccgactcgccgctgattggtcggcgcgcgagcagccgggctcgcacgggccaatcstgtgrtagcgcgtgaggaggcagaggcctctggggtgggatcgcgggccgtaagtggctgtggagctggggtcactgcgcggtgggaccatggcctcggagaagccgctggcggcagtcacttgtacagcgccggtcaacatcgcggtcatcaagtactgtgagtgccgcgggccggcctgggacggggatggccgggagcgaggccgggtacgcgggggtcgcgcgctgattcggcggcgcgctccgtcctgccctcccagggcctcgacagacggggaaactgaggctcagggaggggcgcggcggtggtcgggcggggccgcgcgctccttcgcgtgacaagctcggcgccacccgttcccccgcgacggctgccgcccctgcagggtcgcccggcgcctgcccattagcgattaccgaactatcgaaatcatcaatcatcgattcccatgaatcgtaagaatccgccgtggtggtgcgcgtttgtggctccagctactcgggaggctgaggcgggaggatggccagagcccgggaggtcgaggctgcagtgagcggaaatcgcgcyactgctcccccagcccgagaccctgtgtccctccctcgccccgtttctcccagcggtaacctccaaggagcggtaatggggggcccgcaggcccacatccgtgcsggggaggccggtccgcacctgtgcgttcacagccccgcccctcccctcgcgccggggttacctggccgccactgaccactcatttctgtaacgtcatttcaaaatgttctgaaactggaatcgcagttatgtggcccacccagtatcttttgagtttggcttatttcattcagcatagaatgtggacgtgccccgggattgtatcagtgctttgcccctctgttgctgagccagtccgtggaatccatggaccaccctctctctagccaaggcctcaccccgcaaagagcatctaacgttttctttctttctttcttttctttccagaagccgccaccacgactggctaatttttttgtgtttcccttaccaataaagctgccataaaaygttgtatacaggtttttgtgtgaacatacatttccattcttctgggataaatgcccaggagtgcggttgctgggtcagatggtagatatatatatatgcctctctgtctctctctctctttctatgtatatatgtatgtttgtgtgtgtgtatatatatatatacacctatatagatatatgtgtgtgtatatgtatacacctatatagatgtatgtgtgtgtatatatacatatatatattatatatatactttttttttttttaaagaaactgtctaattgtttttcagagtggctgggccattttgcatccctacggtgatgcagattttccgcatcctcaccagcatttggtggagttgctgtttttcattttagccgcgtcctggtagggatgtgctggcagggtgctgtggtcctcattcgcgtttccctgttggccagtgacgtggagcatctttctttgtgcttatttgccatctgtgggttttcttggtgaaatctctcttcatattctgtgtccacgctcgaactggatggtttgcttttttactataagtttggagagttcattacacattctaggctgggcacgctggctcaagcctgtaatcccagcacttggggaggctgaggtgggcggatcacctgaggtcaggagtttgagaccagcttggccaacatggtgaaacccccgtctctactgaaaaaawataaaatatgtattctagatattagtctcctgttggacatgtggtttgcaggtattgtctcccaaactarctaatctttttgtcctcttaacaaagagccagtttttcattttaaagaagttcagtgtatcaatgttgatgtcaagtctaagacctctttgcttagccctatgtcctgaagattgtctgctttcctccaagttgtacaggattgccttttatatttaagtctgtgatccaaggttgtccagttagcccagaaaggctatccttcctctattgarttgcttttgcacttttgtaaaaaaaaaaatcagctgggcatgtttgtgtgggtctatttctggattttctcttctgctatttttttttttttttttttttttttttgagacagagtcttgctctgtcacccaggctggagtgcagtggcacaatcttggctcactgtaacctccgcctcctgggttcaagcaattctcctgccttagtcttccgagtatttgggactacatgcacgtgccaccacacttggctaatttttgtatttttagtagagatggggtttcaccgtgttagccaggctggtctgaagctcctgacctcgtgatctgcccacctcagcctcccaaagtgctgggattacaggtgtgagccacsgcgtctggccttttatttttattttttatatttatttattttatatttatatttttatatttatttgtattacttttatatttatttttttgagacagactgtcactgcgacacccaggctggagtgcaatggcgtgatctcggctcactgcaacctccgcttcccgggttcaaccgattctcctgcctcagcctctcgagtagctgggactacaggtgtgcgccaccacacctggctaatttttgtacttttagtggagacggggttttgccatattggccaggctggtcttaaactcctgacctcaagtgatctgcctgcttcggcctcccaaagtgctgggatcgtaggtgtgagccactgaggctcaccaacagtgatatttatggaaacgtgtccattttcttgtaacgttcmaagactctggtcttctttaaaccttacgtttgagctggtttttgatagcgcgctggtggaggagggggtgctggctcaagataaggaggcagaagtccaggttcccctycccaccaacgctgtcccatccccaccaggccctcaggaattcctgagtgtctgcttggcctctgacaagagccggcaggtcaggggagtccagtctcccgtgtgctctccaatgactcctggggaggtgaaagtccccactccttcagggagggaaagggggcggggcactgttccagcctggagtgtgggagggatctgtttctttttttcttttctttttttttttttttgagaaagggtctccctctgttgccaggctggagtaaggctggagtgcagtggtgccatctcggctcagtgcaacctccgcctcccaggttcaagcgattttccckcctcagcctcctgagtagctgggataacaggcgtgcgtcactacagcctggctaatttttgtatttttagtagagatggggtttcaccatattggtcaggttggtctcaaactcccgacctcaggtgatctgcccacctcgacctcccaaagtgctgggattacaggcgtgagccaccgcgcccggccaggagtctgtttctgtgttgctaggctgcccttcctggtcctgctagggagggctggstttggttggcagttccagcttctgcagggctaggtctagggcaagcagaaaagaaagccccgggctccccctgcactgtcccacagccgccctctgtcacccgtgagagtctcacctgtgatgtccagggtctcagttgtccccagtgggaggaagcgggagaagtcccctggcccaccttcctgaaagcagaggttcgcccggcctgtcagggcagcggcgtccgcctgcaaggagggccgctcagtgctgtgcgtgaaagagcctcgcgagctgcagggcgtggttctctgccaggtgtccgcgtttatcacccctggaactgtccgccatcctcagagacctcccctcgcacaaaaccgagcagatggtgtgcttagcgaagccgccgtggaataagacttcagctgaagcaccacgcagcgctcccagggcaaacgtttcctttcgggctttctggaagtttgatttcacgtgctgtcccatggccgtgctgggcagaaaggggtttatcctggatgttcctggggcatatgagcagtgagatgtgaggagttctcagagctgggctccttttgtttgggaaggtggaggggaggcaggccgcggtgggagcgatscgcacctgggcactcacggatgctggagtagaagcgatgaaggaatggggagcggggacggaggttggctggcctccagctctgctctgggagcctgagctcagtggggtgggagcagttcttgcaggcckgggtctggcaggaggaggggcacacaggttgtgcggtgagagacgggactgaggcggatgggggccgtgggtggggggtgggggcacctgtggggaacactgggggagggtgggccgggaagcccaccggcctggccctggctgttcattacagggggcaagcgcgatgaagagctggttctgcccatcaactcctccctgagcgtcactctgcaccaggaccaggtatgtgtggactgacgactaaacaccacagtgccatttccagaacatttgtagaacagttggtacccgttgggtatggtggctcacatctgcaatcccagcacttggggagagtctcttgagcccaggcattggagaccacagtgaaccatgatcgcaccactgcactccagcctgggtgacagagtgagaccctgtctctgaaacaaaaaaaaaattggtacttttttacctaaaggctaggatgagatggcctagcgacgactcccagccagcacgcagtgtctgttccatctcccagtattaggagagctgagcacagcacacaygtgcccccaggtctcgtcacacatgcgcacaccgtgccccagggsctcccctgggagtccccgtctctttattcaggataaggcctggttgctccacaaggtgtggcccacgctttcatcccccacgggcttccccactgcccagctgagactggcctttccccccctgccctcagcagggctgaccttgctcgagtgggcagccatgaggctctctcagtagaaaggggtacctggctggcatcggtcctcartgctggcctctgaggtggccctgggtttccttttcagttaaaaaccaccacaacagccgtcatcagcaaggacttcaccgaggaccggatttggctgaatggccgggaggaggatgtggggcagccgmggctgcaggcctgcctgcgggagagtgagctggggtccccataagcccatccctccctgttgtcagcagggwccgagcatccagaaagtgcttytgcctctgtgcccctcctgaggcagcaggcggggtggctgggaaccagacatgcccgctgggccgccagctccagggcagtggcccacctcaatgaccagctgggcttgggtcagtctggggttttcccgggtaagaaactctccacgaggagtctggcaggcagaggcctggtgttcagctgtgaccccgggcaggtgggcaggagcagggcgggcagggtgctgayrgctgggccacacgctgtctcattgtctctgcagtccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctaggtgggtgcccacagagacccgcaggggttctgggctgtgggcgcaggagccacttcatgctcttcccgggtcagggagcccactgctgggcgtggctaaaagagcatcccctcaccccaggcctccctggcctctctggagttgttcagtctcttcccagagcacatctgaacattttcatcttccagttgcagctggcgtggggctctcgcctrtaatcccagtacttaagaggctgatgggggagaagcactgtaggccaggagttcaagaccagcctgggcaacatagtgagacccccccccatctctacaaaaaataaaaaaatcttcccgttgctgtatgtggagcccctctagattgtcagtgatagaaaccacttcaaactggctcagccctaaaatagcgatgattttgtggctcacgtaactgaggattccaatgggcacagctggttgcaggccccgctggacccagctctctgctggccccaggccacttgctggcagcttcccacccactgtcagagcctgtccccccggtggtggtctcacaccatcttcacccctcaactccaggggtgacgcttcctggcccacctgggctcctgygccttccctgaaccaccctcggtgaccagggtgggtgaccagacctggaggtggggttgccctgctggagccctgtgggaggaggggagaaggtggctcccgtgctgggtgggcagggggcgcgtcttgtggagtccagctctgtcctggcatcggtccctgccccacacagccttaaaattccttcccaycctcaaagcccagcttgggtgtcctcgggggcctttctcccgccttccatggggcttcctgctctgccgcaggtaccttttgttgcccttgtcgcaggccgcaagctctgcaggccgtgaacagagagtgtccgagagtggaastagcggaggtgggrgacagacggctgggccggtgaatgctggcctcaaaggctgatggcccagaagccctgtcatctggaaatccccatttgccgtggggtgtgggacgttcctggggcggtgagctgtcagggagcacagcgcaggcagctctgaggaccctccctgaatccgcatgcctgcagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagtggggtggggcgggtggagcagcagcccggtggcctctgtccctagtcagggctgctgccgggagcaggagcgaaggcgtccatccaggctttgcttggctcctggggtcagcrggggctgaaggaacagaagcgtggttgagtgctcaggaaccgctcccatgcggcgggygccaccacccgctgggatctggaagttgcccctgcgtcacccctgctgtggccgggaggcctctgtggtcaggcaggtggcactgactcccacccccgctgcctgcattggctgagggagggccgagtgtttgaggctgaggtccttggggctggccccctgcagggtgtggcccaggctgtctctccctcgtgcaggtgagcgctgagaagaagctgacaggcagtaccgtgggcatgcgggccagtgtggagaccagccccctgcttcgggtaaggccaggagcgggtggtcccggggccctgggagtcacgcttgtgcccrgctctgccctcagcctctgtctgggcccgagtgttctcacacctgcggcagccccgccaagaccacgtgcaggagccaaatgcagagatggggctcgagccgggcctccaaccccggagtctctcctcgaaccctctgctgtcgagacccccagcggctccatgggaaacaccctgtgccttgcagttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcmatgccatctcctggcgcatcatccacctggtgcaccgcttcaacgcccaccacggggacaccaaggtgacgcgggccgggagggcagaggctgcgctcgcgctgtagcgcgtgtctaggcttgtgctgccgtgragacggccccggggctcgcgtgcagggcaatctgtgtctgaaagctccaccctgctgtgtgcgaagctcactgaccatctgggttcttctgtttcattttgtttcttgacttgcccgggtcacggccccaccaccttcttyctgggttcacaggcagacgtgtcaagtaccaggcacttggggtcacagctccactccagtgtggccctgagggcctagactgagctcttggagagcccaaggccgcctggcagaccagagggttggggagacaagggtcaggcaccacgtgaatagccagggtgactgctgtgggttccaggtggcgtacacctttgacgcgggccccaatgccgtgatcttcaccctggacgacactgtggctgagtttgtggctgctgtgtkgcacggctttcccccaggctcraatggagacacgtgagtgtggaccccgcccctcctcctttttgggagatggtgccaggaactctggtcggaagagacggaggcacctgaaggctgtggygctgagacagggagtcccagggcaggcagcagtcccccgagtgtgggagccacgggcagggtgtccccatagagccatcccacagcccacgtccacagggaagaaagagaggccgctcacgcgtgtgtgagcaacgcccaggrtctcccacctcctgagtgacagcgtcccctgcagctcgggaccccgcaggctcttattctatagaacagtggcttaggaaacacgcctgcactcccagatgtgtgcgtaagtgtccgacattttgaaggaaaggagtcaaagcccctgatttccttcttactgaagcgagttagagccagtcaaggcggcygggtgttgaccccgccccggcagttgggtgtcttttcttgggtggggtccggcagctgcatcttggygccacagagccsccatgtacgccctcctcggtgcacagcttggccctgaaccgcctcttcccctgcgctgctctgtgggggtgccacagagcccccatgtacgccctcctcggtgcacagcttggcccagcctccttacgccccggggctgttgatttcttccctcccgtgttttcatggtgtcttattctcaatgtgagaggcgcctcccatttaagggtgtctggaagcgtgtggggatgtgcgtctgtcccgggtgggagcaataacaccttctaatggtcaggggcctgccctgtggggtggactcagacccacaccccaggactgcccgcctgggaagcaccaggctcgtggctgctgctccgggtggggcttgcaggcttccgctgttytgcagaacacggtgacgaacgcaccagcttgaattgggcgcttccctgagctgttaccccatggggcttggcagcacccttggccagatgtgggtccagcctgggcatagctgtttaccacataacctaaaatttcctgtcycagccattcgagagcatataatcctgcggtgttgaggacattcacagggtcatgtgagcaccacctcaagccacctccttaactttttcatcamccctaaaagaaacctgtccccacagcagccacctgcygtctccccctccctgagccctgacggccaggaatgcacttcccatctctggacttgcctgttgtasactgttgtagacgcttagagaaacggatgcattcaccgtgcccctgccctgcktttccaggtttctgaaggggctgcaggtgaggccggcccctctctcagctgagcttcaggctgcgctggccatggagccgacccccggtggggtcaaatacatcattgtcactcaggtgaggcctggggctcacccagtaccccggggtttcctttcctgccaggggggcccgcccagcccccagggcccttaaaggcwaagcgcggctccctgtccctaccgtgtctcaggcaggaagccagaacgcctttgtccattcatttgctctcaaagtggacattacaggccactggtgatgctcagagcagcagggctgcgctgagggtgggagggtgagtctgacacaggctcccagggagacaggtggggagtatcagacccttgaatagggagcgcctgggtnnnnnnnnnnnnnnnnnnnnccccaaccaccccagcagaccggggttcctgccctctgacctgctccgagggccaagcttgcatccagtgatcacggccgcccaagccattgccgccaccttcctctcaggggctgcctgttcccaggctctgtggttctctgtcccccctgtgacagaagcagtgcccagggcagggggctcgcagctggcaggggcggctgtgcctgcaggagctgcgtgtgggtgtcaccactcaggcgctttaccttctgaccaggacccacaggaagggcgggggcacaccgctaccctcctgtgtccggccctacagatgctgggcacaggatgaggcgctgccattcctggtgacctgacatggatttctatccccaggtggggccrgggcctcaaatcctggatgacccctgcgcccacctcctgggtcctgacggcctgccgaagccagctgcctgactgcctcagcagggascgcatgcygcttggagaaggggtggcctcgccggagctagggagcggatgtrgtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcacygtgctgggagcagcctccttgggcctcaggaaaccaccaagtgcctcggatggtggctgcccacggcgcttytgctgagaccctgcccccggcccaggtgtctcggagggtggctgcccacggcctgggtgtggctggaatggtggcaggagtgggcaccagtgcggccccggtggccatggggaataaaccagcattrctgcctccggcctccgccgtttttctgtttcgtaaaccagcatcccggggttcctgctctgagtgaccctggcacctstcagggagtccaggtgtgccccatgagggcctgggggaggggcaggctgggcagagccacagaggggctcccctcaaaccccacattggctcaggtgggaccctcaggagcaaccccaggtctaaagtcttcccatgggcgctgggctcaccacccccacgccagcccctgcctcccgtacccaggccggacgtgacggggccgtccctgcattctgtgctttcccagttgtacacatcctgtcccctccctcgagtctcagtcacagttcagtgacctggtgacgggaggccccctgcagtgtctgacccaggccaygcctgtgccagcccagagccagggggaggaaatgggggctgggcctctggtccccatggggaggccacccttgtccttggtagcatcagggtgcagaggtgttcccgggctgtaggggtgactcccccaccccccaaggctctggagaggccgatttgctcaggaagccgaccttcacaccttgtcctgctattaatagacgcctggttgacacgggaccctcggttgggtccggagcattgggcaggggcacttgtcagtgtttgagagctgaagtttgggaagccctggggaagcgcaggaactccccgcctgggctggggctgccgggcagggcccctcctatgcctcggcgtggctagagagggcgggggcagaaggctccgggacagccctgcaccctacagatgcgggtctccgcccagccgcggtcacctggggggctgggggcggggcctgggcggggcggggttcggccgggagcgcaggggcggcagtgcgcgcctagcagtgtcccagccgggttcgtgtcgccatggggyagatcgagtgggccatgtgggccaacgarcaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagygcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacgggtgaggctgggctcaggcgaggtctgagggcagaggcaccactgcagcagctccaggaaggacctgcaccgggggaggagtgcctgggaagggcctgggggctgagggtgaggaggaggggcccgcygccaccactcccctggggctctgagcgccctccctgttgtctggagggtgcgtggcagctggagtgggagcagagacctcagggtgggagggctggaggacggggccctgcagcctgtcctgtgcccaggaaagtgacckcctgcttcgagtcagcggccaagaagtcggtgggtcagttcagacagctctycccagagctgccccgtgagactcaccctgcctgccccgcactccctacaggaagtagacggactgagggcacccagctgggagccaggagacctgggctctagtctggcctcctgctgaaaccctccaggggctcctggcccgaagagttagagccagactggacgccctgcactgcccgccctggcctcccggctctccggccccctcctccagctgccgtgcttcctttctgttcctagatctcctgagcgtgccccagggcctcggcacaagctgctgcttctgcagagcctcatggctgtctcatttatttctcaattcaaatgccacctgcctggggaggtccttccagaccgtgcagccccaggaggcagctggcccggagacagcagggccttgacaaagagtcccccctgtacacagcaggtgctctgtaaatgtggctgggtgccagaatacgtcctcagacctccctggtggcaccagcggcagctttgcaccctctttcggatggcaggctcgggaccaggacggtccccaaagatgcatggacaattggctgagtagactcaaggacactgccctcccctcctccgacgcagacagacaaacccagagagttaatgtgtagctgggctcaaaccaaggataggaaatcttccaacaagaccatgtggagacaaaaacagaatggctggcagggcaaggtggctacacctgtaatccyrgcactttgggaggccaaggcgggcggatcacgaggtcaggagatcgagaccrtcctggctaacacagtgaaaccccgtctctactaaaaatacaaaaaattagccgggtrtggtggcaggcgcgcatagtcccagctactcgggaggctgaggcaggagaatcgcttcaacctgggaggtggaggttgtagtgagctgagatcacgccacggaactccagcctgggtgacagggcaagactctgtctccaaaaaaaaaaaaaaaaagaaataaaatagtaggaaggaccaggcgccgtggctcatgcctgtaatcccaacactctgggaggccaaggcgggcggattccctgaggtcaggagttcgagaccagcctggccaatgtggtgaaaaccctgtctctaataaaaatgtaaaaattagctgggcatggtggcgggcgcctgtagtcccagctactcaggaggctgaggcaggagaattgcttgaaccctggaggcggaggtagcagtgagtcgagatcgcgccactgcactccagcctgggtgacagagcaagactccgtctcgaaaaaaaaaaaaaacagtaagggggaatattggacaatacccccccaaaaatgtgcagaaatagccatatcagacgaaaccgaaattaaggcaaaaccgctgacgggttaagaggaactccgtatcggggggaaaaagacactcccccaagaagatgcagaaaccacactcggcctgttagctttcagtgcatcaaacaaagactcatggtgacaagggggtccatttgggggtcccagagcccactggggcytgcaggtcgggctgtccttggccactcctgggacccagagcccgggcatgtccagcaccccctccgccagcccgtgcgccacaggctctgctcttcaccagtgcagaggggtgcctcctgggggtgtccccgaccctgtcactgtgctgtggggatgggtagggggcagctctgggtggcctggtggcccacagtaggtagagaaggggggtggcccaggcccccgggacrggagccccacagtgcctgacccacttctccccgcagtcctcatcaccgggggcatcgtggccrcagctgggcgcttcacccagtggtactttggtgcctactccatgtatccttccacctgaggctggggtgggcggggaacgcccagggcagagctggggagccacttcacagtgagctgtttgcctccgctccccaccaccgcagccaggctgggacacagggtgggctgtgcacgggttgggcagcccaggccccagcagccaggcccctcgccaggaccatgtggcgatcagcggcagacccgccagtctaagtcctggtgagtggtgggcagggggtgtcaccagagggccagggccagcactgaggcctccctgttggactgctgggatcccctctgcccgctcctgtcagtcatcccccttgaccggcccctctacctcctctgccccatctcagccctgccgcccagccggaccttgcgacaaggagcactgggcagggtggtgggagggagggcgtgggcagccccgagtgccagacctgttggaacctcccgtggctgcctcctggctctgtgacctcaggcagtggctgcccccgaccttttttgagacagggtctcgctctgtcccccaggctgcagtgcagtggtgcagctgtgactcatggcagcctccacctgggctcaggccaccctcttacctcagcctctggagtagctgggaccacaggcacacaccactgcacctggcttttaaattttttgtagagatgagggtctcactatgttgcccaggctggtctcaaactcctgggctccagtgatcctcccgcctcagcctcccaaaatgctgggattccaggcatgagccaccgtgctcgggcccctctctgtgttgtcttcagtaaagggagttccctgtggcccctcaggctgagctgggctgttccttaaccacatggcttcagtgtggcgggcgtgtttgtgtgcctgctggagtacccccgggggaagaggamgaagggctccaccatggagcgctggtgagtcycctcctgctctgggktctctccgggggytgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagyacatgaccrccgtggtgaagctsttcgggccctttaccaggaattactatgttyrggccgtcctgcrtctcctgtgagtccccgtcccgcaccccctctagggctcaggagggcttggagccgaccctccccactgtcccaccggccgggctgcctggacaggagccacccccacttacctcagtrtttttccaaacaaaaattcgggtccctggctctggcagggcctgtgtctgctgtctagygtgcaggatttgtaaggatccactccaaatccgaggagctccgatccgtcgccagggtctggggtcagcatgcactgctggggggtcttgcctgggcttcctggtagggtggagggttccgtgctgtgtgtctgctggttactgccggctgaggccaggacacccacacgtggctgcttcctcygagcaagtgcaccagagccgctagygkccacatcaaggcygagaacacccaggaccgaaacaagccccggtccrcrcacgtcccctgggtctgcagtctgccttgtcctgagactttgtggccttggcccccagacctggggctccgttcccctttctgagtgcccttctgtgtccctgcctctcacccgctgtcccccaggctctcggtgcccgccggcttcctgctggccaccatccttgggaccgcctgcctggccattgcgagmggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgcca

SEQ ID NO: 13378 - DNA, 48203 bp, Homo sapiens
ggatctccatatggaaaagagtgaagttggacccctacctcacaccatatacaaaaataacttaaaatgtatcacactaatatacaagaatttacttaaaactccaatagaaaaagtaaaactataaaactattaaaagaaaacataacagaaaatcttcatggcmttggatttgggaattaggtatgaygccaaaagcataggtaataaaagaaaaaacagataaactggactctataaaaatttaaaagtgaatcaaagaacaatatcaaaaagtgaagaaaacccacaaaatgggagaaattatttgcaaatcatacacccaataagggtttaatattcagaatatataaagatctcccacaattcaacagaaaaaaaaactcaattaaaaaatgggcaaaggacttaatagacagttcccaaagaagacatataatggccaataagcacattaaaagatgctcaacatcattagtcattaaagaaatacaaaataaaaccacagtaagataccacttcccaccacctactaggatagctataatttttaaaaaaggaaattaagttttggtgagcatatggagaactggaacacttgtacactgctcccatggaaaaacagttttagcagttccttaaaaagctaaactaaaagcttaccatgtgatctagtaagtccacacgtaggtatattcccaaaagaattgaaaataggaactcaaacagattcttgtacaccaatgttaataacagcattattcacaatagccaaaaggtggaaacaacctaagtgtccatcaacatatgaataaataaatatggcatatatataatataaacaaatggaatattattcagccataaaaagaaatcgagttctgatacatgccacaacatgggtgaaccttgaaaacattatcctcacaaaagactctgaatagccaaagcaatgttgagctaaaagaacaaagctaggggcatcacactacctgacttcaaaatatactaaactctagtaattaaaacagcacggtactggcataaagagacacacagataatagaacagaacagagacccaagaaataaaaccacatatttatagccaactgatttttgacaaaagagccaagaacccacaatggggaaaggtcaggctcttcaataaacggtgttgggaaaactgataaccatatgcaaaagaatgaaagtagtcaattmtctctcaccacatacagcatcaactcaaaatggactaaagacttaaatgtaagaccccaaaccatgaaaccacttgaagaaaacacaggaaaaaagctccctaacattggtcagggctagaggttcccaaccccagggccacagattaktaccagtccatggcctgttaggaaccaggccacaaagcagtaggtgagcagcaggcaagcaagcgaagcttcatttttctttayagctgctccccattcctcacgttaccacctgagctccacctcctgacacatcaacggtggcattagattctcatagcagcgcaaaacctactgtgaattgcgcatgcaagggatctaggttgtatgctccttagaagaacctaatgccttatgaactgtcactgtctcccatcactcccagataggaccctcaagtttcaggaaaacaagctcagggctcccagtgattctacattatggtgaattgtataattatttcactatatattacaatgtaataataatagaaacaaagtgcacaataaatgtaatgcgcttgaaatatcctgaaaccatcccctccctcctgtggatggaaaaattgtcttcgatgaaaccagtccttggtaccaaaaaggttggggactgctgatctgggcaatgattttttggatatgacttcaaaagcaaaggtaacaaaagcaaaaatagacaaagggattacatcaaaataaaatgcttctctgcacagcaaattcaacagactgaagacagaatctacagaatcggataaaatatttgcaaactatacatctaataagaggttaatttccaaaatgtttaaggatgtcaaacaactcaatagcaaaaaaataaaaaaattaaaaaaccatatttaaaaaatgagcaaaagacctgaatagacatttctcaaaaggagatatacaaataaccaacaagtatatgaaacattgctcatcaataaccatcagggaaatgtaaatcaaaatcacaatgagatatcacctcacacctgttaraatggctattaccaaaaagacaaaagataagtgttggcgaggatgtggagaaaagggaactccttcctcgctgttggtgggaatgtaaattattactaacattatggaaataactcaaaatattaaatgtagaactacaagcgggtccagcaaatccactacagggtatatattcaagggaaatgaaatcagtatgtcaaagagctatctgcacttccatgtttcctgcagcactattcaacaatagccagaatatggaatcaagctaactgtccatcaacagatgagtggataaagaaaatgtgatatacatatacaatggaatagtattaagccataataaagaatgaaatcctgtcatttgcagcaacatgaatggaactggaagacattctgttaagtgaaataaaccaggcagggaaagacaaatatcgcatgttctcacttatatgtgggagctaaaaaatttgatgtcattgaggtagtaagtagaatggtgattaccagaggctgggatggatgggtggtgggaatgaagagaggctgttaatgagtacaaaaatacagttagatagaaggaatatcatagggtttgagagctatatagagacaaaaaaataggtaagtgattgctaggaaagcgggtgggattgagtactaatggttatggagattctcttttgggtaatgaaaaagtcctaaaggtaattgtgataaaggttgtacaactctgaagacaaactaaaaaccattgtattgcacactttaaatgagtgaatcatatgatatattaattatatctcaataaagctgtttaaaaaagaattctgagtggaattggccagatacaaaaaagactaagatggcaaattttatgatatcttactccaattttttagaaacataattcagatcacgtttccctaacaactctccaacagcttcccatctccctcagaatgaaagccccaattttcaatatagcccataaagtcctacacattctggcccctttccctttctggcctgacctctgacctcctctccgctctgctccagctcactaggcctcttaagttgctctctgaacataaagaggcaggttcccccagggcctttgtactttcttctcctccagagaacgtcaaggtaagttctctcacttccttgagctctggactcaaaaattcccttctcagcgaggacgtccctgaccacttattgtaaaactgcagctccctacagccccccacccacaacacacacacacactcttcatccccctttcctttytaatctctattttcaccttctgtcatcctataattttactttttgcctgtctctttccactaaaatgtaagctccaaaaggagagagatgtttgtctgttttgttcattgttggtatctctagtgcctagagcagtccttaataaacatttgttggattaataaagggagaccactgtgggggaaaaaaaataaaagaaaataaaattttagctgaagaatgcaagcccctttaaattatcaggcccagagaggyattagaatgaaaaaacagtcccgtctcactcccggtctgagctggataattatctcttaaagcccacctgctatatgggctctagactggaaccaagaagccataaaatgccatatgctggacacgataactcataccctatgagttacagtgtacagccaatcactaagcaatsgtatctctgtaaaccaataacaattcctgaccaactttgtctcagcccactcttycccttcgcctttaaaaacctgcttgtaaccaaggctgaaggagcactccccaaggcaactgggaaatgagtccygggcagctktcctcattttggctgaagtaaacactttaaattataattttgtgccccagcctcttccttttaggtagacaccactattcaatgacatcaagatctgaactgtcctacttatcccaatatcccwcccctaaaaagaaatgtaccgaaccataaaaagcctgaagtactccgacttacagactcctgtattagcatcctaagaattatattaccctcttcaatagggagtagtatttttcatatcaaacctagcctgagaacaactgagattcaactaggaaaaaaagaaaagaaaatccattaaagactgagtgatttgaactcaaaaatatccaycatcacttgctaaatcatagacagcaggttayttccctcgactttgctgtgcagacctgtagtggctcaatttctgccataataaaggccgtactagaaagagcaatcctaactaagcgcgcaaggtaaacatcaagctggggccgtcaggggcggggaaacactttckgaatggcggaagctccgagagacgcctttcccagctgctccagaggggaaaggaaaagggagaaagtctgtttttccagaatctcccaaacacagcccaggggcctgctccgcgggcctaagcgcctccacgtgtctcagaagcctagcactatagataccccggggcacggagctgggaaaacgggaataggaagacactttaccccgagaagatccagtccaacaggtcttcttcagccggatgactgtggagcgccaccacaagcagggcctgcaacccaggcatccasgctagacaccaaatcagcaaactttattcccgcrctgccgagtacaagcyggcgcctccccggcgcacacagtacacatcagctccgggagacctacccgacccgcccctccagsgccgtccccgcccccgttcctgccccacccctttccccgcccccggcccggctcgcctttctcgcggcgctgcaaccctcccaccacagcccatccagccccgcccagcgcgccgcggtgcgcatgcgtrgaggccctcgctgccgctgagcacctcgggaagtgtagtctcttcgcaggtgcggctgggcagctagagtcctgcatcccggtggaatccggagaagtgagaacattcccgccgcccggtcctcattcccatcttcccacctgtccagtcccctcgcactcccgctgcaccccacgcgccgggcttcagtcagagaktgcactgaggaasagcggagaccccstcttcccctcagcaggctgtgccgggggaggcggggtccaccgcccgccccccgccgtcgctctccccgcctccccttccctcccctcctggcgggtgcggggccggtgtccgaagtcaggcggcggcccccgcagcggccgcaggaggggcggctgcggtgggcgccgcgggcgatgcccctgcccggctgctccggcggggggcagtgcgagcggcggcggcgggggrggaggcggggggcggcggctgcggcggctgcagcagaggggccgagagctggcggtggcggcggcggtggtcgtgaagggcatcggcggcggcggtgatggcagagatgatgtgagtgcccgccggctggagacctggggccgcggagcgcgggacgggcggcggcggcgtgcgggagcggccccgggggcggcggagggatgcggggagcgcgggcagagccggagcggcggccgccaaccggccggcagtggctggagccccgcgctgcggcgccgggggagcygggcccggcgtgggggtcgcgggcggcggcggggcggtcaggccgaggggcgtctgcgattgttctcaacacccctcccccaccccatcccgtgtgtctgtttgttacttgcagctgaagatggaaagagccaggcgaaggggaggcggcggcggccgcggccgcggaggcaagaatgtagggggctctggcctargcaagagtagactctatccccaggcccagcactcccactacccccactacgcggcctcagccacccctaatcaggccgggggcgcagccgaaatccaggagctggcctccaaacgagtggacatccagaaaaagaggttttacctrgacgtgaagcaaagctcccggggccgcttcctaaagatagccgaagtctggatagggagaggccggcaggacaacatcagaaagagtaaactgaccctctccctgtctgtggcagcggagctgaaggactgtctaggggacttcatcgagcactatgcccacctgggcctgaaaggccaccggcaagagcatggccacagcaaaragcaaggctccagaaggaggcagaagcactcggcaccctccccaccagtctcggtggggtccgaagagcatcctcacagtgtcctgaaaacagactatatmgagagggacaataggaaatattacctagacctaaaggaaaatcagcggggtcgcttcctacggattagacaaaccatgatgcgggggactggcatgataggttattttggccacagtttgggccaagaacagactattgtcctcccagcacaaggaatgattgagtttcgtgatgccttggttcagctgattgmagactatggcgaaggagacatagaagaacgaagaggtggagacgatgayccgcttgaactcccagaggggacttctttcagagtggacaataaaaggttctactttgatgtgggctctaataaatatggaattttcctgaaggtaagtgaggtgagaccaccttaccgtaatactattactgttccattcaaagcttggacaaggtttggggagaattttatcaagtatgaagaagagatgaggaaaatttgcaacagccataaagaaaagagaatggatggcagaaaggccagtggtgaagaacaagaatgcctcgactagagtgaaattgaactccatcaggcaaaatttaaaatcacaaattggctaaaagtactgatccattatcctttgaagaagtttttcctcttttttggcccgttgttattagtaatacctctagtagttgatacttcaggaagtctgattctcatgttatgttacacatagatcactataattcttacgggaattccaaccttcccagagctaaatagtttagctgcttcaactgctccagactattgaagtatgcaaatcagcacaaaatgtgacattctgacattctaaataccataactaagatttacattgcactatgacataatcccgaaaaaagatacatatacttaaatagaagtgtgactttcccccaaaagtatttcaattctacttcattaaaagctgctaagcttacctgtagggcagttaccacagaaacagaaattgacctccggtatatataaatatttacttataaaagtacaagtagacgtatattgtccgttgaataactgaatataccatcaaaggatcaaatcttattacctaattaaaccttaaaaatataatgtcataatatttcttaagaatactatagtattctataatttcaaactttgtggtaaccctacattttatagttgccatatcaaagccatgggagagttttaattcgttattctaagtttagttacaatcccttctttacctctacttaatgttccatatatttttattgactttccaaagtttcaggaattacttttatgtcacattgagtgggaggcttcatccaatggctttgctatggaaatcttggtggtgtagcttttcatgctaatttaaagattgcaagaggtttcttccccaaaatatatcatggactcaaggtgttatactttatgcttcttctttaacactctttcagaagggttggtgtaccaattaactgatataaaaatatacctgtaataatatattttagtagcacttttgcaattgctacccttaaaaccatgtcaacacttccaatataatcctgwattttacaggtgttttaattctggagggggtggggattttttttttctaaaaataatttagaatacaaatttccagtctgagaaaaatattatttgaagattggttataaatatatttgaaaggaaaattcaggcattttccaaggtgctctttctgactttacacaagactcacccatttacctgtattaaaaattactttccaggaagtgccacagcaatttttcaacacctaagcaattttttaaayaagtggatatagtgttatatgtgtaccaacccatcctgtattaattgactgaaattacatctattcagctatattttcttctgaatgaaattattgtcttttatcttggctttattcacctcccacacaataagtccatctaatcatatttaagagccagaacactgatttyaacccccaaatatcactctcattgatgagagctggctgcatggattcaaatcagaatgtagctcttcttttatatgctaaaagtaatttaaaattatatcagcgatttttttcttccagagttttgtcccccaatacctttacgtgaggtcactaagaaaacttgatggtatgaattaaaaaaattaatttcattggtttakgttacttaagaacaagcaatcagtaaccccgacatatatactagtgttggtttgcagattgtatttcacatttcctctagtagcgtgaaggaatctcattagttcattataattgtggaccatctggatcactatggaacaactgaaggttaggagataatgttagtactagagctaatagcacatggtgggtgttgagactctaaaagtagcaaggatttttaaacagtcctaactgtaaaataactatgtaggcttgctaaaaaagtagtttttggtctatgaaggaatgatgtgcacttgaattactgtactactgattgttattgctgcccatcatagtgcctattaataataatcaacctgtcagattttggcaaactggagctgtgaatattctagtatttgattgttcctatcgctattgctatgagtgtatacactctcttaaagtcttcctttctaaaatatttatatccattaggtctaaatgatttccttttaccttttgggtctgataagatttgggtatgtgtctatatctatatatatacacacagacatatgtatatacatgtatacatatatatgtgtgtatacatacatacaataccatgtcagacttaaagataaatatctttaactcattgtatataaacattattaaatttagttttccattaattatttaagtaaagaattagttaagcagccagattttctactttgkatgtatacttcaaagtttttaccatctcaaagctgcagattaaatagatgcatatatactggcaattgagtatactctaaaattattaagccttctgccagtccttttgtttcatttttttcatagttaatcattcaaaaatgagatgatgctatgactttttgatacttaaaattcccaagaattcattagccgtaattaaatatgatccagttcaaaactctggtcttaggacatgtattgccatgtatcttataaaataagctactattcttatctgtgcaatatgcattttatttattgtcatttgtaacatacatggagctgcaagtgttcatggtatccttcaaaataacagaatccctgccttgaagacattaaactcttaaggcaactggaagttagaagttaaaaaatgagcatgaaagttagtaaccaaaagtactagttcactgtataattctaaaacactgatgatgtttgcacctaataatccaagcataatgtggtacaggctcaaactgtagtaatataagctaatagtatgaaatttggaaacgggttcctcttgatagttggcagtgtgctcctagcaatcgaaagcagcactaatctgttgctttatgcaaaagatgcaatgtattataaagatattaaagttcctctacattttataattttccttgttaaagccccagactgccatgtccctgaaacttgagtcaaacacaagcttatttgcactaaagagcatggccaaaaaaataaatgacagggtggaaaagctagttggaacctcttgaaataattggttctaatatgagaatttcacatttgtctatttgaaagctgtatggtccaggcagacaatctgtcagttcactaatttaataatgcactttaccttttgtatatagaagatgtacatttatgccacttgacaggtgggatgtgtttcaataactatgtagctagaatctataaggtgatcccgtgcatgcatatgtttgtgttggaactgttgttgtaacaggtttccattaaatcagtgtaatggagaagggtagaagatgcttttgaaacaaatcccagtatatttaacaaagaattttaaagtagagttcacatttgatgtcttaagaactagaataaataaaatactatttctaacccaaattcttattacagttgagactatatttagttgagattccccacagtgccctgacagttaatttggggaatttgtctagacaaaatttttttcaatcattgtttcattgttgatatgtgtttaagtaatgaataaatatgcagtacataatattatactcaaattaaaagtgtggttagctgatgtggcattatttaaagaacattcagactaaagaagtaaggtttcaagttaaggaaatgcaaggaacctatgaacagtcactaacacaaatatgatatctcagaattcacagaagtactaaccttccccaactaaaaagggtattgggggatttagtgbatccttccatcttaaaagcttcttaagatgtacatttgaaaactagataactgttgcttaataatactttactgagaaacactgtgtactaacaattcatcaagagtgtgctatatttactgagttcattttatatctatagataagaataaattatatagtcatcctaccttaatataatcatgtatttatattgtaattttgcaaatattttccataaaataaacatttatctgagctgcacaatttgaagaggatgaaactggaatataccctcagatgctcattttaaataagcagctaccattgaaagctgatgtatgtattatcattcctttaaatttgggtttatggtatattttaatatttaaatgaataggacttaatttgaattttaagtggttttctgaaaataattttttcataagtgtgagctttttttccttcttatctccaaatgtttttcattggaatatttatgaaatcctattcaaagcttkatgtaaggggtttgcttagtcaccacttagtttgaagtctgtctttactaaaacaccaaacatctttgacaacatacaaagaggagttaacattgattctatgcctacagaataatacaggtgtaatatttatcacggcctgaaaaggatcttaaatccttctgaaatttccttaaatatttcttgaatttcaaagagaaatggtggctaatggctagcccatcagagaaaaagaataagtatgttaacatgctgttgaaacaactcatagtccaccatactgtagcaatgaagttcagggaaaatgtgtttttcccaacttaatatcatgtgaaaattgggttttcagatcacagtaactctgtcgtaaagaaaatatacccaaatttagtaggtagagcttagaaaaataatataagtatatattttcatgtataatggaaaaaatccgtacttgttattaatttgacatgctattttaaatcatttaaatttattttggtaatgagattttaatcaatatttttgaatagggaaaaacatacatatagtacaaaatggaaacagtacagatgggtagagggtgaaaagtagcaaccaatgttagcaatttcttgtgtatccttctagagttactctgcatatacaagtatatgtgtatgtatrtatatatatatatatatatatattctttttaaaacatacagatgaaaacatattatatatactatcttgtacctagtagattcaatttcagatctgtcattttaagtgacttttttttaacttagatatcatacttgagctagttaacatatcacttaatttgaaatatattaactatmccaaggaaatatcaaggaaattttgaatgaatcccattggtatttacttaaagtgcaaatatatgtgtattttaaatatacaaatattcagttcatcctactagtttcctttctctcttcctagccatcttgcctycctgtattcccctcacaaatatattggtctttttcctgaagtagtgcacttcaggagtgccaggatattaaataatttaaccaagtgttatcttaaaccgtattccctaatgaaaaacacccatatttaaaagctttaataaagtatcacgttcagtcaatttttactaattctgttactattatctttatccaaagaccttgcccttataagagcaaatgagtattagaactatagtaaaaaggtatatttctgttgaaatactttattagcatgaagcctttatctttatgagaaaggtataatgttcatttagcaacctcatcaaatccaagtttaagcaaataggtaactctagacccgattgtttaaagcattgatttttcactgaaggaccaagagtctgtcagtagtcttgggaccaaaggcagtgggatgatttggggaatgagtaaaaactggagtgctgtgaggttacaagtacagctaaactgtctctctggtggaagaatataaaatggtcaatataattttttaatgaagttagcattattactagtcctataaacataaacaaagctgccttaatagttttgtgagcacccgtccccaaaaatcataattctcttttcattcccatcaagagtgcattttgatatgacttttctattgaccaccaagaaaaaattatctgaaaaatgaaagatcccatacttgagtcctgaaagatgctatctaaytatgaattaaagcaaccagagtaaaagatccaatacaattgtaaatatctttaaaaatgtgggttgaggaagaagaattttttcatggattggtatccgtgaattttatgaacatgtcataaggtttaaaaatttaaagcattgctttaaactttagaataataactctatatttggtagcataatgtcctgtttacaaaatgaaagaggtgttgttaaaagataagatcctcttaaacatattttaaaagcataaaagtttgctccctttattttcatgctgaataattcattataaaattcattaaaaattcatctttaggaatgaattttgcttaaatttaggctaaagcatattaataatttcccatccttaattgaagagcttcccatgttggtgctttctggtaaattatatttttcaaactttatgttcttttgaatatttcttatgaaaaattacatatttttattgaggccagtgacatccaccagtaaataaaaacataatgaattagtgctgctatagtgaagttactttgtgatatgaatatgaagaaaaaaactcatttaaatggaatatatactttcctgtttaatattgtttacttatttctgattaagtagcagttctctgtcttcacattttaccctcttaaacttaatttttgcaaaaaatttttctattcggttttcattttcctagggaaagggaaaaattgtccctratgaaaagtgtttatagtatttaaaagagttgctcaaagtgtaagactggggaaaaaaagcttatgttgttttttttgtctttatcaaaataatggtataaatctgattatcttacttgatctgattaaagtcaggattacttttatcagaaacttttatattcaaaacatatttagtattttatttttcttaaagaaaatggttctcttggataatacagaaatcttcaggattttgttgtggattcaatgaggttgttgcctagaggtggcaaacagaaaagaaaaaatagaaaagagaaagacagtggctgattattttgcttgtctgtaacgaaattcatctaagagaaataagtcattctcaaaactcaacctctgtttaacctttaaaagagcatttgagaaagaataataagacgtaattctgccaaggtgcggcctgaccctgagtaaatcattcaacttctgttggatgatttcctcatgtgaaagatgaacagtattgtgctggaagctaaggttccctcctactctaaatgtttaaaattctgtatcagtggactgtgaaaggaaaaatagatggataataccagagttggaaagtgtgagagtttatctgtttacattaaaaacaactataatgatgcagcaacctgtgatgatacccaacggaacaatgcaaaaaaatgtcagttttataatatgtatgtatttctttagccacacaaaataaaattttgtttctagtccttattaagaccaagttgttgtayactaactacgtaactatcctaaactttaattttttaaaaggaatatttttaaatattgattatttcccatctccttattatatcaaatatctcattatttggaaggagcattgcttttttctgcatattctgtaatcattttttatattctgcatggcaaaggaattttacagattaatatcacttcctgaaatgccatttttcctaaaataaccatagatcacattgccaaataatactgcagctgtcatggtagtggtccctactgtcttcgattcctttttgttgatcctgtccaatatcctatgctagaaataatgatgtctgacaaagaccatcagaaaggatactgacctgtgaactgtatggttctgttttagaggacttgtaactactagggtatgcaaagattaaacatctaatggtttgggggttttttttagccttaagaaacgtcaaaggatggtgattggaaaagagaagaagcagcacacaagggttttgtcttagaagcatttattttatttatttatttattattacttttttttttttttgagatgcagtctcactctatcgcccaggctggaatgcagagaagcatgtatttaagcaccccagtcctcagctatgcagtgccccgccactgccagtgaagaggcttaaaaaagagtgacatgtttctccctagacctctcttttagtgcctatttgtttatcagagactccatttaagggtaactgaagtgtattttcaagtgcatatgcatgtgtattttgctaatttcaaaagtttctgtgcacataaattccattacggaaacattccatatgataactaatctttgccctggtggtggttcaaaatagcaatttggttggtctgttttcaacaaattctatagaatgaattggctgttgttagaaaatgttttctctcttttctcctccctcttctcaaaatagcagatacattttaaatccttgattgcttctttttcagtggtgtttgaaatctaagtgggatttgagagaatagtttagtttggcagttctttacccttgccattttgtagaaactttcctcagcttcccatcagatattctaagcaactttaccaaaagaagtcacctacgtgccaaaactgccgagcaaaataaaacaacagagccatagaaaatgatgtaggagtaaggataaagatatatacagacacccaaattcacaacattccttatcatttgctaatttacttcagagactgttgtattttatttcttggttcttcaaactagcaatgtggtttattccaatgatttgtcagtctagaatgtcaatagaacaaaatcttttgctgcttagtaaatgttccaaaaagggtatctcatgttataatcagttgtaaaaatagaattctaaaattccattcattataatcctctttccttcttccctcctgtacactgtaccctattggaagtgggtaagggcattaatttctttcactatcacatggacccactccatcctatttatttgttcagaagacaattgaaacataatagagaccagagctgctctttgaaaatctagaaattgccctgtgagcttgatctatagactgtaagaaagaagggttactacttcactgaactgttctccacgctcttgccagatttctatatgacagtttaggatgaatagaaaacagatttgacttgggatgacatgaactgaaaggtcagttcctccagcttttcaatacacagtgcatcttcagaaaatatttttgacgagcatgattgacaggtaatttcagaaatgaatttaggctgggtgtggtggctcatgcctgtaatcccagcactttgggaggccaaggcgggcggatcayttaagttcaggagttcaagaccagcctgaccaacatggttaaactccgtctctactaaaaataccaaaattagccaggcatggtggcacgctcctgtaatcccagctagtcagaaggctgaggcaggagaatcgcttgaacctaggaggcggaggttgcagtgagctgagatggcaccactgcactcctgcctgggcaacggagtgagacgccatctcaaaaaaaaaaaaaaaaagaaagaaatgaatttggtccctagagaagtttcaccatgaccattttaaaagagcaggtggtaagaaaaggaagagtcaattaagatttattagtagtaataactattgcttatggaccacccactgtatactagacatagctgggccccttatagctactattcctaatccttataacaaccctattatccccattttcatatgattttccagaggtttataaactggttcagaatatcagaactaatgtatttgaacccaaatttacaccaaagccaamgattgtgcccgttcagttaggccaaactgcctttcagatttcctatgaagctgatccttccaactctaataaagcacagtctacccccagccgccactatacatctgcctcagcttacttggaattattttatccaaaaccrtcccctatatgtgggactagtctcaccaaagagacacttggcttatatgaggattccattggttaaagttggtgctaataaatacaagttatttgatctttagtttacagataaaacctctaatcttgatcaactatttccaataaactttttaaagggatcataactttttaaagggatcagatcataagaatgtagaagagcttcacagtttcatccctaagggcagagaggagacaaattactattcaccatgggtctacaatttcattttcatgaaccaaaaacaactggttacgttatcttagtttcaaaataaatcttatcaatatttttggaagttttattgatttcttacaactttttcctgccatcttattgatgtctcacaacttttcctgccatactcctccctatatcattccactcattttcatatttaattaccaaatttcctcctctttctcttaattccagtacaataaacagataattctccatttacagatacatatttttccccattactatagggcactaattttcaaacttcagtgtgaatacaaatcatcttgatggtttgttaaaccacagattgctggccccagctcagagtttctgttcagtaggactggtgaggtggggagaaraccaagaatatgcatttctaacagtcctaaggagagtggatgctgtgatctagggggaccgcactttaagaaccacactgctgtcagctgatgagattttaccttagctacagaagatagtgatggaaaaactcggtcaaaacaactagggtatctgggtagaaagaagactgagagctactccttcttctgccttgacaagcttacaaatcttgaaacaagcaactttttaataagttgaccagagttttgtaaaaaattattttcttcccttttgaataacctttctgattccctctcatttttcaacagctatcttgagagaaatctgataggaattaacagttatgaagcctcatgtgaaaagcttagcttttaaatatatggagactgatgcatatttttaatttattttgtaattatagtatataaatcttggtaaagaaaagtgaacaatttctctacctaagaattattaatacaagtttaatgactattaaatattaggacttaaaagamcttggaattaatttaatcccttagttttccattttgtgacatacatcatgtagctcaaattgttcatagttactagaatacgctaagtaaacagaatttaaaggctagagcttaaattgctgattatctcaagatatataaatggtgagaaatatactaatttcttctaaaagcatatcgcatttttaccatcttcctgtatcctctctgtacgtatagaatggaggaactatatactgtactgtgtttatagtacctttttttgtcttcaaactctgcctcccaggttcaagcgattctccagcctcagcctcccgagtagctggaattacaggcgcgtgccaccacgcccagctaatttttgtattcttggtagaaacagggttttgccatgttggccaggctggtctcgaactcctgacctcaggtgatccacccgccttggcctcccaaagtggtgggattataggcatgagccaccacccccagcctacagtacttttctttagatcagcaattgaactcactgctttaaaattagagatattgggccagacatggtggctcacgcctgtactcccagcactttgggaggccgaggcgggtggatcacaaggtcaggtgttcgagaccagcctggctaacatagtgaaaccccatctctactaaaaatacaaaaaattagccaggcatggggatgacagagtgagactccatctcacaaaaaaaaaagaaaaaagagatattggctgggcatggtagctcacacctgtaatcccaacactttgggaggcagaggcaggcagatcatttgaggtcaggagttcaagatcagcttgacctacatagtgaaaccccgtctctactaaaatacaaaaattagccaggcgtgttggcaggctcctgtaatcccagcaacttggaaggctgaggcaggagaatcacttgaacacaggaagtggagattgcagtgagccaagattgagccactagactccagcctgggcaacagagcaagactccctctaaaaaaaaaaaaaaaaaaaaaaaaattagaggtgtttcacctgaacactcattgagcccattttctataactaacatatttttaaataatttattctatgcttgacaaccttgtagatattctgtactataattaatatgttgatcaaaattaaagccatatatatatatatatatatatatatatatatatwttttttttttttttttttttttttttttttttttttgaaaaaaaatctccctctgtcacccaagctggagtgcaggggggcgaactcgggtcactggaaactccccctcccgggttcatgccattttcctgcctcaaccccccgagtaggtgggaatacaggggccccccccaacgcctaatttttttttttttttaaaaaaaacgggttttcccctgttagccaaaaagggcttgatctcctgacctcgtgatccgcccgcctcagcctcccaataataaaaccatattttatgtctaaatctatataatatctataactatatataaaccttaatgctgtcattctagtggattacattgtattgaagtattaaattaattcatacatagacatttggcagttctgcaagttcattgacttctcttaacagctactacctttgaatgattagcactccagaacactgaatgagttcctaattgtgaaaatgattaactaactgctgacataacagagatagtcacaaactcaaatggatcattacaggcaatgtaacttttttaaaaattctctattcatttgcattatggctacaagataaattttagatttaaaaaaattaagtgttagaattatactttgagtaggcttcaggcagaataaatttatagtagacttcagctcaacattagggcaaactttaaggattgcatgacttctctgctcctggaattaattatttaggcacgcactgaatgtgggatgcataaagggaattaataaatcagaaaaggtgaattgttatggctcagattcttctccactctgagggattcagaatttattggaaataatcattggaacttttgccttcaggccttctgttaatttactggtttggataaagaagtgtgatttcaaattttctaatattattgtgaaaacatataaagaaaagaaatccttcttcccatcctttgttattgcaaaacaacgtaagaactaggttttaaattttcatgaactttattaattaaatgactagttaaatagaatttatgaaatttattctgtaagattaagtctaccttttataatcttcaaagaaacttttcactttcaatctgttttcaaaaatatgaaggaataaatttagtatttatagtgctatttcaaaagtacctgctgtcggtttatttagaatgacacaagaggcaatagggtaaattggaaaaccaaattattggatattatcaaattttttctttataaaattcacattaaattctgtttaaaagtcgaaacatctataatatctttctccattttttcttgcactgctaattaaggtggaaagaagcaacatcgtttgctaatttcatcttaaattttttgttttagacaacaagtttccaagtaagttcattattgctacaaatgcaatcatatctaaattcaggacctagtgaattcatatgaaactcgattctgcctggtggtgtccacttttttcttgtcacttcttctaatcatctgtgctttcttgtgatactgtaacatttccagatttcaagtgggcaaatagtagcttttatggagagatctgagtgatttaaatgttatcacacaaacatctataaactatattgcacatttctaaatatttggctaagcaaattttattcctccagataaatattacataccctttatatataatagatagatatagatatagatatataatctcttatagagagtatgtgtaatatatattaaacatacatatattgcacatgcatatatatacaattttttacatatatatgtaaaaatttttaaaagagatcccaatcctrttcacctttttcttgtccctggagaagtagtggtaaatgggtttcatctcgcttgtatttgcaattgattggctgccctaaagtgctgtgtttgtatctacagggagagggaaaaaacagtgttcatgccaaatatttgctatttatcattcctgctttagagacataaaagttttcattgtagctctaaaaatttctagcttagccagatagctggcagttgcagcacaaactaccatgtgactcacctggaatgtgtctcttctaatatgtgaaagagattatttgaaatctctttccttttttcttttttcttttgatcatctctcctttaaaagagcagagcatctccactatgcctctgagaaactagaatgatggccatgatgatgtcatcaaagatactcttaagtattaaactctacatttgcttctaatgagttctaacccccattaaaatgacagcagttgcatcctttaaaatttagtccagtgattctcaaacacaagtgtgcaggtgtattaaataaaaatacaggtttggtccccatcctcagagattctgatttgattggttcaagagaggggttcagaaattggcatttttcatcgtcttactcattctgatacaagtggtctggaagccactctttgtcattcacttagactgtggacttgcgttctttctttttttttttttttttttttttttttttgkttcttgktaracttgcattctttcttccatatcgtttttccagcacaaattgcttaagttttaaatactgtcagtcatgacaccatggaatgatgatttttttggttacaatattaataagtagtatccagggctcactttattttatttatttatttatctatctatgtatttatttatctatttatttatttatttttgagacagagtctcactctgttgcccaggctggggtgcagtggtgcgatctcagctcactgcaacctccacctcccaggttcaagtgattctcatgcctcggcctcctgagtagctgggactgcaggcatgtgccactgtgcctggctaatttttgtatttttgatagagacagggtttcaccatgttggccaggctggtgtcaaactcctagcctcagctgacctgcccgccttggcctcccaaagtgctggaattacaggtgtgagccactgtgcctggccttggtttgtttgtatgtttttgtcgttgtttgtttgtttgtttttgagacagggtcttgttctgtcacacaagctggagtgcagtgacccaatcacagctcactgcagcctcgacttggcaggcacaagcagtcctcccacctcagcctcccaagtagctgggaccataggtgcatgccaccatgcctggcgaatttttttttattttttgtaatgacagcatctctttatgttgacccagctggtgttaaagtcctgggctcaagcatttctcccacctcagccttccaaagtgctgggattacaggcatgaggcactgcacccggccagggctcactttaaacacagagaggctaaatgcataaatccaggtgtttaagattttgtatgctatcatattggccagctttctgggcagtgattactggaaatgccagtttctcacccgcctcctaaactcaagttctgtctgtctggtcttacttgacatcagtccactggtttcatactccctggatttcacaaccaaacattcagagtcttcagagccaagcgactggtctttcagtctcaaaagttgaccctttacgtctcaaatgacatttctcaacctcttttttttttaaaatatatatgcagtataaacctatcatttatcaggagtagaaaaaaattgccttagtcaatctagttaatctttgaatgcctcacttctggtggtggtgtgtttgtttgtttgtgtgtttgttttcaattgtggttaaaaaaatgcatagcataaaatttaccatcttaagcatttctaagtgttcagtaatgttgtgttcagtagcgttaagtatattcaccttgtcatgcaaccaatctccagaacttttttgtcctgcaaaactgaaaagctatatccattgaacaactccccatcttcctttcccccgcaagcctggcaactaccattacactttcttctcaaccttttctttaaaataagcaatatgttttcttaacctttctcccatccataatgggtttacagttattgctatttagctctccaagtataaagcttatctcctgtattgttagaattctcacatgcaaaaagatttacaattacaaagcaattgtgctaataagatatgcttataatctttgagtgaaggtattttatcctggaagcttttccactgatttacagggggaggtaagcctttattcctcttgagacctatggatctcactttatgcttcctggctggtttggtattttatttgtttgttgaaggtttaagtttagagttaccagggcaattaggcttaaatcctagaatttccttggctttttcctgtctacattctaagactgttttaccataacactttataacgtaagtagtagattggaagtttttctggaatttgacaaattagtgtttactaaatgatttaataatctttgcttattcagtataaaatggtttacctttaaacagctttaatagaaacacaatttgggaggaaataggtaaaaaataaaaatgtatttttctgcaaatgaactgtttcaaatgttattttcaaaatctttggcagtaagaaaatactcaacccgagaaataaattttttaaactcttattctgtaaaagtttttcttttgaaacatttctcttcctctgttattaaaatttttttaagaaatcaataaaagcttaaagtcttataagcaatacacatctaaataaccaaaaatgctataattatgagtatgctgcttatgatcctcccatagggaaaaacatctgtcttttcttggcctaaattatttcagagctagcacaaaaactgattgatcatgactcttggataatgataactaagtcttcgtttcatgaatttaacaatttgtatcagtgctaccttatgagtttttcagaaaaatgctatttgtattgaacyattttaaataattccataatctggaataattcagatttttttaatgatctgctgcaacatattggtattattgaatctcattttttctttgatttccattataaaattagaaatattttctgggagaaaaaatactccttgagttgaaaagatttagtgaaggagttgtgttgcagctgattcagtaatgttccaggcaattaacctttttttgttttcagcgctcctctcactctttaagatctttcctcattgatcatcataccaccccaaaatcacagaagtttatttaattccatgcgttcctcagagcacgtgatgtcagaacttaacctcccctcaattttcagcttctaacctaagctggacactaatattttgccagtaggaaccttttattttttgagacagtttcgctcttgttgcccaggctggagtgcagtggcgcgacctyggctcactgcaacctccgcctcctgggttcaagtgattctcctgcttcagcctcctgaataactgggattacaggcgcccgccaccatgcctggctaattttgtgtttttagtagagacggaagtttcaccatgttggccgggctagtctcgaactcctgcctcaggtaatcctcctgcctcgtgcttccaaagtgctgggattacaggcatgagccgccgcgcccggccaggaacctttatatggtacaatgaattccagcctgaaaattccccaagttctgagcctttacttcatacatatttaccaaatatatcaattattatattaaacttagaatgaagaatgactgtaagatttataatgactaaagttagtttgcattatttttcttcaagcgttattaaaccgtactcctctttaagcaagtttttgggtcactaggtaactatgtgatttggtttgttgatcaccatttattgtttgactcactttttcaaaggcccaaatattatatttaatgacataccaagctctaattcaagcagtgccctctgttaaggtgatttgcatctgacttgaagcatattaaataaaatctacattttatttgatgcaaatgttttatatttatataaaaaattaatcttgggtaaacacaacttgattcttaaattagattcttaataactcaattctaaatgattacttattaaatttgtcacaaaataactataaagtgaacgtgaatgctacattactcagtatatctatgctataattaataaactccaaaaattagttgtgtattatttggactactatttcaatcattcagaaatttgttttaaaaaatccttgcagtcttgctgctgacttcatagygtgcagtagtgtgatatggagatgatgcactgtctttcagaagccttggctctatgccttctagctgggcctggggcaagtcatttagcctctgtggaccccagcttgcttatccataaattgagggaattggatcagagtgatgatctctaagaaccccttcaatttctgtatccctgaagtcagtgaaacttctcttaaagttagtttctactttcttctttggccttttctcattttcttcccactccccttggtttcgtctctcatctgacatttattgaccatcctttccttcttggcatggttcatatttagttatggccactttacagtgttgcagtatgctgcttctctgcctaatttgcccagttcccatttttaccctgccattttaattttacatataaattatcttggaactaacacaaaaactagttgatcatgatatattatatatataatcaataagacttatcttttggccctgtacacaaaagttttaaagaggcaattcttccagttccaagagatttttttagacacacaacctaaaacttgttggagtatattttaaacttaagtttcccatttgaaaaatcctaactccttaacttgcatttaagtttaaaagcagagacagtttcttcctcttttgtattcccctctccaccttgcactgggctgattacttaaatcatctcttttcacttaatcaccagcattcctgttcctgttttgtctttgaaatcttgttgcttcagaatcacggtacttaacagacaaatctaaatggcgacaattgttaatgaaagcgatagttttaaaacctaaccaaaaatgctatgtcatctttatttcaaagatgactcacaattaaaggatgatttgttgcctgcacaccctaaattttatttcagaaatattctttcccttgcttaatggataagtgatgttgttcctctactcattcaatggacattgagtagctactttttgccaggttctgtgctagggtctagggatacaataacttaggaaagacaaatatttcactgccattagctttaagtgtgccatgtccaaagttatttgattcaaagcagcttttggagcctaattacagtatcattttgttcattcaacagatatttatttgattatctgccatgtgctagacagtttgttggtacatatggaagtgtatttaaagctatctagtataaaatgctatgcattatttttcccttatcaatttatcctttaaatatgattatctacatactgtcatagtgctcaaaatatatttcattgatgcagatttagagaaatacaatgatactattttaaacaataattctgtcttcctcattccaaatctgccttgatgtcctagggtgaaaataactattctgtttcatttcatgtgccattgtgttcaagtggtaatgactacctgagtcctaggttggagatgattgtgaagctccattcaggcccatggtaaaagactgcgatgatttctgtatgttgatggggcagttagatgaggaaagcaaggagtagctatatacatgtcacatgttagcccttcctgccccaggcttttgtattcatcatcactaattttatttcactctcattgcatattcagtatattcacaaattctttttctcctcatatgtttggattgacaaaaatccatcagtgttctcagctatgatgactatctcaccaatgtcttagccaaccaaatgagatttactaacacctctgtgtcagtaaatccacagttgtaataattttcactgtagagacattgcaatgaagacaattaatagataaattcagttaatcatgagtaccaaaaatttgtcctgaaagttttccataactggtcattaattatgaaatattttctaattcaattaaatataaaaagaatgtgtaattttaaattataataatttacatatacgttaaaatcattttccaagttcttttttctattatacctcattttaccctgatgaaactcctgatttagattagttcaatatcactgtccccacttaacagatgaagaaaaccaaagcccagcaggtgaaatggtttgctgtaatcacttagctgcctaataaaaataccagggttttaacaagcccactgctcattgaagccttttatattaataataacatagaaatttaaagrggtaaacttgaaatcaaaatttggcaaaattaagcatatatgtttatagctcatttaaagagtttttttgaaatgcattctaggtattttgttgctttcatcacatctttaggctcaattctgcactcagtaaactcttggttttggccctggcagaaggcctagcaactcattggtgctcatgtctgtgcaccagctgcttgccracctcagcctctgcctcaaactctgagcctttgtcctctgtgcttaagactccctgcctgagcttcccaccttagctaaccttccagaacttgacgtttcctcacctgttaacccaagtcttgtcatggcacctgctttgcagaatagccctctaaaagtgatatcgtttagaggatttaagatgtaaaactacatttgcataataagtttggttaattaaacagcgagtaaatcttttccctgcattccattttttattatttttttattttttattttttcaagacagggtcttgctttgtcacccaggccggagtgcagtggtgcagtgayggctcactgcagccttgacttctggggcttaagtgatcctcccrcctcagactcctgagtagctggtactacaggcatgcaccaccatgcccagctatttttcctattttttgtggacacagggtctcactatgttccctagactggttttccctctacatgcttatgaacaagagataaatgaccacatgataagttagaagcagactttttcagaaacctgtttgaaaggaatgatccaggttttatgaaatcaactcaagaacccactgttcttcatctgcatcagtaccatsattacagttgttgacagtgaaggccctagagcactgcagtattctcatttgtgcatgcaaaatttaatcacatttattatgttgtatttattaaagcagaaaatcgaaataatacatgttagaaatatttccatttcaataggattaaaagcatactgttagctaggaattgctgttaagtaaatgacttcgctccctgacattcccagttaaccatggttttgtagcatcactgaggaactggcaggctaaattctgaattcttacatgcagactgaattattctggtggtttttgttgttttgttttgttttgttttgttttgagacagagtcttactctgtcacccaggctagagtgcagtgrmacgatctcagctcactgcaacctccacctcccgggttcaagtacttctcccaccctagccccccgagtagctgggactacaggtgtatgtcaccacgcccagctaatttttgtattctttggaagagwtggggtttcactgtgttggccagactggtcttgaactcctgacctcaagtgatccacccattttgacctcccaaagtgctgggattacaagtgtgagccactgcacctgtccgaattattctgtttstgtatttatggccacagaagtttcatattggctaaatctgcacaaattatcatatagttataaatataaaagtcagatcaatatggctaagattatcacagaggagcttaataggagttccacacttgccttttgccgggagaagaaaacaacaatgactttaatccacttcctctacccccttaagcaatggcagtaatttcagctctatttttaggtattggatcccctaaagttatcaggcaatctcagtggcctagtataaagtgcaaacagaacagaccttggtgtcagccagtcctgggttcaagtccaaattctgtcatttattgtgaaatttggagcagtttatgtaactgtatagagttgtgagaattcattcatcatttattgtatattcatcaatcacctactatgtgctggtcaatctttaaagttcagggaattatattgataacaaaacataaagttccctgccctcacagaacctagagtaaaccagaattctcttaaaaaagttaaatgcaaccaggtgcagtggctcacgcctgtaatcccagcactttgggaggccttggtgggcctcacttgaggtcaggcattcaagaccagcctggccaacatggtgaaaccccatctttactaaaaatacaaaaattaaccaggcgkggtggcacgcagctgtaatcccagctactcgggaggctgagtcaggagaatcgcttgaacccaggaggcggaggttgcagtggcagcgagccgagatcatgccactgcactccaggctgggcaacagagcaagattccatctcaaaaaacagaaagttaaatgccttcaggtacataaggctgttaacgaaatgtcacataatcaaagcatttaacaaatattagttaacatcattattaaktcttcccaacccacgaaatggatggttccctggaaagtataacaacattatgcaaagttcaaagggagcctccttttaccataggaacctttaggtgtagcagctgcaagggaattgggctgcttataatctcataaaactgttttcagtcaaatataaaagtgcacaattgtgcaggcaaaaatttctygcacaggaaacaaaaagcactaactataagagaaaaaaacaatacattagactccatcaaaattaaaatttsctactcatccaaagacaccattaagaaaatgaataaactatccacagactggaaaataattgaagcatagatttattcctggaggaaatcagaacagctttgtttttttctttttttaaaaaaagagaatcattaggctgtttgcatgattgagggaccaattgctgcagcgctaaaagtattacattcacctacttcctagtacctacagtttttctcatctagatctaccatcgattttgatggttttttgcctgaaggtgtctttgggggtaatatgacaccctcattttacaagagataggaaaaatatttgtatgactttgacatcatttaactagtctttcagaacttgaactatattaagtggtacttccactgttcagtgtctgtttttcttattacactgattttgcttcagaatcagtgagattatatagacgtcattcagaatatttgtttttatccttcaactcgaagagttttctcacctctttattttcaagttgaaaacattattataagaktatgttagcgggtcatttgactctgaaaaaaatagctttttaaaggttgatcacactttaatcttcaatttcaggatagtaaagaaccattataatttaggccccagtgactgtcataaaacagcttttaccagaccaccatcttaatactgatattttcctctttcatatttgaactatatttttttctataatctagctcttagaactctattttcctttgatactaatgattcctcttgccctcagaaatgtttacatgaaacagcacrtgactgtcctttttgttgatcccaaaactttttattgttcattctagagaggcaaataatgtccttcagtgtcactaattgagtttttaaaaggaagatttgatagctaagaatctgttgtcttgtatcaatttatcatttttacaattgggtcaagatatatttatgcaatttttatgttaatagcataatagcagtagcaatataatgtgtggcttgggagtttcagagctttttaaaaaaaactaagtatgtgcctatgcttttcctttttaaccatattgaatgtgtaatgttgagttagaagacactgtgtgaggtaagaaatggcarttcaaggggaacaagaacattcgtttattcagtcaacmaatatggattgagttcctcccataggcccagcattgtactagggaaattgctcactatttttatttttcccctctaacctaaggtggagatgataatgaatagtaaaattacatgttttagatgtctttgtatgttataggtggatttgggacagcaaaagcctttggtgtgtttcacttggaattacaaaaagaagtaaattagagaaataattgtctgacttctgatgatagggtgtttttgtttttgtttttgtttttgttttgagacggagctattctcttgcctcagtctcccgagtagccgggaccacaggcgcccaccaccacgcctygctaatttttatatttytagtagagacrgggtttcaccatgttggccatggctcgtctcaatctcctgaccttgtgatccaccctcctcgccctctcaaagtgctgggattacagccgtgagctaccacacccagccttctgatgacagttttaattttgtagatgaatttggcatgacgtggatgaattctgtcaaggtcattattgttttcttctcaaaaccaatagaattttctcacttayttatttttagaattgtcaggtagtgtaataaagttatttctgtaggaaactgggaattcattggctatttgactctgaatgtaacctctttaaagctgatgaacgagtggccccttakatttgaagtggtaaggtagtcataagttaggctcccagacactggcattcaacgtgattttgaagtgtgatagaccatgtatacacttgattgtgcaccaagaggcataaggtaaaatcttgtttccttcccacctgtaagtgttaagtgcatcagtctcctttctctactggtggtgtcctgttgctccactagtagcccctgatataaaacccgtgtcctccatagataattagtcatgaatccctttccagggcgtgttgttctctatgtggtgatttgaagggagaagttttgaaatgaaaaaaaaaagaaaaaagaaaaatgctaagcaatttctgatgctttagaaggaatgtcgtgtttcattacaatgcattttaacatttttattaagatataatttaataaaatgctcagatcttagcatgtcattcagtcagatttgatgaatatgaagacacatttctgtcaccccagaaagttcccatgtacccctcctcagtcaacactcccccgaccctgacttccaaaagcaaccactgatcagatgtctatcaccacagattagttttgtgtattctggaatcccctgttaattgcatgtatttttcttttcttttcttttcttttctttttttttttgttttggtgacaggatctcactctgttacccaggctggagtgcagtgtcacaatctcagctcgctgcaacccccacctcccagctttaagcaattctcatgcctcagcctcccaagtagctgggactacaggcacatgccaccacgcccagctaacttttgtattttttgtagagatggggtttcaccatgttgcccaggctggtctcaaactcctgagatcaggtgatctgcccatctcagcctcccaaagtgctaggattatgggcataagccactatgcctggtctgcgtgtatttttctctgtttggcttatttcactcaacataataattttgagattgtccatgtttttgagtctgtcagtagagtgtttcttttattgcctgatgatacttttttaaaacaggcaagaaataagcagatcgtcactgaatatcttgattgacacataactactattaaaatcatggcagcaaacctgtagtaagaatgcagggggagaaaataccctcttatattaatattaagtgacagtacttctaacatccaaacaactctcccaccttaattagcgttatatgcatcaagagctactcttttggaagactctaaattactaaaaacagaacctgagttcgcatcaggaattgtaatagccgtaaacctatgactgtttccatcgctttatagttctgctttgacttcagaaactagtttgaaaaataatcccatttaaggatattcttttgttttgtttttttttgagacagagtcttgctctgttgcccagtctggagtgcagtggcacaatcttggctcactgtaactgcaacctctgcctccctggttcaagcaattctcttgcctcagcctccctagtagctggcacctgccaccatgcccagctaatttgggtttcaccatgttagccaggctggtctcgaactcctgacctcaagtgatccacccacctcgggcttccaaagttctgggattacctgcrtgagccactgtgccyagccaaggatatttttcttgtagtatctccattatcaaaacgtgctggaaaggatgttttacttgtttatcaatatggtgatgcctcaggagcttttaagccctcttaaaattatgtaatatagacctgatgaactcagttttattattagaaactcattttgatctgtaattccaagcaaatattatataaatgaaacaagagtagatacagtaagagcagcatccagattgcatttttcttcttttgaaagtcctaattaaattgtttgccatgttatgcaaagattcattgagattctggggagtggcagtaaatttaagcaargattatactgtgattctggggagccatagtaaattgtgtatcaacaaatctaaagggtgaayttttactttctgcttattgtctttttcaagaaaattctatagttaccaaaaaggtggctgaattttgacataataaaggagaaggttgagctggcctttggctagtccacccctattcttaccatctccaccttcaagactgaaataaggagctgcaggagcacaaagagatcccaaaacattgtcacataccaatagccactttcttacttttacaaaaagttagtatggtgttttttttgtttttttgttttttggtttttttttgagatggagtcttgctctgtcacccaggytggattgcagtggggcgatctcgggtcattgcaacctccacttcccaggttcaagcgattcttttgcctcagcctcccaagtacctgggattacaagtgggcaccaccatgcccagctaatttttgtatttttagtagagatagggttttgccatgttggccaggctggtctcaaactcctgatgtcaagtgatctgcccactgtggcctcccaaagtgctgggatgacaggtgtgaggcactgtgcccagccagttttctgtatttgtacaattattcagccagaaaaaaagtagccatatagtactataatgcttatatcacttcagtgggaaaaaaaaaataatggtacccaaaagaaataagaaatatagcctgattagtgagagaacactgataaagtttcagattattcccgttcttgaaatatttctcattcgcttttcttatttctttcacctacgactaaaatacacgtgctttccttttcccctatcatacttacttttttgttcaggttcctaagttgttttaccatcttcatatttcattctgataattccaaaaatactgaaatgaatcctccctttcacatgacctactttagtgtagaatttggcctaagtcatttctcatacaaaagcagttacatttgaattaccaagagaatcttgttggtataatttaacccagaagggcaactcacagtgctgtcatactaagcctcaaggatatatcttctcaagattgataagtgcttttgagcaatcgctcaaaagtatgaattgaagtctctaaacagttcattatcgttttggttgtagtaattaattttaattaaactgccgataatgtttgttccagatgaaaaaatgaggatatggtctttgttcccacttgaatatgaacactgctatccatttaatgttagaaagataaaagagatctcggccgggcacggtggctcacgcctgtaatcctagcactttgggaggccgaggcaagtggatcacctgaggtcatcagttcgagaccagcccggccaacgtggtgaaacaccatctctacgaaaaatacaaaaattagccaggtgtggtggtgagttcctgtaatcccagctacttgggaggctgagccaggagaatcacttgaacccaggagacagaggttgcagtgagccgagatcatgccattgcaccccagcctgggcttcagagagagaccctgtctcaagaaaaataaaaataaagtaaaatattttacatggtatcattgcaaaagaaggagtaatggtggtttaaagaaaacgtttaatacagttattcaagagttccaacacatcaaacttttgggatttaactatccttttttaaaagaaaatatattttgaatactgtacagattcccatcttatcagaggaagaaccagttagcataacatagaattttagggctagaagagactttcaacatcatcaagtcttacctckcggtattcaatagttcaatataattattatctttttacaggtcttagctttcctgccctaatttccaaaacaatgaagaactagtagtccccagatcccctttgtatatatgtataactgccttttcattccctctgatagtctccatattcatgttaatgattgcagctatgaggattatttccttgattcattatgcctgaattagcttaagaaaagaatagtctaccagaagcacaacttttaatttaaatgtttggcaaaggtaaagatgagtaattcagagttttagaagtagttgtagtaatagtcaattgtgtcattggttctctggaaaacacatcatatggattttgccatagcgattcaggcgtgagtaatactaccctattcaagagtaatactacccgattcaagagtaccacttcaagagtgagtaatactaccctattctttaagacaagtaatactacctaccacattgtatgggtgaagcaaaagtggaccagcacagctttttgtgggggttagtggtaggagagtgttatagtgaagttctttgttctgttttctcagtctcatttctcattsattcattaaatcaatagatatttattttgcctgtggtatgagctaaccatttctctgggtctggataatatagcagacaacaagatccagtctttggccccaaagagcatacagtacrggtactcacaacatggacaatgctagataactgcccagagagcagagaagctacatgagatcattataaacctgtgcacctgaaccactgcacaagcaatgcattaactttgccttgctcattgggatatggtgagaaataactgttataattagttgtgaagcactttggaaatgaaaagagctacaaagcaactgaatgaaagaaaacaatattaaattatagggtagaaatgattctcataggtatgttcagtatttatgtcaacgatataggactattaccagggaaaagctattttaggtaaatacaattgcctagcttttacaaagtcaagaaaatacgtgtgtgtattaacaagataaattgtggaatgttgtattattttgggtattatgtgagctaaatatagttggaatatcacacatactatgaagtttctataaatctgcagcttctattaagaatttctgtatttcaatgtttatcggaagtatttctccaatatttaaatgctgaaactatccaagactattattcacaaacaacggattatattttaatactcagaaactgtaggaaggtttgttaaataagatgaatatcctgtgattaacttgccagtatgttgggttcagtgatttattatgcctggtcttttctgattttagttaatgtttttaaagtttgttaattctctcagaagatgaggatgccaatttatatcccattatacaccctcaaaagatgaatttatagaatgggccatgtctttaacatgcttctatatagtcattcttatacctaagattcagatgctcaaggaagggacccatttagacagttatttaatgttctttgactatgaactaatcctaattttaattttagtacttttatgttcttaccagctttcaccctaattaaatggggcactacaccgcagagtttagcctgtggtgtagcagagcccaggtcatctgtcacagagaatcrtaatcttacattctctctctcctctgaacaatagaattttgaggtgggggagaatcttagtttataatgaggcaactctagttttatcacactcagaaacaacaaaaatattcaaaatttaactttctgtgcattccatttatttgcaaatatatatcagtatgattattacatgagtaagagatcttcattttttactgtcatccctgatttgccaaatttgatggagaacctccacagagttgcatattattttatttgttccacatgttggtgctttgttctctactgtccttttgtcattatattatctctgaacatttccatttagtgtttctatttagagtaaagaaatagaagcatgaaaattaataacccatgcatcrtattttttgctggactttataggaatgaccagctaaggctagaaacctcagtgtttaatactgttttcaaaatttgattgttacatatattgtcatttcagtgactggagacaagatgtatatgtagacaaatagataaaaacagggtaattaaaccagtgtggtttttttttattttaaaggaaaacacatacgacttatgtacattgcatggcagagtattactaaaattcgcctaaacaaaccrtcacgatgttttcaggttttatggtaatgctttgactatatagtatttggatttgaatcctcataatcacaaagtctcttagttgtttaaaacaaaaaacaaagactatactgattctagaaagtatcatctccttgattatatttgtgctaagtgtatgaatctgtgctataccagtatgaaaaaggtaaaactgtatatatatttacattttgaaaagtagcattgtgcattttagaaaaatatttgtcaacttgtggcactttggcaaaggaatgtgcaattataaaggttaatgccactttatttttttctaattcccagtaattattcttactaggctttagagtcaaaatcaaacccaattttaagactagcacttttttcctactggtaattcctgtttttctaattacacaaaatgtttaacttaaactattctttgcaatgagttttagctttcctcctctatcctaayttcaaaacctttaatttaagaaccatttaaaattaatccagtggtaaccagaagaatattttaggtatcatgaccacttaatcttgtgcctgattttagtaattttctgataaaaataactgaattcctgaaaaagaatattcaaactttttaattagttttcattggtcataaataattgagtagttgatgtccatatagtcataatttatctaaactctggagctgccaagacaactaagtacacagaagtgcttaaaacacacccatatcccctaaagagaaatgacaagacttggaagcatcagaattctgtattattatgagtatcacatatatatatgctattttatatatacatatatacccatacacatacattctgttaggttaccagtattttactgtcatgcacccatgggtagtagaaacaaaataaaaataaatataaatgtttaactttaggtgttggcaccaayatagattatgcataaactgttgcaataaaagatactcattgtgcctgtacctgaaaaatttaccttaggttttctctggccttttttgtttaggcctgcatgatcattttaaatgtaaagatagcaggatatatgaatgaatggataaaatgatggccctgtttgccatgggattaactattctgttgaattttctgaggggcattggctgctgtatattacgccataaactatattgttcagaagcaacatgagtgtatcacagcatttagaaattatacatccttcgctttccccacaaaatgaattcagaatcgacattcaagtttataattttaagctgctaattataaaaatatattaataccttakggattgaagattacatgaaataagaactacaaaagaatgctaattaataacataactccatatgctatcaaacttctgatagcactgagtttcttataaagccttaaaatattttaatgataaattaattacctggaaaagaaggcactttattaccttgaactagctattcgtctgtatagaatatgtcaaaaatcccttaaattattctttatccttttataaatttatcctagttacatgtttttctgaagcctcttatggtataatgtgttaattcaaaaactattgtaacttaacagaaaaattgttaccaatataaccaatgaacaatacagaaataaaactcaagaataacaaaagtatatgtgataacaagactgttagtctaagttagtctacaatcatttgagattttaaaatgttgtaaaatttgaaggctttttcattgaacaatttttggacagtttttatttttaaatctcacttttaattggtactgccttgtcttgaaatgttgatcaaatgtaaaggcaatcataattattaagccagtccattataattcaattttgttttagttgagattttttagtgtaattctaaaacattaaaacatctgtttgtttcttttttgctcaagtcagccatgcctggtgaactatcaaatttaaatcatcaacatggatgtgctgctgtgtatagctgtttcctcttcagaaaattagtgcttgatttatacaaggaatttagttcagcagaaaaagcataggataattttttcaaaagggttcaaccctctcaagtgaaaccttaacatctttctgacattcataaggataggcttttatccaagaaattttttcaacagaaaattatttcaaagtggacaaactccactttcttttttgcttgaggggcagtacacttttacaaaaacacatttttctgtaagtttacttatctttaagtcattctctgtggtggccatttttccatctctaattttaaatgttttactaaatgtacgtgcagtttcatagacagtctgatcattacatgattacagaaaggagtcaagtttatcagaggtctatccttgtgaaggggagaccaaacacaaattccatgtcagttgtttggtttggttctttgttttcttttaaaaacaagatatattaacccaaaggtgtgttaatgtcatggcatgaacaatcttcaatgtagacctattgagtattttgtgatgctgagtaacagacgtttctcaactctctgtgatgctaaatattttccttaggaagttttgtttaatgttagattgttgttctgaaagatgttggtcctagtgggatttttttaaacttggaaaacaaataaacgcatgtattacaaatatagaaatggtgaattgtaaacttaccatatagtactgatttctattttcaaaaatgttttgctgttaaatatatacaacataaaattgctgccgtactgtaattgagtactttttcctaaacgaccctgttatcactattccagaattagaaggtgggcagatacatgattgattcatgtgtctgcatagatgcttcaaggtatattcttctcttggtgagtaaaattatattttccttggcatcaatgcattgagatctgaatatacctgtatctatcaatccttattacacatttcttaygcagtagcttcaaataggccaaaattggcctagacacaactaaaaattgagggtttgttacatgctttctaacagaaaggttttcaacgagattaattatgggtttgtactgtgaaaatagtggaactcccttgaaaacttcatgtttgctaaattcaaattaatattttttctttagctcacaaattaccccaaatccagagagaatatcaacctttttcactgttgtcaaatcaagcataaggaacagccccatgatactacaaaaacagttgaggaataaggaataaatctcttatgttacacctcagaataaaggcattcggtgaaagaaatgaactgaagttcatcatgaatgyaaggcctcagtacttgacattcctccacggaagggaagacaagtatcaacaccactggcatcatttccaaactgatcttatgttgaataatttccaccacattgaagtacctttcgactctatccagtttttgggttttgttttttttaattcatcaagcctttcgttttcaaaccaccatttgtcagccttgaggtagagagacatatagatttgaaaatactttcttaagagatcatgtaactatataactctgaatttaaaaattgaggggggagggataatttcaacccactgcctcttaccagaaacatttttttaaatctgtaactgctttagtgttaacagggtgcaaggtggtttttgtcccgtattgttcttaaaaggttctcatttattgtgattgtattgtactgtatgagaacaaatcataaattgccttgtattgtttataatagaccataccacgtactacttcagtttttatgttccaagtttttcagtgatgcatgttaacagttaggtcctaaaattctgtggtgctaattctcccatacccaatggygcttttgtggatgctaactgcacacatgctgaacaaagcttgaagtttaaaactttcctcccttcctctgtttatatgaagtaaaatgaaataacttgaatttgtctcaaagtatcactgacaatctaataaacttgtttatatgtgtgattagtttggattcttaattattttaaggaaagcatctcagctctattgggccccaaaagttgattttgtgtttatttcattatgtcatttgtgcccccaaattcgtggtatctttataaatttcaatgcagtttgtctggcttccaaaatcatgtttaggtaggatctatagaaactagacctatcagaactggaaataagtaagttgagaagatmaaaaatgtgccaatccagtctattacagtgcctttattgtaatttattaataaggttttatcacctggttgagccgggagataacacttgcacgaaagcaagtatgccttcaaaacctttattgcaactcacatgacattgaaaaggccatttctatatgctgatattaaaagttccacttctcatatatgaaaatagggacaaaaaaattaattttgaattttccaggacaaactgacatcatatgccagaatgtcatagtagataaactcatgrcaatggttttattggatttttatcttctgcatctatattaaatcacaacagaaggccaagtgaacctgctaatatcttcatgagggcagagggctgtttcttccaagccagggataaattcaatataaaggcactatgtaaatttgcattccgaccttggtactttgcctaactcaagggtaatgttaaaatttgaaaagaaaaaatcgaaacaaatgtattaaatctccttgagcaacaatcattgaccataaatagaagatgatcaaacctatmtcagtcaaagaatctagcaggtatgatgactgaaatgatattcccataccactatggttctttattatataaagagtttcaggcccagtaaatttttgcctcaaatagctattaaattgtgtctaacttctaacatcagaaaatgaagtttagagaatagtgccagtgtgaaccctaagcttgcttctgtgactatctgaaataaatgcaatatttactaaatcacagcctctcaccaaagatatttctacaatatatttttgtaactaccttaactgtattccattttatgaaaactggtaaataataaatgtactacaaattaattgcacattttcttttggaagaaaaatmtgtttaatctacatgaaaatatctctaattttacacccacagtcaaccagatttctgtattaattttcatcaktgtcccatcaaaaagattatcctgaaaaatgcatatcagctttcgttggtagtggtgaaattttttaaaaaacttatcagccttaaataacatgaatatattttgtaagttttgttcctctataaaaataatgtagtccctctctaagtgaaaccattttttaaattacgtaattatatccattttcattgcattattagcattatttaggtaagttgtcttttctgttcctaaaacagtaattttcccttagagaccttatgctcaaggtgttttccctaaatccttatgggaaagcattttcaaaaacagacccaaatgttctctttccagtaaggaaaatctttcgtaataaattccatgtacactaaaagcataacagtacttgtattagggaagtaatttttctcatcagaaattgctttgagtttgaaaatggccaataataataaaaagccaatctgcagtctacataatttcagatttgtcttcatkcgatctttttaaaaaactgttgaagtaggtgcatactgacttgcactaggactaaagttatttttcttacctcctactttatcctttatccttggcagggattcaagagaggtgaaaagacttttggaaaataactaaaaagtagtacaacacacacaaaataagggagtggtagttcataggactgaataaatcatgaaattcagtgaattcagcactacacatattatgccaaattgttctcctcttacacttttcgcgaagcaaatttcccatcataaaagacttaacaaaacactggaacatgaagatcaaaaggactgaatgaaaaggctggccctcagttttgtgcatttggaagktcaggtttttttttagctaagaagactttgatgaaggaagaagtaaaaaagaaaaagaaaaaaagaaactcggttttgttagttcattctgagtgaattcacaagagattccttttaaacaaggtcataaagaaaacatcttgaatatcagatattcaatggagaaaccaattaacttacaacaaaaaataaattggtacacccagggagtggattggaaagaagctgtgcatgasaagtgaactttgaagtttgcttttatactttttgaatattatttcatgataagcttgtattattttataatttataaagtacttttttttttaaaggaaagaaatcaaatgctagactgactagaatacctatatcaactggtcagcacattctctttccagtaggaaaatctgccttttctttctttttttgagacagcgtctgactttgtcgctcaggctgcagtgcaatggcaggatcacagctcactgcagcctcaacctcccaggctcaagcaatcctcccacctcaacctcccaagtagctgagaccacaggcacgtgccactatgactggctaattttttattttttgtagagacagcatttccctatattgcccagcctggtcttaaagtcttgggcttgagcaatccttccaaagtactgggattacaggcattgaaccactgcacccagctggaaaatctacttctaaaacctgcttaatgtcagaacattgattggcaagcataaaatcaggtaaaggggaatgactaatattcatgaatggcatcatgttatgatgggcttcatgatacagacctgccaagaaacaggaataaccacatcagcatattggctcagagcacagtcaccccaagtcagggatggaaaccactaacaaatccttatgctttaaatctttttttctagattccatgtgacccaccatctttcagtgtgaaaattattgcttatatgattaagccacatattatcttgcatttagtatcactttaggattttcaatgatagaatactgttttataaatatcattcatcattaagcattaacattaatcatattacataatcatatcattacattaatgtataatcattgttattattttgcttgtttgtttgtttttgagaaatagagtctcagtctatctcccaggctggagtgcagtggcatcatcatggctcaccgcagcctcaaactcctggcctcaggcaatcctcctgccttggcctcccaaagtgctaggattacaggcataagccactgtgcctggcctgttattttttataatcatcattaatcattaagtatcattaatcattcactcttattataaatatcattcatcattaacaaaagttttacatacaatagctctctgaccatgacccttcttaatagagatttagggaacatccaaattcagcagaagtgactaatgaaagatcaagatgttcctcctttaaccctcatggtagaccttgccaataaacgayagcaactgggagcagctcacacctgtaatcccagcattttaggaggccgaagcaggcggattgcttgagcccaggagttagagaccagcctaggcaacatggtgaaaccccatctctagaaaaaatacaaaaattagctgggcttggtggcatgcacctgtagtcccagctactcaggacrctgaggctggaggatcacttgagcccaggaggtcgaggcttcagtgggctgtgatcatgctactgcactccagcctgggcgacagagcaagaccctgtcttaaaaaaaraaaaataggccatagtatttatttcaaatggccagatacagctctagagtctttctcaactcagcactctcctggcagctgctcccagttgactacacttagcatgcaagattgacatagttgcctttctaccttagacacccaccagcacatatacatgccatctgtgttagtctgggtcctccaagaagcagattccaaggtggaattagatgtgcaagagatttattaaaggaaatgccagtgagggaaaatggagaaggagctggtggaggagacatcagactcagatgcaagtctgcccctgtgaggaagagaggaggaaagaggagggaggtagaaaggaagttacttcttagactgcagcacaattataagcaagtttcagccaggcctagggggagtccttgagccaaagtcactcttcagaagaggccagcatcttgagggttcagcctgcttaatatccctgtcacacccagttattggctgggagcagcctaggagaagcccacctgcagggcaaacgtgacgatagatttcagagcaccacagctggatctgtgggccagttgggtggagacttagagctgttcagtgcccataggagtctgtggtggctatgaaaatgcatctctcaaatttccttctaccgggagcataactgactcacragctatttctgtattctgtgatgctagtctttggatggtgtggttttcatgttctacttacaccatccacctcctttgctgtgaagtggtcccttagttggatgcctctgtctctgctgccatggccactctattgctgtgcccatcctgccaattctgaggtggccaatggcagtctgattcaggtcaactgtccgagtcactttgtcaacttggttgttcagtgcctctcccatgatggatggcttctggtggacattaacatgtgatacaaaactcttcacagtctgggctgggtgtggtggctcacatctgtaatcatagcactttgggaggccaaggcaggtgkatcacttgaggctgggagttggagaccagcctgggcaacatggtaaaaccccatctctactaaaaatacaacaacaaaaattagccaggcgtggtggcgcatgtctgtaatcccagctacttgggaggctgaggcaagagaatcgcttgaatccaagaggcagaggttgcrgtgaatcaagattgcaccactgcactccagcctgggttacagagtaagactccatctcaaaaaaaaaaaaaagttttcacagtctgtgcctgctcccatatgtgcacccacaagcttctaccccaggcctcttcgaccctgtcttccagtc

SEQ ID NO: 13379 - DNA, 14804 bp, Homo sapiens
tcaagaccctgggtttgggaagtgaaaggaagtcccaaggtgactcgggaaacaggccagatgtgagtagaagaaatgtccctatttctcaaagccacctccctttatcttcttctaaacccacagattcccaaaagtgccccaaagatgcccargtagaggttaagggagaagcaaggcaccgggtactactgtttgcagcaaacacggatgctggcctgcccaggggcccctctctcctttyggattttattcaggaatcatcgttggtctcaggtgatcatgacacagctattctcctttgccagtgactgacatgagattcagatctcactaataagatgtaagaggatgtctcctgggagcttttggaaactgtttcatccctgaaaagggaaggcacatgaagaaaaatccaacatccttttgctactgacttcttgcttcctgttttgtatcctgccatgtgaaartayagcatttggagatgtggcaactttgtgctggccatgaaggaatgcgtcccccacacggcagagtacaaggaccaaagaagccaggccatcgccccaggccggcctccctcactggataaacagcatatgcccttatgctgcatgagctggattttccctttcttgtggctgaaatgcatttggatacagtttgtttatactcatagagtcactgtaagtcaggggcttattgtcaggaactacttaacactttrcttaggatattggatttaaagaaaggaattttggggaatccatgctatagarataaaagtatcagtaagtaagagggggaaacatacaaatttaaaatgtgcacataagaaacttaatagtaactcctccctgctgggggcatgggaagggagaaatgaaggaacmattatttttcatttggtaccattctctgtatggcttggattttcttgctattayttttatttgttaaaatctgggcagtgcaataatggggcacttctrtttcttccgttttctgtattttccatttccytctattttctgtattagaaatacactacttagccggrcatggtggctcatgcctgtaatcccagcactttgggaggtcaaggcgggcagatcacctgaggtcagaagttcgagaccagcctggccaacatggtgaaatcctgtctctatttaaaaaaaataaataaattagccaggcatggtggtgggcacctgtaatcccagctactcgggaggctgaggaagaagaatcacttgaactggggaggtggaggttgcagtgagccgagatggcaccaacggactccagcctgggbgacasagtgagattcttcctcaaaaaaaaaaaaaaaaargaaagaaaagaaaagaaaaagaaatacactacttaaaaataaaaggaaatgttatattggcatgtctagagaattgctcctttctccycctccagggaggaaaacagaggaccttatatttagcaatccagcatcactctcctgacattccctctagtagagaatcatgcctaactaaagagctcagagctcacagatagatcacctctgaagccatgtccaggcaagggtcaacaagaatgaaaacacasggtaacacacaaagcattcagtccacaaatcacaggcatcagtctgacttctagtcatacttttgcaaaaagaattccaagagttccagtatctagtctaaatcttataaaagatttatgcattcctgagtactgtttaatactataactaaacactgatacagcacactaagacagttactggatacaaaaaacaatttctcacttaggtaaytcattttttwtttatttatttattttttgagactgagtctcrctctatcactgaggctggagtggagtggtgtgatctcggctcactgcaacctctgcctcccagattcaagcgattctcgtgcctcagcctcccargtaggtgggattacaggcacccaccatcatgtccggctaatttttgtatttttggtagacagggtttctccatgttggccaggcttgtgttgaactyctgacctcaggtgatccacctgtctcggcctcccaaagtgctaggattacaggcgtgagccacctgcgcccagctgcgaaatttttttttttaatcaatccattttcaaatcaaagtatatactgcagattccagcctagttatttcaactcagaactcctcagcttaggcctcttaattgccttatttcataagaagctgactcactcaaaggtcacaaaggcagcgatggcagagccaagatcagaagtgttaaggctgaaaacaggaagagggcaacagaatgtctgtggaggtgctcaaaggttaggcacaattttccttgggcastactcagaagccagccaggaattaccttagttctgtggttctctgcattmagtccctcatatagagatttgttgaaagatatttcaccaaggatctgcagttcagttacatcttttagtaactagaagatggggaaaggaatgagggaaacaaaacatattttagacatgaactcactgtgtttgaacagccttcaccacctttccctttaaaggtattcctgggcttagktaatggccctaacgtacacaacactacataaagttacccaaacaagacatctgcagttattcttcaacttccttttttttttttttgagatggagtttcgctytttcgcccaggctggagtgaagtggtgcgatctcggctcactgcaacctccaccccgtcaggttcaagcgattctcctgccttagcctcccgagtagctggaattatgggcatgtgccaccatgccaggctaatttttgtatttttagtagagatggggttttgccatgttggccaggcttgtytcgaactcctgacctcagatgatctacccacctcggcctcccaaagtgctgggattacaggcgtgagctgccgcgcctggccttttcttcaacttcttttcccttgtgccatccaaagtcagttcttgactgactgacttatttttgagacaggatctcgctctgtcacccatgctggagtgcaatggcatgatcatgggtcactatagcctcaaccttccaggctcaagtgatcctcccacctcagtctcctgagtagctgagaccacaggtgcaccccaccacactgggctaatttttgtattttttgtagagatggggttttaccatgttgcccaggctggtctcaaactcctgggctcaagyaatccacccaccttagcctcccacagtgctgagattacaggcatgagccaccacacccagcttattcattttatttaacgtaagagatttttcctttttttttttttttttttttttttttgagacaaggtctcactctgwtacycgggccggaatggagtggctcaatcatagctcactgaagcttcaaattcctgggctcaaacgatactcctgcctcagcctcccaagtagctgggactacaggcatgagccaccatgcgtggctaatttatgtatttatttatytttaagaaatggggtttcactatgctgyccakgctgatcttgaactcctggcctcaagcaatcctcccgcctcagcctcccaaagtgttgggatgacagatgtgagccaccacactcacaattctttttttttaaattatttcytgtatctgtccctttcttttccacccccattgctacttcttcagttgagacctcacaaatgtcacctggatcactgtaaaacattaaacttgatcacttgatcactagttcccactttagaataagtgatcagggaaggcctctctaagaaaataacacgtgtggccgggtgtggtggctcatgcctgtaatcccagcacttcgggwggctgaggtgggtagatcatctgaggtcaggagttcaagaccagcctgaccaacacgatgaaaccccatctctactaaaaatacaaaattagccgggcgtggtggctcacgcctgtaatcccagcactttgggaggccaaggagggcggatcacctgaggtcaggagttcaagaccagcctcaccaacatggagaaaccccatctctactaaaaatacaaaattagccgggtatggtggcgcatacctgtaatcccagctacttgggaggctgaggcaggagaatcgcttgaacccgggaggcggaggttgcagtgagccgagatcgtgccattgcacaacaagagygaaactccgtcttgaaagaaagaaaagaaaagaaaagaacacctaggtcgggtgcggtggctcacgcctgtaatcccagcactttgggaggctgaggcgggcgatcacctgaggtcaggagttcgagaccagcytggccaacatggtgaaaccccctctctactaaaaatacaaaaattagctgggcgtggtcgccrgcgcctgtaatcccagctactcgggaggctgaggcaggagaatcacttgaacccgggaggcggaggttgcagtgagtagagatcgtgccactgcactccagcsmgggtgacagagcaagactccatctaaaaaaaaaaaaaaaraaaagaaaagaacacctgagctaaatttaagaagaaaccacctacgtcaggacctagaggaagagcagtgtcaagcaaaggaacagcaagtacaaagtcttgtggccagaataatgctgtactggcgagctagaagaataggacagaataacccgattataaaaggggcagtgggagagaaaggcgagtactaggagatgaagttgaagaattaagcagagaccagatcaagtactgccttgctctggccatgaaaaaagtatggattttagtctaagtgtgctcaagcatcagttttgtttgtttgttatttttaataagcaggggartggcacaatctaatgtctgctcttagaagacggatagctgttacgtgggaattatttgtaaagaatgtgggaaaagcagaggcaagaaaggcaggccgaagsttattgcaacagccctggcaagaaagggtagcttgaattacaacggcagtggaaatggagagaagtgaatgggtttaggatatattttggccctgaaatggcagggcttgctgctggaatagacgtggggatgtaggaaagaggagtcacaggtaatccctcgagttccttgtactgtaactggagtatatctccctcctgagggtagctaaggaacgggttgggacagagggttggttttttgcaccaaaagayctattwtggacatggacaygttatgcaaagatgctattatctcttctaggggcgatgcccgtgagcaactggataatcaaatctggagcatttcagtctcaaacacctcctcagagtgatcccaggagatctctgcagccacggtgacattttctttatctgaagcgatgacacagctcactgaatgccmttcttccacatgctggaaaagcgaggtctagtgaacacaattcctttccgtgcggaaagtctgaaatctttttaacacttcggacacagagcatcgtaaggtcccagaatagagggtgtgagcaatttcagcgctcacctcggcccaagcraagctccagcgggagcaattgagacccagggacgaagctagggagggcctggcagcccccggcactggcmggcaggggtaacccaggaaaaacagtctcctggcctctcgttacccgcttcaggccctccgccctcccctggcctctcgggacggccgcgcttacctgaaccgaactgtacgcacaagcgcgctcctgactccaggtgcacaccgtggaggcctgaaacgagagccatgaccgcgacgcgctgaacaaaccaagccgccagttttccgtcccgtcccggccccggccctggcgaggtgcgcatgcgcagggccgggagctaggaccccgcggcaggcgggcgcgtccgcgtcgcacggaagtctcgcgatgtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggwgaggcggcggcggaggygtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgyggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcgrcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaayagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgyctgcttttggaccaaaaccagggcttccttcagtttccacaagaagaaaattgtgactgatgtgtcagaggtctgcagcatctataccactgccacttctctctctggatccctcytatcagaatgttcaraccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaackctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccrtccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcrcagtggcgtgcgcctgtartcccagctactcgggaggctgaggcaggaggatcgcttgagcccaagagttcatatctagcctggtcaacatagcaagacccctgtctctatttttttaaataaataaactacatgtgaaaacaaacgtttatatttataaaccctctttttttttttttwaattttattgagacagagtcttgctctgtcacccaggctagagtgcagtggtgcgatctcagctcactgcaacctccgcctcccgggttcaagcaattctcctacctcagcctcccgagtagctgggattgcaggcatacaccaccatgcccggctaattgtttgtatttttttagtagagatgggggtttcaccatgttggccaggctggtctcgaactcctcaccttgtgatccacccacctcggcatcccaaagtgctgggtgattacaggagtgagccatggcacctgacctataagccctctttctaattgtcagcagagtcctttctgtaaattcctttccgttttttgagccttaacacttatgtagtctgagcaaaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtytcaggggagaagaagggaagctagtaagcaacttatagggggcagtgtaagaaatgtcacatgttacatcrctcacacagagaagcagaatttatcaattttcaaagggaaaatgtctctgtctactgacaaggttttaatttttgcttttttttttttttgagatggagtckcactctgtctcccaggctggagtgcagtggcaggatctcggctcactgcaagctccgcctcccgggctcacaccattctcctgcctcagcctcccaagtagctgggactacaggygcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgycttcactctgtttctagaactctggtttttatacttgagactctgtagtcactgtggaaagaggtgtgactgataaakaactgcctttaaatacctgagtcctcgtcagcttcttcactgctrcaacctggagacctcgtaatttggttgggacgcaaatttgcaactggtattctgctccaaagaggttctccccatgtacctgcaaattaaaatcagagtaggaaatcaaagctggtattgctttgccatctacagctttacaawaataagtacttacatggaagaggaattctttgtggtgagaaagcccctggcctgtgttcacgtacattatggatggtctgcaattgasaggacatgcgtcagcccttgaggagtctttctcccttttttggagacagggtctcactctgttgcccaggctagagcacagtggaacaatcatggctcagtgtagcctcaacctcccaggctcaagtgatcctccacctcagcctgsgaaagtgttgggatgacaggcatgagccactacactcatccctttttttttttttttttttttgagstggagtcttgctctgttgcccaggctggagtgcagtggtgcgatctcagctcactgcaacctctgcctcctgggtttaagtgattctcctgcctaagcccccaagtagctgagattacaggcgcctgccaccacacctggctaattttcatattttyagtagagacggggtttcgccatgttagccaggctggtcttgaactcctgacctcaggtgatccacccacctcrgcctcccaaagtgctgggatgacaggcgtgagccaccgcaccyggccttctctttttgaatgaactcgactgctttcaactgaatacattaggacagagggcaccagacctttaccaggaatgaggccgggtgcagtggttcatgcctatcatcccagcactttgggaggccgaggcaggcggatcacctgaggccaggagttcaagaccagcctggccaacatggtgaaatcccygtctctattaaaaattttttaaaaattagctgggcctggtggtgtccacctgtagtctcaactactygggaggctgaggcaggagaatcgcttgaacctgggcggcagaggttgcagtgagccgagatggcaccactgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttctaattatccctcaaatggccttactcatcccctccttacttcccagtcccacagctgccttcttccctccacagcgtcatattaattcccttttgtagcacgactagttggcaatacacctcctttgatgaccacagtggggtttytgtgacccaaatgttagcaccctagagatcaatatcagagcctgggttctaagcaggctcctctcagaaggacagtgtccacattcatcctgaccaccagctccatctacgagagagagcccaaagctgccccctgggcgatggagtcacaccgctgctggcctcttgggagtactcacttggacagaactgcaacgaagccatgcctgaattgaagggtgtgggtctcgttggccaaagaccrtctttcattggaactaggaataagagtgttagttcatagcacacctgctttgtacatagcaagtgcttcttaaaaagggcttcgctctgttgcccaggcaggagtgcagtgttgcygtctcagctcactgcaacctccgccccccgggttcaagcaattctcatgcctcagcctcctgagtagctggaattacaggcgtgagccaccatacccagttaatttttgtatttttagtagagatggggtttcaccatgttggccaggctggtctcgaactcctgacctcaagtgatctgcctgccttggcctcccaaagtgctgggattacaggcrtgagccactgcgcctggctatttttttaagttccagggtacatgtgcagatgtgcaggtttgttacataggtgaacgtgtgccatggtgctttgctgcagctgtcaacccagcacctagttactaagcccaacacgcattagctattcttcctgaagctctccccaaccctgcccctcccacaggccccagtgtgtgctgttcccctccctgtgtccatgtgctctcactgcagaacaggtgcttctgcacctggctccccagggtcactgggagtcagataagaaaaggctctcagaggctgggcgcggtggctcatgcctgtaatcccagtgctttgggaggccaaggctggtggatcacgaggtcaggagttcaagaccagcttggccaagatggtgaaaccccatctctactaaaactacaaaaattagctgggcgtggtggcgggcgcctgtaatcccagctactcgggaggctgaggcagagaaytgcttgaacctggaggcagaggttgcagtgagccgagatcacgccacagcactccagcctgggcgacagagcgagactcgtctcaaaaaataaataaataaataaaaggctttcagagataagcaattggagttcagaattgtctctagaagaccacacttagaagaatactgattttaaaagggcttctcagcctccacactattgacgttttgggccagttagttcttggttgtgggggctgtcctgtactgctctgcgtgatgtttggcagtattcctggcctctacccaccagatgtcctactgaacacccccctccccaagtcatggcaatcaaaacaggcacagcctctggtgggcagaatcacctccctttgagaactcttcccagcagygttccccaccttaccccccaacacagaggtcttgcagrtaacatagctatcccaagctattccaaagctgagtgaacragaaccagaactccagggctcattccaccaggctgtaccacagttttactttgtgtgtgaacaaaagaacattttcattatctctggtaacaagaagagaaagtcgagtccctgcagggaaacagatgccttctgtgggctcactggggtttcctttctccctgggctgtaagggggccgttcctctcacagcgtgcatgtggcagggagatgtcttccggggtcatagcctgactctgctgtgacccaggcagtacttacttggtgacagtcacagtgatgtctgctgtcctgtttggaaaggcattctcctctagctgccaaacgactgaaacatgagcctattttaaagggggaaaaatggtcagttgattctctctatgccactcacaattcagaccgctagctactcgtggaacagacctaggagacgattcctcagattttcacattcctcacatttttctaacacagcatgtttcctttcccttcctttttyttttttttttttttttttgagagggagtctcgctctgtcacccaggatggagtgcaatggtgtgatctcagctcactgcaacctctgcctcccaggttcaagcaattctcctgcctcagcctcccaagtagctgggattacaggcacgcaccaccacgcccagctaatttttgtattcttagtagagacggggtttcaccatgttggccaggctggtctcgaactcctgacctcaaatgatccacccacctcggtctcccaaagtgctgggattacaggcatgagccaccgcgccyggccccgttatttcakttaagcctcaaatacaaatatggagtaagcaaggcaggcggcctcattccccttttacaggtgaagaagccacttcagagatttcccacagcacagagatgacaagggacagatcagggttaataacttttcgtcttggccgggcatggtggctcatgcctgtcatcccagcactttgggaggtcgaggcaggtggatcacttgaggacaggagtttgagaccagcctggccaacatggtgaaacccyatctctaycaaaaatattttaaaaattagccgggtgtagtgctgcacgcctgtaatcccagctactcaggaggctgaggaaggagaatcacttgaacccgggaggcggaggttgcagtgagctgagactgtgccactgcactccagcctgggtgacagaatgaaactccatctcaaaaacaaacaaacaaaaaaactttttgtctgacacgccctccatactacccacaacttcactctgcttcayggaggtgagcaggcagttcacctagggctgtgtactggaaagctctcrtccccatcaccccctactttcagagccagcttagccactgtaagcactgctggggacacactgcagtcaagcgaagcgcaaagctggaaccgagagattgagrtgagaccaagrtgcagaagacgccaactgcagggtggtgagaagagcgaatcrgtccaaaccgactcacagatgacctcttgaggacggggtgaccaatcctgcagttcatgatcaggacagaagcaaccggctgagggtcatcacastgaatgtttggagagggaggctgttaamagagcagatgacattctcttaaagagccaaacaaaacaaaacaaaaacgtggtttcctcacagcaattcagcaaacattcactaatttttctgcctgtcagacaccctgccaggagctaaagaaataaagtccacttggtccctgtcttcctcacaagccggacaggcagggtcagcagtagatccccgaggaatttaaatacaaggtcgaaggggtgcttctgtgag

SEQ ID NO: 13380 - DNA, 21142 bp, Homo sapiens
tagccattgaacttttgatggccagtgagtatgactggggcccatccaggcagggtgtggagcagagggccctcctttatgggctggactcactagtgggctgcttacctgtgactcacctccaaggctcaagttaatgctaacgtgttgatttgctagaactctgagctgtgcctgtgtctccttgggccctgggagatttttttcttttagcagtattttatggagatattgtctaggtagagtaaaatgtacagatcctggttttctgttgagttttgttttgttatgaggcagggtcttgctctgtcacccaacctggagtgcactggtacaatcatagctcactatggcctcaacctcccaggctgaagcaatcttcctgcctcagtctccctgtagctgggactacaggcatgcaccaccatgccccactaatttttttgatttttagtagggatgatgtctcattatgctgcccaggctggtctcgaactcctgggctcaagcaattctcctgcctcagtctcccaaagtgctcaattacaggtgtcagctgctgcacccagcctcagcctgttgttaatggatgtaaacacctgtgtgaccaccacccagaaccagatccagaacatttccaggctctcgaagactccttcgtgcccgtcccagtcagagacccccaagggtaatgccattctggcctgttgttcaacttgacttgaatggaattttcacagcatgtgtctgtttggatctggcttcttctgctcagttgcgaggcccattgatgtttcctgtggcctagctcctttttattgctgagggccactcagttgtatgaaaaccacaattcattctcccttctcctttggtgaacatttgcactgtttccagcctgggacaatgatgagtaaagctgttaaaaacaggcacatatgttttcctttctcttgggtaattttttagaagtagaaaagccagccaatagaagtagatatttgactgtattamaactcaccaagcagtttttcttattttttttaatttttaaattttttttagccagagtcttgctctattgcccaggctggagtgcagtgtcgtgcactctcatggacacacatggatccagatgccacagcagccttagctggccaaccttaaaacaacacatttgttcttatagtgttggaggtcagaaggctaaaatcaaagtgtcatggaaggtggccagcaggaccgtggagcctctgaggcagtgggacactttggctaagagccacatactggctctggctggcaggcagtcttggccagccaggctgagctccccactgtcggggcaagcctgggtgtcctctggtgatgctgagtccagaacaaggctgyccacattctggtccgcagggctcagctctgctttctagacttccaaataggaagaagagggaaagttcccagtctctgggcacaaccaagaacagagagyaagttctgactcagcagagggattgattcattccatgcaaagagctgcactgccaaggctgacacgagccagggactcagcacacggcatcrcacccagtcctctccagaactctgccacgtagtgttaccatcctgccrttcagaggagggaagtggggcacaggcaggtcaagcaacttggccaatgtctgaattgctagtgtacggagctgggaggggagcccatggggccataaatccagtgcaaaaatccgtcctcctgaaccctacggagcaaaagtgagtccagttgttttcctgggtttcctggacacacagatctgaatttcacagcagccttggctggccaatcttaaaacaacaaatttatactcttaatgattctggaggtcagatgttaaaaggtcaatgtgtcagcaagtttgtttccttctggaggctccaggggagaatctgtttcctttccttttgcagcttctagaagctacatgcatgccttggcttatgggccctcctgccatctttaaaactgtcagctttgtccaggcacattgactcatgcctgtaatccaagcactttgggaagccaagacaggaggatctctttagtccaggagttggagaccagtctgggcaagaaagtgagaccgtgtctctacaaaaaaatagaaaaaaattagacgagcatagtggtgcatgcctgtagtcccagctacttgggaggctgaggtggggggaatcacgtgagcctggggaagtggaggctgcagagagctgagatcacaccactgcactccagcttgggtgacagagtgagatcctgtctcaaaaaaaaaaaaaaaaaaaaacacaaaacaaacaaacaaaaaaccaaaaccagcttcttcttgcttctgttgtcacatctgcaggactcattctcccgcctcccttttataggatccttgtgatcacattgggaccacctgtataatccaggacaatctccccatgccaaaattattgatttaatcacatctacaaagtcccttctacaacgtattcacagtttctggggatttgaatgtggatgtttctggggggtggcccactgataaccagtgttataagtttcttgaaaatccttccagagatattttatctataaataaataaatgcaagtccatagcctccccccacccactttttatacaagtggcatcattccatatcagtgctcagttccatcttcctctttttcttttctttttaaggytacacagaacctattatatggaaataccctaatttatttcacttttttcctgttggaagacttttaagctctttccaatgctttgctttataatcttttgtattataatgctgcaacctatataatcctataaccttgtttgtaggataactttctatttaaaatctcatttttcaggccaggcatggtggttcatacctgaaatcctagccctttgggaggctgagacagaaggatcacttcagcccaggtgttcatgaccagctctggcaacatatcaagaacctgtcttttcaaaaaacttaaaaattagtgaggcatggtggcatgtacctatttggtcccagctattcgggaggctgacgtgggaggmtcacttgagcccaggaggtggtggctgcaatgaaccaggatcacacccctcactgcactgcagcctgggcaacagagtgagaaccaatctcaaactaaaataaaataatcttgtttttcagaatttgagggtgccatttaagacattttgacacttcacagaacttttttggggaacttgttgccttggagattagcctgtcctgtcccacccccatgatctgtacttcctgtttctccctcctggcttccttaattaagccttgtgtgtacttgcgagcccatgtccatcacgctctgccttcaattctggatgctgtgctgtgaatacgcttgagtggaggccgcatgctttccaggarggtgtgtattttcagtgttgtctctcatgatagtatgaaaggctctggagggaatcacaggcctccacaaacaggcaagcggaaaaatgttccacagacatgtttcagggacaacaggcttcccaatcctaggtcgtgctggtccataactggatcaggctgactctccctccccgacaccgctggtgtagacagggacaagaaagagaagtcagagacacaaagaagctgtgatttgcttgaggtcactaaagtacttaatggcagagttcagacctgacctgaggggcaacaaaagacacccscctcaaatccatggggagcagagtctatctgaatcagatcccagattttctggggctttcacgatgccaggtgtgtacactgagctaggatgggtttcccagggttctttgtggtcacacaactcaacaatacagaccaraaagcagtggcgagtaggctgaatttggctggtgggtgttttctgtttggtctgcacagtgtttaacttgttattataggaaattcaaacatgcagagagaattgtaccatcaacaacacacacccatcactctgctccaacaatgatcaattcaggcctatcttgcttcatcctataccctccctcgcttgcttcccttcccaccctcaaatatgtggaagcaaatccagagataccattccattgcaaatatttcattttgtatctctataatatgggaatttggggaatttcatttgagacaggatctcacttggttgcccaggctggagtgcagtggcgtgattgtggcctcaacctcccaggctcaagtgatcctcccacctcagcctcccaaatagctgggattaaaggtgtgtgccacatctggctaatttttttatttttttgtagagatgggggtcccactatgttgcccaggctgrctggcctcaaactcctggtctcaagtgattgttttgcctcggcctcccaatgtcctgcaattatagatgtgagccactgtgcccagccaggaactttaacataatcctttttgacaaaaattttcctctaagaaattagaaaattttacagaaaaataaaaatccagacttctgtcttctcttaaaaatttggaagctctgccaatactgggcccagatggcaatcactgattagyactgagtagatgttgacttttcagatgaggggtgtgacgtctactttgccacagtccccaccactcccccacctggccatctcacccatacacatcacctgcctggctcctttaggcatttaatttgtgtaggaaattgacctaaaggagatattagagaagacattaaaaacttgaagaatgtgaaaatcagccaggagatagaactgtgctttaatgagggttatagaaccacactggatatgargcattttgggaataaactttgaaaattggaagtaccagtttgtgaattttgctcagagagatgaaggtggggggtgggtgacagtggtgaagcatctcctatgtgccagtctcttttaccacaggctgtttctcacaaaatcatcaatcatatgcagtaggagaaacacctttgtattttacggatgagaaaactgaggcacagagaggtgaaataggcttcccgaggtcactcaggtcatatgagcagcagagctaggattcagacctggagttggcctgactctaaaacgatgcatgcctcaccatggcgcattgctcctttaaagagcaccagaagagagaatttgacaaagtggttgcccgyggggcctgggatgggtggggaaactaygctagggctctgggctgctgagggcctgagggaaggaatggggagcccgggcgcagaagtagaggagggggctgccccacggctacagaaggcatctgggaagacactttgctgaaggtggccaggagggcaaaggtcacagtggccattgttatatggtggtggtggggagagggggatggcttcttcttaacyttctcgggtgagtcgaaggtttaccctccagacccttgatgggtcccttatgtcccttggacatcctgagtccccagccagggccctgggcgctttgctgggagcttgacataaggtccagcagcccccattgctacctaattccttagcagcccagggtgtctgcctgctacttccctgcctggaaggaaggccttctgcctggtgcgttcctgctgcagcctccactgcctcttagactctcacacaagctcagctccctgtcgcgtcctctcagggccaggcttctccttatcacaagcttagactgtctgagtaactaattggatttgtgtttgcctccacacaggaccctaagacccgtggggctgcgactccctctgtactggtcacagccgcaccctakccccttgcatggcgctgtcaaacccaggctggccactgactagcgctggaggggagcaaacgggaggccggccacctgactgatggtcccacaccttctccctgcaggctgtccccttttctgggactattcaaggaggtctccaggacggacttcagatcactgtcaatgggaccgttctcagctccagtggaaccaggtgtgtgtgtatatggatggaaacgtttcactccagcctcgtcccttagtaaaccactgtgcctgtgagcctgggttagttcaaacagcaacatccaagctcacgtgcctggctcaggggaggcccaatgcgtccctaacccatgccacagggcagcactccacaggcacaacctgcacccaggggtgccattaacctggactccaggatgaatggggccctgggagctgacggtctaaggagggcgtgggatggtcagagttggatgattatgttctgggttgaaccttgcacactgtgactaagagttgcaaaaatcaaacttcctctatttcccgtaactgctctcatccactctgaagctctccttctgctgatgtgaaaatattgaaaattgacattcaaagtaatttggtctctttcagtttcaaggccttttctggaaactactaagtcaattcaacatactaacattgtatcagggctgtttcccaccccctcctccctcccaaggtgggctgtctgggaacagagaagagctcacatggcttctcagtggctgggagggctctagaccctcacgcaggcctggctgacccctgccgaggcaccctgattgggtgacacagaggtgtgcagctctctcctggttgggtgggagaccacagggtggcttgctgaagtctgcggggcccacagaagagcctctggactcatggttctcccacagaagcctctctgcctcagtcccaggggtcctctccttaagaccttctgggccttgcagatcccaactcaacatcagttcggccactagattcttgctgacctcccccaggagatgccaagggcagggmggccctgatccccctgaaccctccaaccaggggaatcaggaccacacccctgatcttcctccccttcctctcttcctctcccttggcctcccctacctcccagcaccaggaaggcttccgactcccatcctgtcgaatagagacagatcctacctcagagggccctctcctctcgggagctttctgtctctcccttccttggggcaggaatttccaaaggactacagggatgaagctgaagggctccaaaagaaaaaaatacattcagaggtatttcaaatgtamtcatctccatttattcatttattcatttaattaattattttttttcttttgagacagggacttttttctttgacccaggctggagtgcagtggtacgatcatagctcactgcagcctccaattcctrggctcgagcaatcctcccatctcagcctctggagcagttgggactacaggagtgcactgtgatgccmagctaattaatttttttttaaagtagagatgagatctcgctgttgctcaggctggtcttcaactyctgggctcaagtgacccacctgccttggcgtcccaaggtgctgtgattmcaggcgtgagccactgygcccggccccaatttcacatgctctttacatttgttctcttctttcccacttaatcaggcttgtgctagcctccaacaagtgtccactggcatggaaggctctctcttctaggtgtgcttaacaacttccatctttggtaacaattggtaatcactttccaagacctatgcttcttgtttgctaatatcagcacttttccttaagcattttctacttatttttagaaaatcatactgtaaaggcaaaatccaataattgcacaaaaacacattagrtccaaattagagaaacaaaaagatgccaaccaagcagtctctgcgacgcaagttgtatgcaagatcccagacaaatgcraggcagaggcaccgaagccctcctgtgcctgtcactggcaataacccatgccacagaagactatttgctttccctgggcctaggtttgctgtgcgctttcagaccggcttcagtggaaatggcattgccttccacttcaaccttctgtttgaagagggagggtacatggtgtacaacacgaggcagaaaggaagatgggggcctgaggaaaggaagatgcacattccctccagcaggggatgccctttgacctctgcttcctgctacagagctcagatttcaaggtgagcaggaaacccctccccacctctcacccccgggtcycccagctctatcaggcgaatgggctttaagtaatcaccttgattgacattcagccagagtgatgctactatacagataacacaatcatttccttgtaaggtgttaytcatggctgcctagtcatcttatrcacctttatctgaatctacaggtgcacctgctgcttcttttactctgaaaataagaactagaggagtcatcacgttgctgtttggtggtgtgtgtctttgaattccaagctcatgccattcctctgctatcaccacacctcctctccaggtgtctggtaacatttattattcagcgacattgttccagccttcatccagggtctattaagggtatagttttgtaagcaaattgcaaattacctttgcaagcagagtaggtctctgggcttsagaagcctgtgggtaagtcagtccgagtatgcttatctgagataaggatgtccccatccactcagtatgcaacstgaggtcasctctcctctgctccccatgagcattttatgcatatataaataatacccctgcagccataaaaaggaacgagatcatgtcctttgcaggaacatggatggagctggaagcctttatcctcaacaaacacaggagcagaaaaccaaacaccacatgttctcacttataagtaggagctgaacgatgagaacacatggacacaaggggggaaacaacacacccttgggcctggtgggggagggagagcatcacgaagattagctaacagatgctgggcttgataccaaggtgatgggttgatctctgcagcaaaccaccatggcacccgtttacctcgttaacaaacctgcacatcctgtactcataccctggaacttaaaatcaaagttgaaggggatgggcacagtgggtcatgcctataatcccagcactttgggaggctgaggagggcagatgacttcaggtcaggagttcaagaccagcctggccaacatggtgaaaccccatctctactaaaaatacaaaaattagctgagtgtggtggtgggcacctgtaatcccagctactcaggaggctgaggcataagaatcacttgaaccactgcactccagcctgggcgacagactgacattccatctcaaaaaaaaattgttcaaggaaaaataaataataaataaatgaaaccccaggtgagctaagactagaaagacaaacctactgcaggaaacaaccagaagaatgaaaagtcyaactggagccccgtagagactcgggttgatgcacttcrggtcacacacacgttcctgtaactggccccacactgaagaccagactcaggtcttcattttctagaaagagggtccaggagctcaggggtggtccccatcccagcctgggatgcctcccccggaacacgtgctctcctctggcaggtgatggtgaacgggatcctcttcgtgcagtacttccaccgcgtgcccttccaccgtgtggacaccatctccgtcaatggctctgtgcagctgtcctacatcagcttccaggtcagactgtscacctggcaccggtcccaggggctgggatgcagggcccagcrtagctgtgtctaggcccwgctgggtgggcccaagccaatctcctacccaggtcactctggggacaacctctgcttccctgtcccagtacctgcccgccccttctcctctgtcactctgcccctccttctgtgttactgtccctgtccggaacacctgccttggtctcccagactcctcagctgcccctttctcctcaccccttgatttccaccctggttaggaggccatattgttctagaaagaacacaggctaaggaaccaaactgaatccagttcaaattccaagctctgccattcatcctctgtgggatcttagacaagcaacttcacctctctcagcctwggtttcttcatctgtagaatggtcattgcctgccccccatgggtggttgtgtggttcagtgaggagacagatatcagaggtcacacagtggcccccctgggcccacaccagggtctgtttgacctctgtgttttaacaactttgaatgtgttgccaacatctaaaaggtcaggagagtcaggtatggtggtggaggtctgcagtcctggctactcaagaggctgaggcgggagaattgcttgagcccaggaattagagttctgcctgggcaacatagcaagaccctgtctccaaaaaactttgtttaaataataaaataaaataaaacaaataaaactaaagaaggtcaggagataccaataccacgtgaaaaatgggaagattagggtatgctgggcccacattcccacagggcaccagcagctgggtgggagctactattacccttttggcattcgaggctgctccctgagatcagcgaagcacacagtaggccctcagcaaatctgggcttctcgccctttggtcctcatctctgactttggtccctctttccctgactccctcccctgtgggtgaatggggagggaagagctggagggagaccgcacccctgcactgctcaccagagcctggctctttcccatcccatcttggcatggccctaacccccttgcctcatccccctgcctgcctggtctctccctcttgcccttgcctctgcctttcggcttctccttggctctattaatgcttctcctcactgcccggtgccttttgttttaacagaacccccgcacagtccctgttcagcctgccttctccacggtgccattctcccagtctgtctgtttcccacccaggcccagggggcgcagacaaaaagtgagttcaacacagaggccctgggtggccgagcagacagtaggaaggaccgagggtctgagaggctggccccagccagcaggccactcagggcctacaggccccatcttgcccactcaagagttccctgtctgtctgccgggcacccagagctggggacctgggggtctccctgaattcttcattcccccttctttacgtctctccaaggcaccaagaggcccgaagccaccgacatggcccaggcctccgggattcctcaccatgacgacaggggtccagttccccaccccccacacccaaccactgtcacagtggttcttataagcacttaagttcttataagtgcttcttataagcaaatctgatcacaccctctccctgcttaaaaatcttcacagcccccagcccttcaaataaagcccaaattccccagcagggcatacaaattcctcccagtctgaccccaatcaacctcgctgcctcaccccyaaaccacaaagctcacgcagcctctgcagctcactcaaggccctctcgggccaccatgtttttgcatatgctgtccctggtcccggaagcatcctctgccagcctgcccycagcacacgcctaattgcccttccatgctctgcctaaatgtcgctcctctgggagtcctccccgcctggaatattgttggacgctcccccatgaccccacrgagtctgtacgtatctgtgccatgccagttcaaagcacyccattgtaactgtgtttgcgttgtctgtccccgtcactccacccccatctccctatgcccatgaggcttcagagggccgggactgtgccttgttcatttgcactcagtgaatgaatgtggaatgtggttcacacagccagggagaatgggataccagccagggcaagaacagtctactgggtggggcaggatccaggacaaggaggtgagcagcccttcctctggccactccagtagtggggactgggaggaggggcgctttgtctatgcagtcttcttacggctcatcacggtacagacagggcacctgcctcctgccacgctgacttcaggactggtcgagccccagggaacatttgcagcgcagcccaaatttggccctggccctggggaggatagaaagtgtgctggatacagtcagacagaactggctgccaytttggatttgatgccttccacctgggcgagcttgggcaagttgcttaatctttctaagcctcattacctcaccagggacacaggagctgaggctgcttccctcattggaaagcastgaaacccaggaatcagcccacagtaggccttcaacaaataccacttctcaccttagtggtaaaatatggcactggaagtaatgctcttggctgtgggagctacagagagcaatgaggtctctatcaaacccagcctcctctctctcragaggaaccaatggggataccctaccccccaaccccaaagccctgtgcacctgggggtaaaaatctgggtgccacgggctcaggaaggcttgcttgggagcaagagggaggtgggtgtgtccggggaggcatttctgagcacaagagcctccctggagttttgccaccatctcctcccattctgtggtgcccgcgataaccaccattctgactctcctcacccctccagcctcccggcgtgtggcctgccaacccggctcccattgtaagtctcttgctttctttttggatcgtcctcattttggcttttctgggctcatggaggaggcagggccaggcattgggcctctcccattgggagtrgggagggcacaggccaggcccttgaccatctgcccggcctggtgaggttgggggttggatgtggttggctggccgtgatgaaacaayctgagttgccaccccgtgggcagccacggaagaccatgccccacattcacttctgtcacctgcaaagggaggctaggctgagagacgtttccccgagaggaaagatgggccagagccaccagcgtccccatctgtcttctccagggttctaacctttgcccctcgctcatccccttgagagaagagacacctgggcccaccctctgtggggtctgtggggccattgggcttgttacgccccctggagggtgcctgccgtgtggcgccctctggtgggagctggtggttttcacacgtgagagcctgggtgagacctggtttctttcttccagacccagacagtcatccacacagtgcagagcgcccctggacagatgttctctgtaagtctacaagttctggtcagttcacagctgcacagtgtcctccttcaccaagaactaaattccctagagcgctagagttgggaagaaagcggtttagcaaggaggatggggacactaggggctgagtgcttggctcaggtgacatgtggctaaagctgtccttgggacagcagagattctggaagaagcaggatttatccagtggtggaagaggcaagccccctagagaccgggagggaaactggtctgtctgtcaccaagtggggagtgcagtggccccagcacccggatgtgaggttcctggccctgcatcctgggtccccaggatgtcactaccgatcataggcttaagctcttctcctgctggtgcaaatcaggccggaagtttagcgttagtggggctgcctgcagaggggttgagggrcaggtgaccgtggtggagtccgggaacacggcaggaagttccaggaaggctaacatgaaaagggaggtggatgggggagtccaagggccaaaggctcatgaggtcagcctcacagtggagcccstctagaatgcatgggtgcgcgtgggtgagtgctcgcgcacacatgcgctctcccattgaatttcctggtttcttttcagcagactcccgccaacccacctatgatgtacccccaccccacctatgtaagtgrtttctcagggagggcggaggttctgtttgtggtgggcaggctgggggtgaagggccacttcgggggtatccactagccttgcaaaatgaaaagcgaagggctttcaaaatggtaagctgaagggcttcaaagcttcccagcgaattagaagactgtggagaggagctttcaaccttaaaactgtcgtgtcaatacgagcgcattgcatggctctcccttttcaccccacgagatgagtctttttgtgtttggccaaagttcctttcatgacactaatctaagcccattaatatgaggagcactggaaagttttcctttggcttttatggaaccaagtacagatatcgttggtttcttcttagctgacagcccaaattcatgggacctggtacaatcttcccttttgtgtggtgggctgccctggctgccactggctgacccatgcctctccttctgaaagccgacgccttttgtcaccatcattccgggagggctgtacccatccaagtccatcatcctgttgggcactgtcctgcccagtgctcagaggtaagctaagggctccagttgacctctgggaagagagagcccttcaaggtmattccagccattcccctggctttgggcaggctgtggatgacggggaggaaataaggcccagaactcagtggacaaaggtccaggtgggctgcccaccccaggttccacatcaacccgcactctgggaaccacatcgccttccacctcaatccccgttttgatgagaacgctgtggtccacaacacccagatcaacaactcttrggggtctgatgagaggggcacagctggggagaggtggggagtgggcagtgaagatgaagccccatgctcagtcccctcccatcccccacgcagctccaccccagtctcaagccaccagctgtccactcctggtgggaggtgacgtcctcagtccctcccctctgacctttaacctaactctcaccttgcaccctgcatcaacccttcaccccctcctggaaagccagcctgatggcatcccactggcctccaccaactgaccagagtgttctcttcaggggactggctcctttcccagtgtccttaaaataaagaaatgaaaatgcttgttggcacattcatgtgggttgaccgtggcttctttaattcatttggagacattttggagtctgtggaatcgggcggcggtgctgctgagaggagtgggatgggaaagcatggactccctttgggcagggggtcctgacctcacacctcctcccagagggtccctcacaaatcccacgagggtgttggagaaagcaggctggggctctagccttttgggcaggagtctcggacacaggaaggtggtaatggggtaccccaggaaacagccccatgcctccgagatgggagaggggctggggcagagcctgtgagggccacagcagggtcagagctgcctcctcagacctggcgtcccagtgggaggaggtggcttggggaggggggtcaggagaagccaacccgaagcaccgtctgggtgtgtgttccattgtgggtctctccggcattaggggttagggcttgcataggaaaagtggctcagtgttcatgtgtkgggttctgccagccactgggccactgccaggaagcccgactctgcatccaggtgatgccaacacatcctgctcagcccagtaagaatccagttcctcaggccccatagtagtcctcagagcagtggcaccagctgcatccgggagtttgttggaaacgcagcatcccgcgccccacccgacctgcgaggtcagagtctctgttttcacaggaccccagacgaggtgcgcacattaaagctggaaagccctggtccgggagcggactcctggccttgttgctgagatgcacggctgtcgcgcagggcatggagctttcctggagcctgaggttggcactgccccttctcctgcccctgagatgctactgctagaaggggaaggtggcgggcaagggggtgaagtcggccagggcacccaggaggcagaggccaaacctaagctgggagccgtgtgttgccaggaccccagtggccgccgctgagctccttttttggttctgaccaggagaaggaaacggggcccactctcctaagaaggcttccttggcctgctccaaacccaagagggtccccagtccctcaggcgaggatgctgtggcccacamtcgcctcgacacgctgccttcccagggaccacatccgtactggccaaggcacagtctcgcatgagactggtggccccagagcaaaacgctttctaagacagtgtccaagaagaagctcaaggccttcctcgaaacactggccttatgcgacaatcccaccctcaccagaccccgtttcagatactttgtgtgggaggcaggcctgcgccccctgccctaccacaggtctttggaccagcacgaagctccatctgctgctggcacacctggcagccatttcagaggagccatggactgsctggggtgtccctctgtcggggatctgtccaggctgtgacacccaccagctccccactctgagaagagctttccctacaaaacacccacacacgcatacagtgtgattaaagtaaaatgcaattcatgtaaatatctccatcaaggaatcatacagggaagacccaagtggccatggggaacagactgggtgttagttttttaaatacagaggcataaataactgtacacaaggcagttaaatacacagtggtgcgatagcacctcctggtggtcacttgaagtggtgcactcagcagcaagttccatctttcacccacttgccaggcctggcatttaagatttygtctccaagggaccagggaggccccagtttgagagaggaggctccgatcaatccagggtgctacttgttaggaggtcaagtaaagggcttgatggggagcaacgttgaggaaataagamttgaggctgggggatatcactttcctccatctccccaggccctgtgacctcrgataatgcagagctggctccatccttaagttctgtgccggcagctttaacccctcctgtaggccctcagagygctgacatctccaggctgctgggctgcaccgccaccctgtccttcttygcctcgtaaggaaatacagcaccaaagatatcttcgtgatagcgcttctggctcttttaggtaaaaacagagagcaacgtgtcaagtccaggctgggatgagcccctggggttgcccagcttccytatcacatggaccttcatgagccatctgtcttcccaactgttatacttagattgtgcttgaatctggtttagaccctaacsctgctcagcacctgctctggtgcgggccctctaaccatctccaaagctttacttagcatacccatttcctgcccagcgttcatcccccacccaagatactccaggaagtgtgagctctgagataaatatgtttgggaaatgctacgtcctttctttccttccagccttgaagggtcctgatgaacagcagcatactgaaggctcccagaagtcttgtagtaaagcaacgtgtttgccttgccttaactaagcatgtcccaggctattcgaccttggaatctttttgatgccaactgtctaccgacccactgaacacatttggggaaatgcctgttatctcctcactgttcttcaaacacgccagcttaactcccacccccggggcctttgtacctgctgcccctccagaacagcccagagtgtttccttcagtatccacagggctcctcctcaycatctcaggtttattctcagatgccaccttccagctctgccttccctggccaccctatttaaaattacactccccagcgttccctgggctgtttcctgctgtttttctctgaagcactacacctctttcttgtctgggtttgtcagccccagtagaatgtaaagaatttttgcctgattcatttactgctctatccctagcacatagtaggtgctcaataaatgttcagttgaacgtatgaatgtgtcttagggagagtatggaagtgacaatcacaggctttggaaccagagagaggcagactgaactctaggctctcacatttactgctgtggtccccgtaggcccccttccctctgtaaaagggggtgcctccctcataaagtcctcggcaggactgaatgaaatgtcacatgagaatccttggcaagcagtatgcccagtgtaagcccttgataaatatcactattatcttcatcaataaaatgcaagcccttcctgctggggggatgagggtgagcagacaccagcctgggtgtaaataagaagtgtgaggttcacacgaggctgacggggggcagccttgctctcccctgtgttcacagccttgctttggccacacagatactttctgaaaggggggtttggggagaggccagggagactctcctgcccccattctacagatggaaaaatggaacacattcacccgacttctcaaagctgccaactggtccaggatgtgcagtarggccatctgacagcccacccagctcagatctcagccactgctaagattctcttggggtccagaacctttctgggcctgattcccctgggtctacctgccacccctggtcctggctccaacggcctgtgcccttggccggcaccttcagcccacacacccactactataccttgagctgaaagaaatagtcctcgacctgctcctcattcaatttcagcttggcagccaccagctgcttcagggtgtgggccacgtcccgggccatgcgcacatccccgcaaacatagaggtggcctggctccttgtggagcacacggagcacctcgctggccagctgctgccgcaggatgtcctgaacatagacctgaaaccagaggaaacagtgggttcagtcctcagctgctcaggacaaggcttgcaggcaggcctgctggcctcaaggaggcggggagaggggcactaaggggtgaggagtgagtccccttccagccaggaccttgcaaggggccaggctcaggatgaggtgcatggatgcccctggggctcggctgggattagagagataaatgctggacacagtcctgccctcgaggggctgaccatccagtggggatcccagactgtctctgaatttgccatgcttcaaaaaggcatcaatgaaggcagtccccctgcccagggctctgcctacaccccagaaaagggagcctctcaatgcagtctacccattaggtctctgcagggtatggatcccgggctccccagatacaaggtccaggagtcagtcagggactctctgctcctgctccacacaggatgcccagtggccccagcactgggcacagagcactgggcccaagaggtgccctgatgggacaaatgtgtgaaggcygagagtctattctgacaccccaggctcagggggtaacgcggccctggggacagaagagcccctctgatggccgtggtggaagcatcggccgccctccagccttgcaaggcttgagcgtagccagcctggaccacctctccccgggcagtcgcgtgtcccagggggcctgctggggaccttcagcaggctgggctctggggttaacccgcgtgtgacctaggttagtcctgaacctctccaggtctgtcgcttctgctgtatgagagggtgtaatgctcttcacagcatcactctgatggttgtgaattaccagcattttcgagctcaggaggtgaaggctcggggaggcgaggggcctgtggggacccagggctcacagtggagcttgtgtgtgtaatgcttcacctgctttgaggctgcatttaccttgggcttgccaggcaggcgggaataggctgtgtgcaccgcatgcagcacccccttctgggccatctccagcatctcctcctggtagatgtggtcctcatctgggcggcggcacccaaacaccaaggtcatgcggcctccccgcactcctgcaggagtcccgggctgttgttaccatgttggccaccagagggcgccagggctccaagcccaactggaattctcacttcactcccactagctatttaatagcattatccycactttacagatgaggaaactgaggcccagcgcattcagatcactcatccatagtcacagaactgaaagtgcggatgcagaattccctcagccaatcggagatcaaaagcagggactttcctgttaccyccactcccaggagagggagccctggctactatgcgggagacggaaaggcagccattctaacccgcagaggcccgcacagggaagcaaacttgggaggccttccctcgagagaggtcaggaaccgtttgtggggctgcagttctgctcctaggcaggygctggccccctggtgcccctcccacctgggaagcctccagccttacccttgtgctgggagtcatggagccgttgctgccagaaactgcggaagggcgcgatgcctgtgccaggcccgatgaggatgcraggatgggagggatcctcggggaggtggaagccgctggcrctgaagaggacaggagaagagggggccagtcctcagacaccccaggcccacgcacacacaggatggctggggagctgggcctgtgggaggcggtcgtgagggggtggagaggacaagaagctcctatttgatttcccacgtcctgcaggctgcttcacttctgtccaggcaccagcacctcccccaggtccttctgwaaaagggccawgctcactggactcttgagacccacctgtcatcgctgtccctgctacaggcagccacaccagtgtgaccycagtgccttctttatgggccaaggggctccgagcgtctcctaaaccccagatccctccctttcctcccggaactcccaggggtcggcggccccacaggggacagagtggaaggggtgcttacttccgcacaaagcagggcactgggtcttggggcttcaggctgttgagccatgtgctgcagacgccgtggtgcaggggaccctggccatctgcaacgataccacaaagtgaccaacgtccccccactgccc

SEQ ID NO: 13381 - DNA, 14248 bp, Homo sapiens
caggtcacacaactggtcagttcagggtctggctcctcctgcagggtacagcgggtacagtcagggatccttgtgagacagagattgcgagtcccccatgccaagggggcatcttcagccctgccctgccccatccacctgcatgcccagttctgccttaggggaggagaagatggactgggcaatcatagacacgggtcactcatcaaggccaccggtgattggcaaagccttggtatatttgctgcagctcctggagcattgggggtggccaagccttggtttcaatgaatcaccctaccaaggccctacatacacactcagtgcacccctcagtgcacacgccccctcccagaactgcccagggccacagcagcacacacctccaggggtgcccttctcgttgcagtccttgcagacggcctccacattgttgtgtcaggtgcaccagccctgcacacgcctgtgctcttggacacacacccacctatttgcccccatgcacacattttccaacagccccccaagccatcccatctgctccactcacagcacaagattaactcagtcctacttcatctccccgggctgttttcagatgccatcatcacagaaggcrgggagaatttcagccagggacagaggcagctgttctgcctgrccyrggccttcgtgaggaagaccagcatcttcatcatggacgaggccacggcttccattgacatggccacggttggtcctgggcccctccatgggaccatggtcttggaaagggtttagtgggatgctagggagaaatttgcacgaagtagtcctgaggctcaagttgcctctaacatcaaatgctatgtgttgcagaaaatgaaaagagctggggggaccctgactctgtctagtcttagggaatgttacacacacacacgcacacacaaaaacactatgcaaacacacacataagctgcacacacagacccacacagacttcacactgtcacctatcacaacagcacacacacagccacaaccacaacctacatacacacacagagctgagctcccaacaggctgagtccagtccctgagtgccgggaacctgttcagtcctgtggggtgggggtgggactaggatcggggtcagatgggagctgagccacagacctgggctccacatcccccaagccaggccagaccccatccactgggcaggtgagccaacagctgttgcccccacttggcaggaaaacatcctccaaaaggtggtgatgacagccttcgcagaccgcactgtggtcaccatcgcggtaaggggcccattgatggggtgcagagggacacccagggacaggactggcctsttgtggccgtcatcagtgcacagcccctgggcttgcctggtcccagkaatcaagaaagaaccctgaagcaggcagttcagggcaaggggcctggagggcatgcagggagcctgggttgcaggatttggggtgsggggttttgcccctgtgcttccctcagacctcccctctccttctccaggttccaaggcctgcccctgtcccaaggccttatatgttaggctggcgttacttctccataggaagtgggggaggggttgtggagggtctctgagccttgaagcctggaggtggggtagagttgggacttggagaggagagaagggtggtattagcagatggagagcttgtagtcacatccaccccaggaaagtgcagtccccacagtgacaggacattctggccacatgcctcatcctcctcctccaagccgcaggagggccaccctcagctgtggcccccaccgcgggtggtrttcccaccatcctgacccgccccctcctgccctgcccagcatcgagtgcacaccatccygagtgcagacctggtgatcgwcstgaagcggggtgccatccttgagttcgataagccagagaagctgctcagccggaaggacagcrtcttcgcctccttcgtccgtgcagacaagtgacctgccagagcccaagtgccatcccacattcggaccctgcccatacccctgcctgggttttctaactgtaaatcacttgtaaataaatagatttgattatttcctactagaggccctaagtctggtgggcaggggctggcggtggatggtgggttcagtagaaccagcctggctctgacatcaggcagaagctgtgtgagcaaaagcctgcttccttacctgtgaaatgaggcctctattagtcagccaggctgccacaacaacatatcacagactgggtggctttaaaacagacttttttctcacagttctggaggctgaagtctgggatcaaggtgttggcaggtttggtttctcctgaggcctctctccttggcttgcagagggctgccttctggctgtgtgctcacatgacctttactctgtgcacatgcatccctgctttctctctgtgtcttaaaaggacaccagtcatattggattagggccccacccctattacctcattaaaccttaattatctcytcacaggccctgtttccaaatacagttacattgtaggattaggcttcaacctgtgaatttggcaggayacaattatgtccatagcaagggtgatagcatttctgcaatgagcttatcagataaggtaacagatctccatacagcttggtctcctttcttctcactttcattcttgaattaaaatctggattaacactatttcaattgcaaatgacaggaacccaattcaaagtaacctaagcagaaactgaatttattgaatatgtgactgacaaggctaagaggtatactacttcaagcatggctggacccaggtgtttgacatccatctgggatgtgtcttcctttctgggttccattttcctccccttkcattatgacagatggccactagcaggtccagcttacatcctgccccaaggcaacccaagaggcaaaacagatrctccttcccaatagttccagcaaaagcttgggagcaaatctcaatgcaccaacttggatcacattcccatccccaccccactgtgatcagaggggtggcatacactggctggctaggcctggatcatgtstccatctccatccctcaagcaggggcattcagaagtggaaaggtggtccttcagagggaaagcacagtgcatgagtcacaggtcagccaggtggtgtctgggagacgctggagcccagacaccagggagactaaaacagcagctgtcctgacttcctctgcatcacgaaacaagagtgcacacctgcccttggccaagaaatggcaggtgctcatttacatctcattttatgatcatttgcatatcatctgcagtactggctgcaccaagccctgaggtgcagacctaagagtcttgaacctgcatcctcttggctgcaaggggatcatagaggcacaacataagaaaagcccaccagttatcggaggcaggtccagtgcagacccctgtggatgttccaggagccagagaagctcggaaaggaagagctctgtaaagcctggcagcctgcctggaaaagacaaaatttgagttaaayattgtgggggatagggattggttaggcagaaagtcagagaaagggttggggtggcaggtagggacagcaggagctaaggagtgatggtggaagtgtgttaagagtgttggttgatcagggaggtgggagagagattacagcagtggggagggcatcatatcagagagccctgaatgccagagcaaggagtttggtttatgcccatggacaaaaagggagaagggttttgagcaagaaagcgamttgacaagttcagtatttggtggagatgactataagcaagtgcaggatggagcaaaaggggaggctgagcctttcaggtgggagactcagcctctcagaagggtgagcagcagggagggaggtaaggcctcaaggctgcaccaggaggcagaacccagcctttccagctctgagatttccccaggggcccagcagcttcctccactgtgagatctcccaagagcagagccggggaactgaaagaggactccacaagcctaccactgctccaaagccaccccacctcaacagattgaagggaagtagcaggggcagggctgggcccacagtgaggtgttgcagggatgcccaaggtcatcctggcccaaaatccctgtataacatccctcatggcccaccgacttgatttgggtaccccacagatgtggctcatctctggttattgttattagaactgactcttgcatatgtgaaaccaaagcctgcctctgttccacttagtgtcctggttctaccctttgggccacaaaaaactactagtycatcctccttcaaggccaggtgtttctgcaatagtgcccaaatccctgggggactttccttttctgatggctggacagttgtagttgcctcagagatttccccatgtaaccctgtctccttgagcttcccactctgctcatctcattttaccctccccttcctagacactgcatctttgttaatatagcccatgatcacacccatcctttgtagcggtgttcgctctgcctgcaggtgggtagggagagaaaggaaaatccaatataaaatgcatatcttgcccccactgtggcccacagccacactgccttttccagaccctgtctcaagcccccactccaacaaaatggccrcagatggtcaggggttcttccataaggatctgagccacagacagcggtaaagccgttactgttccaacaacagagatctagcaggctttccctcccagctgagaacccgggtccatgccacagggcagcctcaggctgatgcctgaacagaaacaccaccatgccgggaccaagagcctgggtcccccagtgcccgaggcagccctaacacactgttcaggcctaaataccacccatgacctaacgtggaagaagtcaggtgacaggtgtgagaaagtgtaaagcaagtggcctcggctcaaaccttctttaaagtagggccggaatggctgagaagatggagccgcccaggctgccccacagcagtagcaggtgttaaactgtgctcctttcctgccgaggccttttttttttttttttttttttttttttttaatgagagggagtctgagcttccatcagattgtcaaaggattcaagactaagattaagagcatcccccaaagagaagcagctgcaggttgagaagtcctcggaccgcctaatttccgccagccctgggattggtggcgccgcctctcagcgcctcctttcccggggaacctgcaaacctggcgcggccgagaggcggattactgacccaaatacggatggggayattgggggaggggagccagggcgacagggcggcggccccagactgggagggcgggtcacagatccctcccagccccccactttcgtagagcgtgggcaggaggaacctctgggttccgcggatcagaaaaactccaaaggccgggttgtgagtcccgggaggggaggtggagggcgggggcggggaggggcgcgggaggggcgggggcttgctccggccccgccccctgcgctccggtgcaggtcgggctccccctggcggtccccggccccgttcctctcctcgtgcgcccccctcccgccgtcctagacccctgcctagcccaggtcggtctccgcggacccacggacggacagacagacgggaggacggccagccgcgagcgcccgggcggcgggagggggcggggaggcgacggccgtggcgtgaggagcaggagcaggtgcagcggcggcggcgggcggggccgggacccggcgcggagcgggagccgcggcgcgggcgggcggcagggaccgggaggccgcgactcggagtcagccccgccgggtcgcgcgcaggtccggggagccgcggttgagccgggtggggtggtgactccagagaacgcaggatcccaaggagacagagaggacgagagctggagggggatccggaaagcggcgggggcgctccgggaggggtggagtaggacatagggggcgcacctggaggagagacggggcgggggtggccaggacctgagctggagcctgggagcccgaaggccagacaggtgaggcgggagacccggaggtgggggtsaggtccggttagtgggagagatccggaggtgttaagttctgagctgggctgggaaggcaggctgggcggggagaarggctcttagcgggaggcccaggggtggtcagctggtgggggaagctgggggaggacgcagggccaggtggagagccggcagggttgggggctccctaggcgccaggcaggtgggctcaagggtgaggctgttttttttgttttgttttttgtttttgagacggagtctcgctctgtcgcccaggctggagtgcagtggcgtgatcttggctcactgcaacctccgcctctcgggttcaagcgattctcctgcctcagcttcctgagtagctgggattacaggtgcgcaccaccatgcccggctaacttttgtatttttagtagagatggggtttcaccatgttggtcaggctggtctcgaactcctgacctagtgatctgccctcctcagcctcccaacgtactgggattacaggcgtgagccaccgcgcccggcctgaggctggtattaagaagtgaagtgggacccaggtggaggtaaggaagagtctggtggggagttatctcagargtgaggccagcacaggctgagtgcagccccagggtgagaaggtgcccaccgagaggactctgcagtgaggccctaggccacgtccgaggggtgcctccgatgggggaagcccctccctgggggtcaccggagccatgctgtcccgcaagggcatcatccccgaggaatamgtgctgacacgcctggcagaggaccctgccragcccaggtaccgtgcccgccagcggagggcccgctttgtgtccaagaaaggcaactgcaacgtggcccacaagaacatccgggagcrgggccgcttcctgcaggacrkgttcaccacgctggtggacctcaagtggccacacacattgctcatcttcaccatgtccttcctgtgcagctggctgctcttcgccatggcctggyggctcatcgccttcgcccacggtgacctggcccccagcgagggcactgctgagccctgtgtcaccagcatccactccttctcgtctgccttccttttctccattgaggtccaagtgactattggctttggggggcgcatggtgactgaggagtgcccactggccatccygatcctcatcgtgcagaacatcgtggggctcatgatcaacgccatcatgcttggctgcatcttcatgaagactgcccaagcccaccgcagggctgagaccctcatcttcagcaagcatgcggtgatcgcyctgcgccacggccrcctctgcttcatgctayrtgtgggtgacctccgcaagagcatgatcatcagcgccaccatccacatgcaggtggtacgcaagaccaccagccccgagggcgaggtggtgcccctccaccaggtggacatccccatggagaacggcgtgggtggcaacagcatcttcctggtggccccgctgatcatctaccatgtcattgatgccaacagcccactstacgacstggcacccagcgacctgcaccaccaccaggacctcgagatcatmgtcatcctggaaggcgtggtggaaaccacgggcmtcaccacccaggcccgcacctcctacctggccgatgagatcctgtggggccagcgctttgtgcccattgtagctgaggaggacggacgttactctgtggactactccaagtttggcaacaccrtcaaagtgcccacaccactctgcacggcccgccagcttgatgaggaccacagcctactggaagctctgaccctcgcctcrgcccgcgggcccctgcgcaagcgcagcgtgcccatggccaaggccaagcccaarttcagcatctctccagattccctgtcctgagccatggtctctcgggccccccacacgcgtgtgtacacacggaccatgtggtatgtagcccrgccagggcctggtgtgaggctgggccagcytcagctcagcctccccctgctgctcatccagggtgttacaaggcacttgtcactatgctatttctggcctcagcaggaamctgtactgggttatttttgtccctgctcctcccaacccaattyaggactggctcacccctctcccccgcccaaggctgcagaggctgtgggaggtactgggccctagagctgtgcrtccagccagtcctgggtccccacgattgaccagccacactctgggccggtggctggggaagaacaatccccgagggctgctgctttgygtctgtggctccaagaagtgcctgtggtcaggccccagctctacttggtccctgaaaaagcaccyggctaagggctgggcctggccagcagggagggcagttgatgagagagggtgttcccgctggagggttggtgctgtggagcctacaccggcagggacagcctggggctgacagggctcccctccgagggccagtttcaggtctggaaggggaggaagcaggggaaggtgacctgaggaggctcggctttgtagagccccgctcaggcacagggaggaggagatgccagggctcctgccttttgccacatcggcctcgtgcwgtgagggctctgtgggctggggctgctgcccctgcctacctcctgcctgtccccagaggctgaggagagggggtactgtgcccaccacacatgattaggcctcagacccaactctggtcctggctccacaacagtggctgccactcrctttgtccagaaggtggcttgggggtggatatctttgggttgctggaaaaggtgtgggaaggttcaggatggtgggagggactgaggtccctgaggtgaagaggcccttggtcctgacgggtttgacccgtgcctggaccyttggagcagtgttgtgtgaacttgcctagaactctgccttctccgttgtcaataaagcctccccctcatgacctaaactctgggcttttcttgctggggaggcagcaagcatgctggtgggaagggaggcagggactggcagctgccacccccttcaagaggcgccatagaccctagcggggagggcaggggagggacggaaggctggcacctcttccaccagttcagggggactttcccctctcctgtctcaggtggcccagccctgtcagcctgtctggccaactcagcctttgggcactcaccaggctttgcagccctgggctctgtctctactcccagggacctgctggaaggctggagtgcccagggagaggtatagaggtgtcataggcattagtgtagtaattggagcactaactctcgagccaactgcctgggttcgaatcctggctctagctgtatgacttttgtcaagtaacttagcctctctgtgtctcagttgcctcttctataacatggatgctaatagtacctacctcatagaattgttttggaagtaaatgaaaaatatgtaaaatgctgaagtgcctggtctacagtaagtgctcaataaatgttaactattgtgattgctgctgaatcagctacatgctgaggaaacggccaaacaagtgttaaagagagacggtgcttttattttgcccttggtcatgtttctttgccaggtctttctttccacacggtgtcccctcctagctgagaccacgattttaggggctgtggcaatgcctgtgacctggtccccttgtctccatctcacccactgtagtccatctgccacrcagcctccagggtggtcttagaagsgtgggtcaccccccacccycatcatgaaataccttcggtagttccccatcacctctgggtcaaggctagcttcttagcagccatttcaggctgtgactgcctctccggccttatggcccactgttttcttgccaggagtctgcacttgcccacccacttccctaggtacctcgctgtcctatccctcctgacacataatgttgagcttcctacctcccagaccttgcttatgttactcccttggcctggactgcccaggcctcatctctgtctgttgaaatccataaaaatccaggctgagtgatgcctcctcgaaaccttccctgatttctctggaaaaggaaggtcccttccctctgctgtgctgtgggcattctccttttgcctacgtttaggggtctgtctccccatccacaagtccatggcttcctgaggtcagggactgtgactcagcactgtggctggcttacatggagtaggtgctacatgaatgaacaaatgaatgaatgaataacggatggatggcgtacaggacaaaaagccagggttattgctrcagtgtgaggcctgcagacagggcatcagtgagggtctgtctcaggcggctccagaggcagggccaaggggccaggaagttgccgctgctggtctgagctstaagctgccctctcccagcacccatgcagtccccagcgctgattcccttccttgcagagctgacccatttctggttttgagggtgaaggggtgaaagctactcagtcagcccaggatcctaggaggctggctcttgcgactcagcttggctgccattaaggccaaggagaaaggccagactcactaaggacctgctggcagtaccatccttggagcccaaaccagagtaaccttcctccacccctcagggaccttaagctgctggtgagtgtgaagcccacagaactgagggcttagcgccacctgctggccacagagaagacttacttcrgcagagaaaaatcaggaccactggtcctaggttttccaccaactctgagggagacccccagccttaaggcataacccagggaggggctggaaagctccaggcatagagaggcagttcgaccaagcctccctcctccgcgaaggtgttcttgcccactgatggtgctacctccatytgggggcaccctttctctatggcactggcctcaactggacaaagaagttcacctgagcactactcagcccagcaggaacttctgtgataattttktttgtgatattctrcctccaggattgcatcccttagtcatcatgtgacagcagaggaagcagtctggcccatccacacgctatgtgcagagctgtctcaactccagggcccctgaaaaggagaagggaagtaccatgtrtcactgtggcccagcaggactatgagagaagcactgttcttctttgagtttgtagatgaggacacagggtcagaaagggtggtgtcttagaccattcaggcttctataacaaaataccatagactgggtggcttataaacaatagacatttattactcacagtctggaggctaggaagtccaagatcaaggtgccagtggattcagtgtctgctgaagggcctgtctttcccctgtaatcttacatggtggaaggtgtgagggagctctctggggccttgttacataagggtactaatcccattcatgaggattccaccctcatcacctcccaaaggccccgcttccaaataccatcaccttgggcatyaggatttaacatgtgcattttagggggacacagacatttagcctatagcaggaagtaatttgctaagatctcacagctagtaggaggcaggtccaagatttcagccaaagtctgtctaatgccacagccctgctcttccctcccsctctttcccctagcacacagtcccagtgacctaagctccagyttttagtagggctgcaccttgttctaagtgtcacattcaccacagggagaaagttgtctccaaaccaagggaaagagggaaggtggaactcagcaagcccctgggcctccctgagatcccagattggaaactggcagcaggcttggctgttytgtgacagcctagattatgtccagaacacctatggagtcagaacaacctcactggcactttttctggcccacgtgcatgatgagccctccatcttcttccttcttacaggaagactgggctctttgctttacaggctcttcttccagccagtcaggtgtcaatgcagcctgattgggcacatctgccacccatctgtccccaactcatatcaatggtgtgagacatgtcctgggcctcagtcctgagcttcagagggaaggcaagccaggccaccytcttcctgtgtgctagtctagaaaaactagcccactcgcacactagaacctgcccaggcctaacgcctgtggatttggcatctccagccaatgtcaccatgagacccacccgagccccactaatgtgcacctctggcccttctgctggagaggactcaygcagcttctccagggcccactttctctccacgggcaggaggctctgtccttcacctgagctcctcccccacatctttttctagggagaactttcccagggagcttgcattcacagcaggagagctgccctgacactccacaagtctctgggctccccagggcctctgaggtctccccaggcccagatatcagacactctgtgttgtaccaagtgtccagataactttagcaagaagacatgaattccgttcatcaaagtcatgttgacctcaggtccgaagaacaacagattgattccagcttgaaagaagctggggaaaggaagaacagtggggttagtcagagctgggccagaagtgcctttcgttgtgctgsattctgggttattggcagccyctctgccagagctacccgtctagggcactratctatgggaggggaagcaggtgctacccacaccctattctagttccactctgggcaggtccaactctggagtgatgtgaagagcaggctgcctggactggccaaactgggtccaggagtgtgaacttctgcctttcccccgacctcaatttctggcaggcaccaaggccaatgagtgaaacgagtaatacaaaatgcctgtgcagctccacagcttattaccttccgtgggggaagcaacaatgttcaggtatgcagcacaggttggcactgcctagaagctgtctatagcttataggatccagttaacccttttgttagtcatgcacctcccctgcatgaaacaatattgttccttgcagcacaaatatgtcccaacctcctcctccccagatcatcagccccgaactgaagcaaaacagactttgggtagtctttcctctgtttactctttacttcatttgatcaattccaawttttttcataatgccattattattgagggaaggggagtaacttcaaggtaatccagagagaagcaaatgcaatacagttctgactgagatgcagattcctttttgttaaatgctgactgtstccttggtttcccattcacctgggaagtagaagaataaaaatcattccatagttccatccaaggagggcagctgcaacagtgtgctcttgagcaggctgtctgggtcatcaggaaaagccattccagttactcacgcattctctgagaaaccttgtcatctctgccatctgtctctgtgtaggaactgccaaagtccttcggttccccatctcaaataagcagtgcatgggttacttccctcattctaatccttcagtccctccttgtgtccgtttggatcttccaggaagcagctttcaagatggagttagaagtacgagtaatgaggggtgattaccgtgaaagataaaggggagaggctgtaggggggaaggcctcagaccaccatgcaggctgactgtgaaggaaaggcaggggggatragggaagactaagatgagcctcaggctacagtacagtaagtcctcacttaatggagttgataggatcttggaaattatgactttaaataaaataatgtagaacaaaaccaattttcccataggctaactgctataagaaagaattaagttcacagcatatttctggtcataaaacacaacatcaaacttctaaataaagaccaaacacttcaatatttaacactgaaataaatgtttacatatacatttaggaatgattactaatactaatgaccaatactaggccaggcacagtggctcatgcctgtaatcctagcactttgg

SEQ ID NO: 13382 - DNA, 12532 bp, Homo sapiens
tcctagtcagctgatgtgagattacatggccctgactgtcttgcctggtgctgcaggccaccttcacagccttgccataccttttcccatttatccatggattggtatgagccctaatggtgcacccttccgacaatccttcatccttcccagacgtttcatcagccargtgaaatttgcaattgtttcwgtgattgaaattatgcttggagtgcaggtgtcaysgatgaaacagcaatgccttgcggtgacaaattcagtgtagaaataattttagcaagcccagtgattggaaaacaatgactcaactttragctatattgattttgtatttctgggctcagcttttgactcagtctcattccccagaaataatccctgttaacatttcggtttgtgttatggaagtgttytctcttctatgaattasctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaartgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctygatccttacacttagcatcatgttttcaagggtyattcatgttgtagcatgtatcagtacttctttttttagggctgagtaatattccatttacggatatgccacatttcatctatgcattcagttcayggacatgtrggttgtttccacattttggctattgtgcataatgcttccaggtacacttgtctacacatttttgtgtggatataggtttwccttttttggggtatgctcctaagagtgcaatttctggatcacgkggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattcygcagaaaaaagtactgattgtccagcagttgtgtcaggtagaaaactgggatgcccgactgcattggtttagccagaactrtggccatgaaaccttgcctggcccccagggatggggtgaggggggatatcatataygctttaggtggggcagaggggtggtctgcccctgtgcaggcaggaatgttcaggaagcaggctgcctctgtttctactctaaatatttaacattcacggatggcatggatcctsactaagcggagcagatgctggctctrtattgcacatagctcctgaatatcagccctgcktggctatgcatgtgttttttgttagtttttgagacagagtctcggtctcttgcccaggctggaatgcagtggcacgatgttggctcactgcaaaccctgcctcccaggttcaagygattctcctctcccagcctcccgagtctctgggattacagacgtgyatcaccaggcccagctaatttttatatttttactcgagacgtagtttcrccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtsgtggagatggtggcgcacaagagggtcagtgccccatctcaaggaacagctgcacctcrgcctaygcgattgtgaaaaygtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcawtgttagtgacttakaaccacacaaaagttacactttacagttttggaggtcagtggtccaaaataggtctcagtgggctaaaatcgatgtgtcagcaggacaccatttytttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctkcttctgcttttaaggaaccttgtaacttcagggagtctaccctgataatctgsgataatctgcctrtttgaaggtcagccaattagcaatcttaatgccatctacaaccttaattaccatttgctatgtaacatatttatagatatcagggattagttcatgaacatmttggggtagagggcattccacatacagcagtacctataatgtatatgcttcttaaagaatgcatgagtctttattttatgtccttggagtgtatagcagagttagatagatcyttctggattggcggttgattgaatattggctgtacaaagaaactggwtaggagtatagagaaaagatcaatcatagcactagcttatagtttattttattctttaatgattttttaaaaatatttctctcacttacttgaaaagcagtcttagaaattaactggaatgggtaatttattygtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaaaagacacagatgaggctattrggattaagggaaaatcaagtaaaycgagaggtaaagcactgtgcagaaatattggccagaagctatgaacagwtgccacagctgggctgaagagttacctgtsagccttccaggggtgtaagycaagagaaagacagttcaccaaatctatygattaatrgaaatcatccagcagcagtgccactgtaagatgttcaatacgtagcacctttctgtccctyctcctctwgccagttgggacaggattagcaagccaaagactttctgaaataatccttagctatattcttggtattcaccaaggaatttaccaatatgcaaagacttggggataattagtattatctttgccattacctgcagtaatattatgaagattagagatgtaactctgtcctgaagaactgcagtctgtggctcaccttggagaagaacttaagaacttattgaagtgagcaggctcacctgcctttgctcagagccacatcacctgcaggcaggatctgcaaggtcagcagttagcgtcaagttgcacagcctgggcttgggtggcgttcgctttacccttgcccttgatgtggtgccgagttgtcaggattctcgtaaaattcctgggtgatggcttcttctgttctctttatttccttaastgaacatctgtctaattgttcacctccatcgctttmgtgctttcctcatgctttctctctttccasacaataaactttattttcttcataagaattcagtctacgcaagggtattaggcagcttgtttgcaccttttaattsctggatgttttccagaaaggctgttwgcagtagttccagtgggttcatctgtgaatcaggaaagacaatgcagctttgtgttttkgtttttatcagttaccttctgtttgtaaacatctgtttggaaacgtttgctggtgcccaccccagcaccccyccacccctgccagaaataaagggattaatctctttttscttggcatagggagaagacagtgtctgctgatgtgcttaacttttttttttttttggtcaggtgygtaggtatgtgactgaaacccatagactttgcacatattgtcaaawgactttccagagggactcaggcactttatttaattaatgccaatgaagcccgttaatccgctcattactgcagtttaattttgatgctggtttttgatgatgtattgaaaacttgtataaactggcaattacaactggaaaacatttctagtttagaagagacccttatttttcrtatgcttagraatatccagcaagccacttttaaaggctttttatcacattttattcttaagctttctgaattccttattatattttgcctgataaatagttggattttgttttttggttcaatgtaagaatattcttaaactaggtaaactgttttaattgtttgtcattatgttctctcattctgttaaattttgttttctatttttcatgtttttgggtttttctagatggcctgtctttaacacttcttgatatttttgattaaattttcatatatcatcaaaaayagagatgacagccaggggtggtggtgcatgcctataatcccaacacttttggaggccaaggtgaggagaccacctgaggtcaggaattyaagactactgggcaacatggtgaagctctstctatcctaaaaatgcaaaaattagccgggagtggtggtgcatgtctgtagtcacagctacttgggaggctgaggcaggcgaactgcttgaacctgggaggtggaggttgcagtgagctgagatggagccactgcactccagcctrggtcacagagggagactctgtctcaaaagaaaagaaaagtagagaggatagtataatgaggttcctgtctgccagtcactctatagtaactattaggaaacccctttttttctctgaagtcattgctcctgtgtgtgtgtgkctgtatataaaaaaaagtatgtatacatayacgtatatgtatgtgtatagataaaaatgcrtgtatggtgctgggcgcagtggctcacgcytgtaatcccagcactttgggaggctgaggcgggcgaatcacgaggtcaggagatcgagaccatcctggctaacacggygaaaccgtgtctctactaaaagtacaaaaaattagcctggcgtggtggcgggcacctgtagtcccagctactcgggaggctgagaccsaagaattacttgatgaaacatggcagacracrtagaccagcagcaaactaccaacactgtggaggaycycctggatcttaggctcagcccagaggagcgaatttgtgtgaaaatgagaaacgaccgagagcttcgaggcagattacatacttatgatcaacatttaaatatgatcttgggagacgtggaagaaactgtgactactatagaaattgatgaggaaacatatgaagagacatatgaatcaacaaaacagaatattccagtgttctttctccggggagatggcattttcctggttscccctccactgagagttggctgaaacaaagaatttgtcmtgtayggaaaacaggagactttgtacagtggcctctctaaakgtgcaagatattcaaaagagaaacccgcatacatttggatattaagaaataattctggggattcttccactcctgaaatgagttgatttgcagataattcacaacttcttaagctaaatggtattttcgtttttctcaagctcttccaataaatatgaccaccaagatttttttttcctaaaaaaaaaaaaaaaaaaaaaagaagaatcgmttgaacccgggaggtggagcagtgagccaaggtcatgccactgcactccagcttgggcracagagcgagactctgtctcaaaataaataaataaaaatgcatatatgtatatttgtgtgaatcatatacacatatataaaatatatgtatcatatacatatatatcacatttctttttctagtgtgtgtgtaccttgatttatgtctcacatattcaaaataactcaacttgtttaaaataagagcacaacctatttaagtagtaaagattcaaagccttcttctaaaatgcttaactttcctgtggatttgtggacccgtgggaaaatctcagtccccaggcaggaaggaaggagatatgacacatctctagtttgttgtaagtcgcctaccctagacctcatctccagtgctctgaatgtggagaggtaggtgcagggcagtgggayagagaggtgcactttgaaagactatcacatggaaacaaaagttccggctgggcacggtggctcacgcctgtaatccaagcactttgggaggccaaggcgagtggatcacgaggtcagcagttgaagaccagcctggccagcatggtgaaaccccgtctctactaaaaatagaaaaaattagccgggcatagtrgcatgagcctgtaatcccagcgactcgggaggctgargcaggagaatttctkgaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctttgcctcartactactggcatttgctgacatccatttatcaagatacagggatggatttctagaaggcccaggcaggggtgctggccaggagacaccaggcatagaccttcctttctcagagccttcgtggcccctagtttgaatctttgagtcactgcagtaaagttcctgatgtttgasagtactccttatgaagggagtcatatgagttgctagctgggttctctggatggtggtgtcatgccaacatgggagccactagcacaaagaacatgctaggttctgttgagacctgactttgggaatagcataggtacttayctttctcagcaccacacaaacacactccagaatgcaaaggaacctgcactgtgccatcttgcttctccctgcatagccacttctctttccagtggtgtttgtattttggttcattcaatcaatgaatgattgattgaatcaaccacttggtcccttcaatytgtaaccttcctgcaacactgtctttgtgatgttatcataaccttgatttttgagggatagaattgggcataatcasagaaaacgtggtctgggacacatttgtgggctattctatgcyaaacatttccatatcattaatgttcaacacagctttgtggtgttggagataggattatcattgttaggatggttattatcaatactagctgtgattattgatcacttccacatgccaggcacagtgctgggtgctacatatttattacctaatttatagcttgctgcactcttgctgggtatgtgtaattattcccatttcacccgatccctgggagtttggtgaattaatcacccagcatccaaatagctaaccrgtagcagagctgggattcaaactcagttaggctgacttctgtgcctgtttycttgcctaagcggtggacgcattgagtaggagaaggccagttattcctctttgtcactgatacaactggggacctgttgcyggagatgtggagctgtgcattagggctgggtagaacacacataatgaaccatatgcacgagaactttttcatctttctgcatacacttggaactagttctttgttwttgtaaaagcatcatgcacyaggtaaaatgtttaataacacagagaaatctaattgtcaagtatcttctcaacacacattaatcaacaattctcmtatcgaargataacctcttgtatttacaaaaaaaagaagaaaaagtgctgtcatcagtaaattcattcatgtatgttatacactyacatacaaaaygtatctatttgattaaattagaactctgctaatgaattactttccttgattgcacagtaataaagtcaatgttgtaaatataataattatagccaagtgcagtggcttacacctgtaatcccggcactttgggaggctgaggtgggcagatcacttgaggtcaggagtttgagaccagcctggccaacatggtgaaaccctgtctctactaaaaatacaaaaattakctgggtgtggtggcacatgcctgtaatcccagctactcaggaagctgaggactgagaatcgcttgaacctgggaagtggagtwtgcagtgagccgagatagttctactgcactccagcctgagcaacagagcaagactccgtgtcaaaaaataaataatatrtgtgtgtgtgtgtgtatgtacatgaattatatacaaatgagggaaaatatacaaatgagttgaatatatacaaatgagggaaaaattgttccttgtgtcaggaacaattactgtgaattttgtgtagctyttyctgactttttaaaattcaaatatatttcataaagttgaaatcacactgtggtctttttttttttttttttttttttaaccaracatatagtggccatgtttctatgtcaatacatactgtttggcagtacagttgtactgacttgacattatagcttcataacttagtaaattaatcccttattgctgggcacagattctgttttccattttttcagtcatgagcaacgttgctggtttacctggggctaaataagaagtttaaatgyaaatagataatkcttgagaaagcttcttccytrtatatactctttctgyagcagtgtctgagtgtctgtaccttcctataccttcaccatatcatgtatttgtcattttatagtgagttgtattacttgctaggtgagctggtatctcctytgataacacaaagaaggcctgggtttgcttggcaatttgttccaatattsttttcagttttaaataagttttgaacaaaaagttttagcattttacataaaaacctctaaagctctcaggctaattagtaatgtagcatatacaaattaagtttttttctgctgtgcttaattcttattaacacactmatcatgagagcccccaaattgctgtaaggagcacatttagaaaacatataaaggatcgatagttggtacttaagaaatcgttgaaacaccttttcttttttaatctatcttagagctgaaagataaaaagacttaaaatgagttagaatatgagtttttcagcatcttatagcttatgagttaaagcaagatttaaaaaatacatttaacatactaaatatttcaaaagctacagagataccgtaacatttaaaaaaataaattttcattgtggaaatcaactgccacaaaaacacaaccttttacgagacaacgtgatgtrcatgagaagccctgatgttgagaagctcataattcggtgtgagaaacacacaaggcatgatgccattcccatctgggatgaacagggaagacttcctgggagaggtgactatggacttaattttgytttgacacagcaaaaacatgaggaatgaattttgtgacttggaagattgttagttttctgtggagggaacaacactcatcttgcaaatttgccttcactattcaatcattagaaaataattttaaatgagcttagcagttctcagaattttggatttcaggaaacaaactttttaaaaacaaaacaaaaaggaggatacsaatttaagcttgtcaaaaagattttcccccaaaagaaaaacacattaaaaacaacgacaaaaatcaacaaaaactaacactrttcccccatcaacaatcaatattactttctaaaagcaagggcgttttgacaccagatattgtgaggacatccacctgctctaagggacagccatttcactggtgttctgtcaatttttattttgaactaattttagactcacatagaagttggagaagtaggctgggcaccagtggctcatgcctgtaatcccagcactttgggaggccgaagcgggctgatcccttgaggccaggagttcaagaccagcctggtcaaatagtgaaatcctgtctctactaaaaatacaaaaattagcctggcatggcagcgcacacctgtaatcccagatacttgggaggctgagacatgagaatcacttgaagctgggagctggaggctgcagtgagccaagcggagtgccactgcactccagtctgggcgacagagtgagactctgtctcaaaaaaaaaaaaaaaaaaaaaaaagttgcagaaatagcaatatttaactatacttgttactcaaatttcaccactaaagcagtgtcatctttttattccaggatctagtccaggatgccacattatatttaattgttgtatctccttggtgcctttagtacttttttttttgagacacggtctcactctgtcacccaggctggagcacagtggtacaatcatgggttactgcaacctccacctcctaggctcaagcgatcctcccacctcagtctcctgagtacctgggactatacgcatgcaccaccatgcctggctaatttttgcatttgttttatcaaggcagggtttcatcatgttgcacaggctggttttgagctcctgggctcaagaaatctgcttacctcggcttcccaaagtgctgggattacagacatgagccactgcacctggcttggagcattcagtctttgatagttgcttacttatttccttctttctgatcttgagaccttgatttgtccagtattttctcatcattagctgagtgtaagcattttttggcaagaacattataaaaatgatgtggtrtctttcttagtatattatctcaggtagaacataatgttgatctgtctcatccctggtaatgttaaccttgatcacttggttaaggtgatgtctgctgagtttttccaatgtaatgttattaatttttcctttgaaattcataattatttgaagggagatgttttgagatgatgctggcagcccygttttccttaaactttcacatgctgactttctattgttggatcttgcctgcagcagtgtttaccatgatgcttggctagtggtgactatgtatttcccttactctttttatagtcagtaattggaattcttctgaagaaagagctatcccttctcccccatttctttcttttcttttctttttgttgagacaaagtttcactcytgtcgcccaggctggagtgtaatggtgcgatatcggctccctgcaacctctgcctccygtgttcaggcgattctcccgtctcagcctcccaaggagctgggattacaggtccatgccaccatgcccagctaatttttatatttttagtagagatggggtttcaccactttgaccaggctggtctcaaactcctcttctctggtgatcctcccacctcggactcccaaaagtgctgggattacaggtgtgagctacagcgcctggcccctcccccgtttatttctgattcaattactttatattagcgtagattcacaggtatttcctttttttttttttttttgatttattaatacctccatttattctgttgctgaaaccattccagctttttctggttggcttctatgaaggacgctattttaatggggtgatttttttcttctcactacattcttgctcactccccactttttatgtccggtggccataggct

SEQ ID NO: 13383 - DNA, 88873 bp, Homo sapiens
  misc_feature (1)...(88873): n = A,T,C or G, or insertion/deletion polymorphism (see Tables 1-2)
acacccaacatgggagcacctaactctgtaaagcaaatattaacataactgaagggaaaatagattacaataatagtagaggacttcagcactttaaacagtggacagattatccagctggaaaatcaataagaaaacaggagacttgagcaacactacagaccaaatggccctaacagatagattcagaacattccatccaatggcagcagaacacacattcttgtcgagtgcacatggaacattctccaggaaagatcatatgttagctcacaaaacaagtcttaacacatttaagaagattgaaatcatatcaagtatcgtttccaaccacaatggtataaaactagaaatcaataacaggaggaaaartggaaattttayacatgtgtggaaattttttttttttttttttttattgatcattcttgggtgtttctcgcacagggggatttggcagggtcataggacaatagtggagggaaggtcagcagataaacaagtgaacaaaggtctctggttttcctaggcagaggaccctgcggccttccgcagtgtttgtgtccctgrktacttgagattagggagtggtgatgactcttaaggagcatgctgccttcaagcatctgtttaacaaagcacatcttgcaccrcccttaatccattcaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaaccttttccccacctttcccccgcttctattccacaaaaccgccattgtcatcatggcccgttctcaatgagctgctgggcacacctcccagacggggtggtggccgggcagaggggctcctcacttcccwgtaggggcggccgggcagaggcgcccctcacctcccggacrgggcggctggycgggcggggggctgaycccccacctccctcccggacrgggcggctggccgggcrgggggctgaaccccccacctccctccckgaaggggcggctgccgggcggagacgctcctcacttcccagacggggtggctgccgggtggagggtctcctcacttctcagacggggcggccgggcagagacgctcctcacctcccagacggggttgcagccgggcagaggcgctcctcacatcccagacggggcggcggggcagaggtgctccccacatctcagacgatgggcggccgggcagagacgctcctcacttcctagatgggatggcggccggacatgtgtggaaatttaacaacacagtcctgaacaaccaatgagtggaataagaaatcaaaagggaaataaaataatatcttgaggcaaatgaaaatggaaatgcaacataccaaacctcataggatgcagcaaaagtgattctaggtgggaggtttatagcaataaatgcctacgttaagaatgatctcaaataaacaacctaacttcacacctcaaggaactataaaatgaggaacaaattaaggccaaagttagcagaaggaaagaaagaaagatcagagcagaaataaatgaaatacagacttaagaaacaatagacaggatcaacaaaactaagagttgagtttttttgaaaaggttaacaaaacccacaaaccttaggctagactaaaataaaaaaagactcagataartaagaaaattataaatgaaagaggaaagattacaattgataccaaagaaataatagacaactatgccaacaaattggataacctagaaatgaataaattgctagaagcagacagccgaccaagactgaatcccaaaaaaaactagaaaatcggccagggcgtggtggctcacgtctgtaatcctagcactttgggaggccaaggcgggtggatcacctgaggtcaggagaccagcctggccagcatggtgaaaccccgtctctactaaaaatacaaaaattagccgggcatggtagtgcaggctgtaatcccagctactcaggaggctgaggaaggagaatcaattgaactcgggaggtggaggttgcagtgagctgagatcgtgccactgcactccagcctgcgtgacgggagcaagactccacttcaaaaaarcaaacacacaagaacaaaacaaacaaacaaaaaactagaaaatctgaacagaccaataatgagtaaggagattgaatcagtgatcaaacacctcctaacaaaaaatagcccaggatatctgatgccttcgctggtgaattctgccaaacatttaagaaagaattaatgctgattcttctcmaactcttccaaaaaattcaagaggaaggaacacttccaaactcattttatgaggccagaattaccctgataccaaagccagacaaggacattacaagaaaagaaaattatgggccaatatccttgatgaacagagatgcaaaaatcctcaccaaaatattagcaaaccaaattcaacagcacgttacaaagatcatgcatcctgatcaagtggattttatccttggcggaggtgacttctttgaggtgacagcccctctgctggtgtggtctggaagagaagataggagccaggctgagcctaggctgtcagtcccaaccagtgtaagatcaccccctatctgcctgctagtccccttctgagactgggtccagctccgccaggttgtaatactcacgtgtggccaccaggggcggtgtttcctgccaaggctactcttccagggcagacagcctggaggtgaccagtgactttcatccgtggtgggctgctgccctcacctgagtatctggaagggcattcagattctggggcccaaagagagcactgcacagtcctcccaccctccgttctgtgcaagacgcacagttccctggctgcccagccagcaccagcatctcctttgaaggttactcttgctcctgcagctggatggagagtcctggtcagtgctgggagtcctggtcagtgctggaagggcaaagctcccagatgccagcgggaaatgcaaaagggcaaaatgcagggtaagaactgtggccagctggagtaggagtgacccacctaagtgtgtccagtgggttttgggccccatgtggccagcttttcaagattgaagcttggaaatctggatttttacagggagtttccagggcaacacatacaaagacacaaagcacagcatgggtcatgccagggatcccctgcccttgggcaggcacatgagagccctggaaggtttggctgactagctgaggggtctaggcggtgcttgtgggtctcagaccctggtgagcccaggcttccagcttctgccctccctcttgcttctccatccttctctccaaatccccagtgcagactggggccctacgccagggctgaggtcagctccccactgtgggcaggaagtccttctgaagccccatgtcctgtgtccccatcagacggtggcagtgcctgcggccatggacacagtgccccgagaygatttcttttcttttttcttctttttgagacagagtctagctctagtctcaggctagagtgcagtggcgcaatttcggctcactgcaacctccgcctcccgggttcgcaccattctcctgcctcagcctcccaagtagctgggactacaggcgcgcaccaccacgcctggctaatatttttttaaaattttagtagagacggggtttcaccgtgttagccaggatggtcttaatctcctgacctcatgatctacctgcctcggcctcccatagtgctgggattataggcgtgagccaccgtgcccggccccgagatgattttgaagcactcctggcacctgcctggcataggctcagccgccgggatccaccatgtttccatggattccaccgcggattccatccaccatgtttctttcactcacaaacagtgttaggccatggagtggagagggtgctccggggaatgaggatctgcattccggccctcaggagcccgagcccacaacggccccaggccacaactgccaggtgggggtcacttcagcagctcattcctgggaatgcctgtgcccagatggcttcaggcctggagcaatttccacctgcctctgtgcatcggtgtcaggcagatgggggcagccacctgcttctcaggaaggaccacccttaccctgggagggcatctcttctactttgacagaggatagaaaacattctgtcttcatgaaatcacrgggatattcagtggtagttttctttttcaggttcttattgaaaaaataaaatcttggcagtgtaaattcagcccttgaaaattgttctggaaatttccctggcccatgaatcacctgggtctggcacctgttggctgtgttctccctcagttttcccatctccacgatgggtagcagttgttgctgtctcatttgagatgacacgtgtgaagcctttagcacgctgcctgactcccaggaggccctcagaggtgactggggcactgccttcctcctggtcagtggtgatgttggctcttatagtttgggttgggatgctgttgctcatgtcctctttcacagggctgcacgcagagctcggtggaggagcctcctcccccaacgcctccgcttcttcctccctggacttctgccccgtcagagggcagcctgcaggcacctctctctgtcctggaagcctggccagcaagtcrgggccaagggctggtgggggmctgcagagagggccagcctgagccagaggaagagtcttggggttggctcaggtatgtccaggccatgagggcagaggaacaagtctaccacagtccccactggagcggtggcggggaggctggggagggcagtgaacctggaggcagcccctcactcctgaatgtagagtcaactgtgactttgatttgcaccacagttttcttcagagtgcactaaacatagagtcatactcattttacgagaccagcattaccctgataccaaagccagataacattacaagaaagaaaattatagaccgatatccttgatgaacatagatgcaacaatcctctcaaaatattagcaaaccagctgggcgcggtggctcacacctgtaatcctaacgctttgggaggacgaggtggggggatcacttaaggtcaggagttcgaaaccagcttggccattcatggtcaaaccccgtctctactaaaaatacaaaaaattagctgggcacggtggtgcgtgcctgtaatcccagctacttgggaggctgagggaggagaatcgcttgaaccgggaaggcggaggttgcagtgagccgagatcgtgccaccgcactccagcatgggcgacagagcaagactccgtctaaaaaaaaaaaaaattagcaaaccaaattcaacagcacattaaaaagatcatgcaccgtgatcaagtagattttatccctggtggggtgacttctttgaggtggcagcccctctgttggtgtgatctagagcaggactgaaggaaatttactcagggaaatttacaaggcttctgtgaaactgacatggcagggcttccagcctcctgttccaagatgggaaaactaagtctcagcaaagggagaggtgataagaccagcccgagatcgtacaggaccctgtcttggcctccttgtccggagcctggcctctccagagctgtgactactagtccctggggggagacagcctttccacctctcccagaccggagctgggtgctaacaggccctgccggatgaaaatcctacgatactaacagacagctaacaggccgggaccggcccccagccaccaccccttgtccaaagtgcaggttcattgtgctgccctcttggcttgtaacagttttgcaacagttgcaacttgtctttgagtgcagggacaggagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccaggtaagcctcaaactggcggggccagctttccactgggcagccaggggcctaagccagtgggccctttgcctttgaggcagggactgagaatggtgtcagcacgtggtcaggcccagagcccaggccccctcctctaagaggtcctcctggattccctgctggaaggaagccagccttgtggtgtcgtgtctctccctggatctgtctgcttcgtggaccctgagcccctcgagggcaggggctgggtcttagatgtcactataggtttcccagcagtgctttgtacacattgggcattcagtaaatgtagaggatagacaagctggcaacaagacagtcggacatcctcggtgtgaataagaacacaatgatttgattggtattaattacagcagtttactatacgatcgcttccggtattggcagctggcatcattacaatattaacagactgccattgaaatgccccgtctttgatccagcgcgaggaggagatgtgactttccatcagcacctgttctgattctttgggcatccagaggtgtattctttctgggtttcctccacacccctcctctgggtgtctacttctgtctgggaaggggtaacttgccccagcccagagtcaggctgcagcatccggtctgcctcctccaccagcttgctgtgtggccccctccctgggcactgctgtccccaacagtcaatggaggctggaatccctgccctgggggctacgtgctgtgcagtagccagtggcttgggggcatctccccaaacaccagaggggtctgggagctcgggaaagcaggacgcagacagaccaggagaccctgtccctgggaagctgacccaggccttctcactcgcctctgaaggcagtgagcatcctgtccctgggggtgagcaaactggggcatgtgctgagatgacctcaccaaaggagcctccctgcagtggacgggcccctggcccaagctgctgctgaccccacctttcctgcccaccctgcctgtgcatagctccttctgggcgcggggagctcgggcggctccagcaggcaggtggtgcctgggtctactgcagcaaccctgaggcgcctgtttcagagacgaggaaatgagggttggagcggaagggtgactgccaggtcgcctacgggtaatggggcatggggttcacaaccctgctctgccgccctcagagggagctgcccacagggctggcctagaagccccaactaagctggcctagaagccgcagtggtgggcggtacgctccgcccagatcctgggcggagacatggggctggcagcgagggtsgggggcgggggaggcctggagttccggccaggccactgcttgggaagcaagaaggtgaaggcacctctgctgggccaagcactcttagggccgaggggcactgcagctgacaagaggtacttggaggtacacccccagggagggacgaggctggggcctcccctatgtgggcggggctgggcctggtcagatctggctgggatctccctctgcctctggctgcagggaccatccagctgcatgagcaggaccagggttcaccatatgggcagctgcctccccgcccccwgccgctcctccccacaagtctgcctaccctcaccaggcgaaggtgccaggcgctctcctcgcttgacccccaccaccccctgagcctgggaggaggagggcgttcctgggtcctctgctttgcagtgaggttaagttgttgctcraggccccagtcctgtgacaaaacccccacccatctgtctgatcccaagcccagggctgtcctcagccctcactcctgggaagctgactcaggtacgagacagagttggagggggcaagagagtgggttaatgtggaggcagctgtttccagggaggtggcaggcaggaggggctctgggctgtccccgctggggccgctgccagcccccagtctgacagtcagaagagccctgactgaccaggcaggtggtgaaggggcacgtggcagcctccggcgccagcagctgtcgctttttgggcacagtcggaaggaggagggaggcttttgcccacagctgaccaggtgtgctgtgccatgcggcaccgtggtgggtggtgggtggtggggtgggggtgttcagccttggagggccttcctcggtgccactcaagctggctttcccctggtggggcaccacttttgggggctcctggaagactgtggaccttcaaggactgaaggtatgtacagacacatgcaggaggcatgcctccttgtccggggccacctctgcaggcaggagccaggcgggctgacacactgagggctgagaggctgaggacaagctccaacacctcctcactcccctacgccgctgcaatcagactccctgctccctcccttgggatggggcactggggcaggagatggggggcagccctgaccagcctgagagctgggatccccctcacatcccccactgtgcctaggacagggttctgggcttcgtcagggcttkggcagtgcccacagttcaggtgggacagagtgtggcagtgggtcctgagtccccctgggatggtcagaagagggggcaggagagagtccctggcactgccacatggaggccctatgaccctggtcacctcagggagcctctccgtgtgtcagactcccccgctgtgaagtagagacattatcatgtgtctataggtgttcaatgagagtgaacgaacgtgcatagctatggtccactcttgaaaaaggatgctgactttcttagataattatatcagtcattcatactgacgtaggtggcacagcacttcacatcttggatcacagccacatccctttcacttttcctgcagatcccagaaaagggcagtggaggtccacactgggcaggacaccaccccacccttccattgagggctgttgtgagacctccgttcttaacttcttagtttaaagaatttaggctgggcacagtggctcatgcctgtaatcccagcactttgggaggccgaggcaggcggatcacctgaggtcaggagttcgagaccagcctggccaacatggtgaaaccctgtctctactaaagatacaaaaattagccaggcatggtggcatgcacctataatcccagctactcgagaggctgaggtgggagaatcgcttgaacccaggaggcagaggttgcagtgagccaagatcatgccactgcactccagcctggaagacagagtgggactctttctcaaaacaaacaaacaaacaaacaacaacaacaacaacaaaacagaatttaaacatgagacacacagcaaaagagctgcaacatagagcaatttattgcaaaagaaaaagaacattttgaaagttaggtgcggatgcaccctgggagagagaggattccaggcggggggctgctcctgagtgtgaggcagcattgatgattgttggagaaaccccctttcagggagtcttccacaattattcataagtgggtggaaagagaggaagaggttactaggcagcatgtgatggctggtcctctgggtgcacatgcggtagctgtacatgtttgttcatacgtcacatgtctcwttcgcatctttttttttttttttttgagacggagtttcactcttgttgcccaggctggagtgcaatggcacaatctcggcttactgcagcctccacctcccgggtttaagcaagtctcctgtctcagcctccagagtagytgggattacaggcatgcaccaccacccccggctaatgttgtatttttagtagagatggggtttctccatgttggtcaggctggtctcaaactcctgacctcaggtgatccgcctgcctcggcctccccaagtgctgggattacaggcatgagccacagagcccggcctcattagcatcttaaaatctccaccgaggggtgtgtttttttactattagaatgagcaaagggtcagtttgaggacaggtaaaatcaatgtgcacatgccctctccagggraaaggccctactgcagacagctttgcttgaamgagctcagttaacacgagctcagttacagtgcaaacgtggaggctgattgtgtggattgcagtcaccacggttgctgcgtccccaggacatggtgactcctttgactgcctgtcctgcctcgcctgcacccaaggagacatccgtcttcatcrgcgccttctctcctgagaaggagggctccctcttgcattctcattgttattggatttttctggctgggcagatctgggagggtttcctgaaggaggagggagtcggggtgggtcagctgggaaggagcagaggggaggaaggcctgttaacccggcttctgagcccctactctgcaatcccaggtggccccaagggagcagagccgggacaccacatccttcatcagcttccgccttagtcccaccgagctttggggctgatgagggggcaacccctcttgtctgggtttgggaggggcctrcccaggaggaggtgctrgctccaggcttgggggttgggtgccccgtctcgaggctgcctgccrataccctgcggccactgctgtrgcatccacgatgcctctccctcctcctggctctctgtctgggagcgcaagtgtctccatcmctcaacacaaccccctccctgccctgctgtgccactaccaccgccttctctgggcactcctgcctcccaggtcccatccccaccscgcaggacctggggtctgccccagcacagacctgtggggcagcagggctgcttggcccctcaggagcatcttgagctccgaaagggctctcaaggctggcgggacggcccccgcccagccccagcctctcgctgtctgtgatctgggggtgagtgtccctgagaccggagcccctcctttccagctrttggtcctctgtcctcagtcccctccccatcctccctgcccggcctcacggggcagcccactttcctcaggtctcactttggatctctgccagccacgycacccmctcttctctacctccccttgtggccccgacccccacttctacccagagcttggcgctccctgtcttttctgtgggctggcagagacctatcctcaccaaggttgcyccygggcactgacagagcctgctgcataccaggcccttaatacatacacacagaatgaatgaatgaatgartgagtgaatgaatgartgaatgagtgaatgaatgartgartgartgaatgartgartgaatgaatgartgaatgaatgaatgagtgaatgaatgaatgagtgaatgaatgaatgaatgagtgaatgaatgaatgccatggggaagtggcaagaggaaggccctgggaggtaacaccatagggcccttatttccctgggtactcagcacagcccccagcgtgtcccctctgcaccccacccagctctgattctctccccagctccctgtttygctgaggcctggagcccccatggcctcactgagccgagccctacgtgtggctgctgcccaccctcgccagagccctacccggkgcatggggccatgcaacctgtccagcgcagctggccccacagccgagaagagtgtgccatatcagcggaccctgaaggagggacarggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggtagggaccgggggccaggtaggggcagggaaggatagsacatagcgaggggccacagcccattgctagctgggacagttcttggttcacaacaaccagcctggggaagagaccctggggaagggtgcatggccagtttgcaggtgggcggagctgggggcactgcttgccctcccagtcgctgaagagctgtggtgggaggagggagcagatgctgcttgtgtggcctggagagtgaagctggggccagagctggaaactccaggcagctgtccagagggcagaagcccctttcctggacagagccaccaggactgagggcattccagggagtggagaaggacggacggggaccattgagggtgaagcagacctgtgtcctccatgagcaccagaggcttctacagttctcattctcctaactaaccagggggcatatattaagcacctatggtgtgcatgtcccaggacagccaaccttctgccttcaccatttcagccatggrtgtcctggcaaactggatctcctgacctgcagtgttggccagttcctgtggtgtgaacactcccaccctggccaatagcaaaagccaccagtgtgaggtcactgactgtggagttgggaagaggtttatccctgggctcctgagagctgatgcgagccggctcccacaagccacygctccaactcttgctcttgccttctcactggccccctagctgggctgtcatagmctcttccctgacgtttcgccagccacacccctggcctgccacctctcacattcagctgctggagggcatcctttgttggggagagtgcagatttaagcttcmttcagtagtgggttggtgyctcggcgccccctccactcacctgctctgtgatcttggccacagaactgttggtgccacttgaacttgatctataagagaatcacgccctcctcatagggcatgacaggcttagcacggggcttggcacrcagtaggtgctccaaaaatgggggcctttgctatgtcactctctgagctgcccaagggcgggacctccctcacattcatcttggtccagttatttyctgctcaacaacctctccaggccccccaggtcctgcagagaaagaccttgcagagaaagacacccatggttgaatatcagggtatcccctgatattcgtctgggggaaggaggtgcagtccactccctggggagtgatggcacccaccctcccgggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcggtgtgtgctcccctgcggggggcaaggaggggggcttgggtgggtgggtgcactccctggggggtcatattggtgggtgcaccccctgtgggggggtagggtgggctccctgtgagggtggaggtacgctgggggttcatgtccgtgtgcgcatcccctgcggggggctggggtggggggctcgtgtggatgagtctgcttcctgtggggtcgggagtggggctcatgtcggtgggcacccttctgccgcgagagaaggggacacgccacagggaaggagccccggcaggtgacagatctgggttccagcccttgcgctgccccttgctggctgtgccacctggagaaagcgactttgccaggcttcattcagaattcccagacagagaatctgattggcccagcttctccctgtcccagtggtccacgcctgaggacactgattggctgttcttgggccaatcaaatgtgggggcgtggtctatctgacagtctgaaacaggatcttggcctctcttgacagctggtctgactgggaaacctctcaggcccaaagtattagacctgtggggttatttatcttatataatagacactttgtgccaggcactggtctaagttctttgtcaatgacatacactattctcacccccacttcacctgagtgagcctgaagcgactttgccccaggttggtcacacagctggcgagggtcggattggcacaggcggcctggccccggagcctgcctcagtgccctgctccttaactcttatgctgaagcggattcaaggracaggctccgggggcgtggggaccggctaaggcttctgggagaaagtgaggctggggtttgcggtggatgcccagttggggaggggagtggcccaggggtctgctccccacggactcagttaacctcccctgggtccccctagctgggcaaggcgtatggtgtggaatcccatgtgctgagcccggcagagaccaagactctgtacccgctgatgaatgtggacgacytctacgggaccctgtatgtgccgcacgacggtaccatggaccccgctggcacctgtaccaccctcgccagggcagcttctgcccgaggagcacaggtactgatggccgcctggctctgggtcccytgttcccagcccactcctcytgccttagaaccctgagagcagaagggaagagaacaagagccattctctgactgctgtgtgactttgggccagtgaggacctctctgagccttctggtccactcctgccaaggggaggctatgccttcgttctgttcacagacatcaggtcgtgccgtgggtgcacccattcctctgctgcacaagcaaatcgtatcaaaagcccttcttataatttgtatctgtgtttgtctcaactccgcacatcattgtagaacaatttttttgtttgtttgtttgagacagtatctcgctctgtcgcccaggctgtagtgcagtggcatgatcwctgctcactgcaagctctgcctcccgggttcatgccattctcctgcctcagcctcctgagtagctgggactacaggcacccgccaccactcccgtctaattttttgtatttttagtagagacagggtttcactgtgttagccaggatggtcttgatctcctgacctcgtgatccaccggcctcggcctcccaaagtcctgggattacaggcgtaaaccaccacccccggcctgtagaacaattttaagaagacaaataagcaaaaaagaagtcaagatcacccagcagtaatagtattgacattttagtatgttttactccaaatatttttctatgaaaatatatatstatgcaaaatagaaccaagctgttgttattttgtgattttttttttttaccaagcagtagactgcaaacatctttctgttaatcaaatatcttgctttttttwwwwaaaaaaaaagtcagctactttttcacgttatgaaaagagggttccccccacaagtcaagtgaaagaacttgcccaactttcaagttctccaagtcaaggcatgggtgggtctagttttctggcgctgtggtcatcyggtttccctgacagtgtygcaggggacctgctgctggcagaaatagtgtccccagctcccctctgggaggaggggttggttggagtggggtgggaagcacccccggggagtcccgtgggattttagaagcagttcctctcaattccaggtcattgagaactgcccagtgaccggcattcgtgtgtggacggatgattttggggtrcggcgggtcgcgggtgtggagactcagcatggttccatccagacaccctgcgtggtcaactgtgcaggtgcgagtggcatttctcctgactcctgtgtggccatgctggctgctccctaaacctgctcccacctctgcagggcttctttctggggtggggagcccctgctagggcagacaggtctgcagaggcagcctgtgcacacctgagaggcagctcccaccaggtgtcagcagagctgagctgtctgtgctctgcccgcaggagtgtgggcaagtgctgtgggccggatggctggagtcaaggtcccgctggtggccatgcaccatgcctatgtcgtcaccgagcgcatcgaggggattcaggtaggtggacagccccrggttcygtgtcagtctgtggggggcacagagacctggctctraatcccagcttgaacccaggtggtgtgacccttgtgggtcccctcactgccccaagcctcagtcacctcatctgtgaaatggggattgtaacatggggtatttccgggtggtatgaggattaaactaggtagcacaggcgtatccctgttggggctgacccccttgttcctcaggacctggcctctctttgatgcccagaacacagtccagcctgtcctgcgtggtgcaggcagcctagctttttgccatgttctgtgcccaggagtttcggggaagacccgaatgtttgcatgctctcagtgtgcctggggtgcctgtctcagagggtgctggttcctggcatgaataacctccctgagagccttctgccaagggaggttgggggcctgggttcacctcctggcacctggggctgggtgcctcctgccctctcttctctcctgtcctcaactcctccctccagggatggtggctgggagcttcctgccactttgttactgacccccctctttccatccrttcatcatgcaaccctcccttactcattcctctctctgtccagccctccatctctccatccgtctctccatccatctactcccgtatctatccatgccttctcccatttattccttcatccctccacccatcccccttcccttcatccattcctccctccactctttccctccctctattcatcttgccatctcgccatccattcttccgtcctccatctctccatctatctattcatctatttatccacatgttcatctgtccatcccttctttcatatatccttccatccacccacccacctaaacttctacccatcaatccctccctccctccctctagccactcatctctccctctgcccttccttcagcatccacccacatattaatccaaccattcacattccattgaaccctctctgcatcagacattgatgggtgagcttggtgtttcaggccctattctagaagctgtggccataacacagacagacacctagttcttgctgggtagagctggggggaggtacagacaagtacatgtgcaattccagaacatgctgataagggctctgatggggtctcaggggctataggaattcccagccctagtggaccaggggaggctccctggaggaggcagctgcatctaggtgaggctcttgagggtggcatggtggacaaggagcgtgcacagagcatggccgttcagagagccagggccagaggctgtggggcagggtcagtgtgagaacagactgcccttgtttagggtcagggccagtgagagggaagcctgggcccctgagctgggagcctcgtccctgggggctgcccattgccaccctgtgccagcctggcttccctatggtcaccggggaggtaccaggcttggytgcttcgtagaccagggtagtgaagcgggtggcgaaatggggccggaacctgggtcccagtgcgctgctgcctctgactcctgtgcgctgggcaagccacgccccactggacacaagacctcttgttcatagaatgagcctctcactgcaggtggctggtgccatgtgccgggttagggactaagagtagtcacacggtgggtgtcggagctgagtgctgaggcctcctccctggctccgggtccctggggagagcctcctcccctaggtggccgccaggggtcacgctcaggtctcagtgggttctgggagggcgggcagagctgtgtcctggggcgtcagggagggtggccacagaatgtccaccgagcccaggactgtggctccatcctccatccctaattcctcccaaggcctgcctttgaggtgcctttccagggaagaagcaaggcagagttggcctaggtccctgcagctgccccytcctgtgtatgtcaagattcaagcgaagctagggggtgttacttacaaagccagtccagatcccagcgtgcctctggtaccggaggcacaggaaaagggccatcagccccagcagctctgagacctggtaggagaaaagtggagatctggggcttcgcacaaagcccctcatgttcctctgacacctggccatgtgcaggtgtctggaagttgtcccttccagaggctgcagctaggcagttggtgtgaatctgaggaaggagccaggccgctggccctgacctgcccacctgctgtggtctgacccttggatgggccacagaacaagccagggggccctctcctgggcgcatggcacctgtgcagcccatttctgtctgctcaggaagctccctgggcgtggcagcctcgtgcagcaggacgctgtcyaccctgatcagacacagccacacacattggggcctgggggctccagctggcaggtgagggctcaggtctcacgtgtggttcatctttcttcttgggtggctggagggctgtgtggccccaaggacctcccttttctgaggatctgtcccaggcctgkgtcctagagagctctgcccacagcttcctttgtggctagggctcatctcttccctctctgagctatcattaaagcaggtggctcgggcgctgttagggggtttcacagtcgtgctctggcgtacttttgcagtggcaaggagcggctgctccatccgtgggcagagctgtgggtaagagcctgggtgctgggtttaaacactgactcctccattacccaggctggccaagtctgtcaccgctctggttccctttcctgcaaaatgggtcataaccatccctactgcctcaggctgtgctgcaggaaggacagagtgatgcagctgggmgtggtgcccggcatacagcaggtgctcatgaggtggtagctgtgtgatgacaaggacaaggacagagggttgtgaagtcgtcaccagctggcgcttcggaggaagagaacacggagggcaggagcaatcaggcagggatcagatggaagaaagaggcagatggaaggcatgggctgaggtcaggaggcagggagtcagtggcaccagggccagactggggacagccagagcaggaggctgctgcctggagagaaaggccagggctccactggacgctgatgctgaactgggcactccgctgggtgctcagaggcagcaggatctgtgcaaggggcaggtaagtccagacatggatcctgctgggacaaacatcaggggcttccctggccaccaggtgtccccactgtcctgctctatggaactctggggctggctttgtttttagagtagtagtgctagcagaggtaaggatataactactactactactactactactattaytattattattaytattattattattattattattattattwgagacagggtctcactctgtttyccaggctggagtgcagtggcatgatcatagctcactgcagccttgacctcctgggctcaagcratcctcccacctccacctcccgagtagctgggactacaggcatgtgccaccactcctggctaatttttgtatttttatagagatggggttttgctatgctgcccaggctggtctcaaactgctcaagcgatcctcctgcctcagactcctaaagtcctgggattacaggtgtgagccaccttgcccggctgtgattatttttaaacagtgctcagttactaggaacttctatgtgccacctgacaacgatcccctggtgcagatattctcattccaatgaacaggactcctgggatcctggcggagagggaggragcatctgccagaatgtcccttctggtctctgcacatcccctttcctgctcccagagacaggacaggggtcgtatctccctgtgctcatctccagttctggggcaggtgacagagggattgagagaaggctgttcctcgggtacagaggagtccacacgccatgcctgcttgctttctaaacggtcttgtttggtttggcttgtttattggttaaatcagtggttcctctctgcaatattatgatgatgtaaacactgcttttttktttgtttgttttgttttgttttttttgagacagagtttcactttgttgcccacactggagtacagtggcacagtgtcagctcactgcaacctccgcctcccgggttcaagcaattctcgtgcctcagcctcccatgtagctgggattaaatgtgcycgtcaccacacccggctgatttttttttgtattttagtagagacrgagtttcaccatgttgccaaggctggtctcraactcctgagctcaggcaatccacccatctcggacttccaaagtgctaggattacaggcgtgagccaccatgcttagctgattatgtaaacattgttaatacctgagcaagtagtgtccaactttttgtgtttcttggagttattaacagtttttgtcccagctgctcagtttcttttgtaactgttatgtgtgtgtgtgtaacattatcttcrtgccccaaracccatacccgttatcaatcactccccatttcccaccctgtccccagacttaggcaatcccaaatctgatttctgcctcgatggagtttcctaktctggacgtttagtataaatggaatcacatgatgtctggcttctttttacggttttgtcygtgtagtacatgtatcagtatttcattcttttttgcagctgaataatactccattgtatggatacaatgcactttatccgttcacccactggtggacatttggtgtttctcatttctggttattttgaatagtgctgctgtgaacatccatatgcatgtttttgtggggacctatgttgttatttctcttgagtttaaacaagttgagcaccccaaatccgaaaatccaaaatgctccaaaatccaacactttttgagcactaacatgatgctcaaatgaaatgctcactggagtattctggattttgatttttggtttggggatgctcaacaggtaagtataatgcaaacatccaaaatcaaaaaaaaaattaaaaatgtgaaacactgctggtcccaagcatttcagataaggaatactcagtctatacactggagtggaattactgagtcatatggtaactctatttaacatttcaacgaactgtcggactattttccaaagaagctgcaccattttacattcccaccagtgaggtatacggaggggttccagctcccctccatcctcaccaagtcttgttattttttgtctttttttatgccggtcatcctagaaggtgtgaggtggtgtctcaccgtgggtttgatttgcatctccctgatgacatgatgtggggcatctcttcatgtgcttactgactatttgtgtatcttctttggagaaatggttactcagacactttgcccatttaaaaatagggttgcttatctttttattgagttgtaggagttccttaaatattctggatacaggtcctttgttacatatatgatttatgaacattttcttccattcagtgattgaaacttctattcagtggttgtcttttccctttctttttttcccccagaatccagaagtctttacatagccttttcgcttttttatggtatggtttgtagcacaagttttaaattttaataacgtccaattcatctctttttttcctcttttgtcatttgtgctcttggtgtcatatttaagaagacatttcccaacccaagactataaagatttacttctaatattttcttctgaggcttttatagttttagctcttatacttatgcctgtaatccatctcaagttaaattttgtgcatggtgtgaggtaggggtccaactgcattcttttgcatgtggctatccagttggcccagcaacattttttacaaagtctgcttcccccaaggaattgtcttagcacccttgctgaaaatcaattgactctgaagaagaaggtttatttattttattttatttttttgagacagcgtctcgctcttttgcccaggctggagtgcagtggtgtgatctctgctcactgcaagctctgcctcctgggttcatgccattctcctgcctcagcctcccgagtagctgggactacaggtkcctgctaccacgcctggctaattttttgtattttttagtagagacagggtttcaccacgttagcaaggatggtctcgatctcctgaccttgtgatccacccgccttggcctcccaaagtgctgggattacaggcgtgagccaccatgcctggcagaagaaggtttatttctcgactctcaattctaatccattgatctgtaggtctatccttacttagtacctcactgtcttgattatgtagctttgcagtaagtttggwatcaagaagtgtgaatcctccaactttgtttttccttttcaaaattgttttgggtattcttggtcccttgcatctctgtatgaactttagggtcagytatttaatttcttcaaagaaactagctgagattctgacaggcattgtgttgaagctatggatcaatttggggtgtgttgtcagcttaacaaaaataagtctttcatttcatgaacgtgagatgtccttctatttatttaggtcttctttaatttctttcgaaagtattttctagtttttagagtacaagttttgcaattcttttgtcaaatttgttcctaagcatatttattatttttgatgatattgtaaatgaaattatttcttaacttccttttcagattattcartgctagagtatagaaatatattagttttttggctgagcccagtggctcatgcctataatcccagcactttgggaagctgaggtgggtggattgcttgaggtcaggagttcaagaccagcctggccaacatggtgaaaccctgtctctactaaaaacacaaaaattagtcaggcatggtcccagctactcggtaggctgaggcaggagaatcacttgaacccaggaggtgcaggttgcagtgagttgagatggcaccactgcactctagcctgggcgatagagcaggwctctgtcagaaagaaagagagaaagagaragagagaragagagagagagagagagagcgctagtagttttttagtggtttccttaggattttgtatatacaagaccttgttatctgcaaataggaatatttttacttcttctttttcaatctgggtgccttttattacttttgctgcctaattgctgccctggctaaaacctccaatgtaatgttgggtagaaggggtaagaatggatatctttctctaattcctgatcttggggggaaatcagccatccttcttccttgaagtatcacattccatgtgggtttttgtagatacccttcagcactttgaggaagttcccttcttccaagtttgttaagtgtttgttgaggcttttaaaaaaaaaaatcattaaagatgttggattctgtcaaatgcttctcatgcatctactgggatgattacgtggtttttgtcctgtactttgttgatgtggggtattctattgattggttttcatacattataccaaacttgccttcctaggataaattccagttggccatggtgttttgttttgttttgttttgttttgtgtttttgagacagagtgagactctgttgcccrggctggagtgcagtggtgtgatcttggcttactgcaaccttcgcttcctgggttcaagcaaattctcctgcctccactcctgagtagctgggattacaggcatgtgccacgacacccagctgatttttgtatttttagtagagttggggtttcaccatgttgccaaggctggtctcgaactcctgacctcaaatgaccctcccgccttggcctcccaaagtgctgggattacaggcatgagccaccacgtccagtctrgccatggtgtatcatctctcttatatattgctggattcagtttgctattgttttgttgggggtatttgcatgtgtatatataactgtcactatttttccccagttgtgtcaagggatctgtcaaacatattgatactattgatactattttctgaataygcacacacatcagataaaccacctaacgcccccaagtcccatttccctcccctggaggacttcctgctgccttcagatcttccgctcccttttggactgaccgctgcatggtctaagctgtcactccagggccttcttcacgcctccccgctggagccatggctttcactctttctgggtttattttcttccttttgtcacagcgtgttctctggctgtttactgcaaaggagtacgagagaagtatatgttttgtgtccatgaatgtctgaaaaagcttttattctttgcttacactcgattgatggcttgacaggatctagaattctgtgttgaaaatcatccattagacgtttgaagagtttgctccatgtcttccagcctccagcgatgcagtcccctgttgatggccctcctggccatccggygttgtgatgtttcccacggcgtggccttggtgcaggcctctgtccagactcagggcttggtgggcactcttgggcccttccatatgaatgcgtgattttcaatyggaggactcttcttgggctgttgcttggacatttttctcgactccatttttctctgtcttctctttctggaacygctgtaaaatggatgttgaactttcaagacggaccttctgatattcttattttttttccactcctgatttctgttttgttgtctttttcttttagcctaatcgctggatgatggccccagccttatctggcccttccattgaattttaaattttgactatcatatctcatttaaagacctctttcttcatcttagattcctttctcatagcactgtctgtcactctgatacagtttggctgtgtccccacccaaagctcaccttgaatcgtaataatccccatgtgtcaagggtggggccaggtggagataattgaatcatggggtggtttcccccatactgttctcatggtagggaataagtctcaggagatctgatggttttataaagggagttcccctgcacatgctctctctctctttcctgctgccatgtaagacatgcctttgctcctcatttgccttccaccatgattgtgaggcctccccagccatgtggaactgtgagtccattaaacctctttcctgtataaattacccagtcttggktrtgtctttattagcagcgtgagaacacactaatacaccatcttcttgtattcctgatgttcttgttgtggtttgtggttatttatttatgagacagagtttcactcttgttgcccaggctggagtgcaatggtgcaatcttggctcactgcaaccttcgcctcccaggttcaagccattctcctgtctcagactcctgagtagctgggattacagctgcccaccaccacgcccggttaattttttgtatttttagtagakatggggtttcaccatgttggccaggctgattttgaactcctgacctcaggtgattcacccatgtcggcctcccaaagtgctgggattacaggtgtgagccacagtgcctggcctgtggttttgttttatttatttatttatttattttgagacggagtcttgctctgtcacccaggctggagtgcagtggcacgatctcggctcactgcaagcaccacgttctgggttcacgcattctcctgcctcagcctcccgaatagctgggactacaggcrcccgccaccacgcccagctaattttttgtatttttagtagagacgaggtttcaccatattagtcaggatggtcttgatttcctgacctcgtgatctgcctgccttggcctcccaaagcactgggattacaggtgtgagccaccgtgcctggcctgtggttttgtttttaggagagagtgagcagcagtgtgattggaggcttggaggggaggactggagagcctctcaggaagggtgggcggcaagcctttcgcttttagagagaccctggtgtcarcatctcaagccttccctgggcctctcagtgtctcacagaagagtctccaatctgctcctggggtgggggggtggggggatggcagtccactctccccacttctggagcctctcaggacccacctctccagaggaagatccttccatacatgagcaagcgcatcaccccctgaagagggacctggggtggctctgaagattcaagaggaggcaggaggggcacactggcttgccttgctcagtctccctctcctccagccccagctaagtctcacccctcctccatccactctgcgtcctccagggttggttggaatctcccatcctctrctgctgcctctgcctgttctctcatctttgtcggttatatgttttgcttccctcccttcctcccttgctctcttcctcgatccattccttcttccttcttccccttttgctgttattttatgggatttggggaaggagaggcttgaatggcagtgacccattcactgtgtgtaacttgaggccccgtgtccactctgtcctcggggtcctacaacgagaaggaccatctcgagcccgtgaccctgggtggaggtgctggcccaccacggggcatggggaaccaagtccccacccagttctgrmtgatgccaaggcctctctctctgccttccagaacatgcccaatgtccgtgatcatgatgcctcygtctacctccgcctccaaggggatgccttgtctgtgggtggctatgaggycaaccccatcttttgggaggaggtaagatgccagggccctgggataatgggagggagttggggctgcatctcagcatggagagggcctctttcaggaagtccatcctcctgaagctcctcagaggcacacctgagaagtggccggtcccctgaccccaccaagctcaaagccatcttgctcttaccctgacggtcctggcaggcagtcaaatacagacccagggcagctggagggctttgcctcaaaacatccacagagaaggtctgcgcagtgtggagtgatgacctcagaagggcatgagagcacacaagtcctacgtccttcagcaaatgacactgccctcccaaccagctgctgcagcggcatttcccctggcctgggctgtttcccgggcagcttctggggttagggcagccctgcagccctgttctatgtgtatatgcatttagtccacacatggaacgactgagtggctactttgggctaaaaactgctttaatttctggagaaagagggaaactaagataaaagtccctgactctgggtgcctatattttggtggagagacatacaataaacaaacaaatggctgggcacggtggctcacacctgtaatcccagcactttgggaggctgaggtgggcggaccacctgaggtcaggaatttgaggccagcctggccaacatggtgaaatcccaactctactaaaaatacaaaaattagccaggtgtggtggcgggcacctgtaatcccagctacttgggaggctgaggcaggagaatcacttgaacccgggagatggaggtggcagtgagccgagatcgcaccactttactccagcctgggtgacagagtgagactgttacaaacaaacaaacaaacaaatgaacaaggaatgaaattctggaagatgatcgcgcactgaataaaattagcaggttaaggatcagcctagagagactggagcagaaggatatcctttagatgggtggtcagggcagggtttttcagggaggggacatccaagcagagccctgcaccgcgacaacaaaccagcgtgccaggtctgggygaagaactgccccattgaggggtgaaggccttgagctcacacaagcttgctcttcccaaagagctgcaggaaggtcagggtggcgggcccagtggtagaggtaggcaggctggcacatgccatacagggctttggggccatcgtgagctgcagggggccagaggaggcttgtgagtagggaaggggcatggtgggatctaggggagtgggtggaggcctgggctggggtggggagggggagcagacagaccttgctgatgggttggtgggtgggggagacaaacggctgggacgtgtgggtgaccaccagccctctaatgcatctgattcagcagaggctggcctggcagccatcacaaggcaggtttggcatggggatgcatggccttcttggggacaacggagatgttcccctgccctgccttggcaggtgtcagacaagtttgccttcggcctctttgacctggactgggaggtgttcacccagcacattgaaggcgccatcaacagggtccccgtgctggakaagacaggaatcaagtccacggtctgcggccctggtgagtgacagcctcggagctggggtgggcgtccatgggtcctttggtctgaygactgttagtagtgaygccccgtgagaccagcctgtgtcacacaggggacccagggctgtycccggtccctctcgctgcttggctccagcagccctgggtactaggtgtggcctttattcccctctacgggcgagaggcctgggcttcacaagggccatcatctgccccaagcacgaggccagggcctcctcctgcctcaagggtggctggtcctggcttccccacctgggcttcttcatccctagacttgacttgtccctggaattctgtgttttcatctgtaaaatgggaatagcgggccacatcccagcaccctgtgaggctgagccaggaatggaagggctgagaccttccctgatgagaggcttatacagctgtgagtcccagttctgcctccagccccagcccccaccgctcccagagagcactgccctggccaggaccccatgctgctggcctccctcctgttcttggcggcttgcacctggaggccagctcagcgggggaaggttcttgtgtcaagattcccctaactctggccctccttgctagccccaggagaacttagctggaagaggctggagcaaaaaggtgggctcagctcccagatgccccacgtgggtcatccacagcgcagctcagccccaccccaccctactggcctggggagccyrgaaggctctgccccagggggcgggtgtggggctgaggctgctggcctggggagcccggaaggctctgccccagggggcgkgtgtggggctgaggctgctggcctgggccctggcaaaggtgcactctctgggaagcaggaggggctgcagctgaccttggcaccccagtgtttataaccacgggactttgagccagacgtccctgagttgagtgtggggcagcccaggagctaccggtgaccccagagcaccagcattccttcatgagggcattcattctacattaagtggcacttcgtckgtggtggaggcaggcacgctcagggccagcgccctccttctggcaggggagacccaatgcaagtcactgatcacagcccgtgggtgggtgctctgacacgaggcatggggtgactgggtggccacagcctgaggacacagacgggcggccaggaggaggggcagcctagcccggccctggagggcgagtcagcgctgggcctgccgcggatacgtgatctgagcaggggagcaccaggtgggcacagacaatcccccacattggggttccagcagaatcacatggtgttccccactgcttcctggtagggggagctctggccccgcttcagggctgggagagaggttcaggaagacacagtgttgcccccagggaaacttcgtgtcagaagcctggtgagtccctctgtgcctttagtgaagggcactggaatgggtgccctctggagtaggtgcatctgtgagatggtgacggagcactgactcggcagggtggcctagggaccagaagccacaggggcggtgcagggcataggccaggcccagcagctgtagagagcatttgagtagaggtgggcggcacaaagcggggagcccagggacttccacgggccatgcagggagcggatgagggccctaaagacagggaagagtcccgacacagaagggctgtggccaccgaggagtccagccccctctgtcctggcacgctcagcatctgctcagccgtcagcaggggctacttgaatgaattcgactcctatgggagcctttggagtgaagtgcagccccggggagaagcagatagagccccaggggccggggcagcgtgcagggtaggagcacacagccgtgactcactgcccccaccccscagcttgcgtgggtctggcagcgagaaacacaggcccggaagaatcccaggggcacagataaccccaggcgtctctctgtctctctctatctttctcttcctctygttttaattagcctggggagccggtactccccacgaagccctattttggggaagatgtgcaggcaaggacatcttggatctggtctgtcggctggatgggagactggtggggaatcagcatttctccttgccaggcacggccaatggcctttggcctccaggaaagagcagggaagtcccaggcccccgtgacttagggagcgcctsggagggcaggcagagctctcattccaggatggtggagctcaccaaggtcagggtgggagccgcaggcctggcccctggccatgttgcctggaggtcccatgtgtcctcgggttactcaacccgcatgagtcatttgtgaaacatccaagagacccttgttccctgcagctgcccctccgctagctcttgwtagcgctccccgcagattccctgtgaggttgttcagagcttctttcctgccctccctgggcctagaaatagttccagccctcccaaggtgctccctgggccatccccaaacccagcccaggttacctycccaatccccccttttttaaaggtcttgctgtgttgcccaggctgcagagcagtggtgcgattttggctccctgcagcctctacctcctgggctcaagccatcctcccttctccgcctcctgagtagctggaactacaggctcgctccaccacatccggctaattttttgatttttttgtagagatgccgtctcgctatgttgctcaggctggtcctgagctcctgggctccagacmtccgcctgccttggcctcccaaagtactgggattacaggcgtgagccactgcacccggcctcagctcactctttctgccccatcrtcacyttctctggagccttccttgtctctcacccagatggctgctccggcctctgccctctgccctgataacccaggccctccacgtagggccctgcccctctagcctgcctcctcyaccctcccctgcagtggccctgccaccttctgcccctcaaggagccctgcctctcctggccaggctcttagcccaggctccccgtggctctctgccccctcagctcctagcgtgggggccctgattgctctccagggagcgggacggcacttgctcctgatctgcatgcagaggatgaycccccagacttggagccatccccgtatcatcgttcacgaacgaagtgccctggggtccctcagaccagggccggccgcttcctcatctagagtctaacatggtgtggtgctggggtgccaacagtagcagctggcacctcagtgacgcgtggccctcagttcatcgtattttctttacgasaccrtctgttttttgcttatttaagtatttgctccctccctccgtcagctcctcgagggctgggacatgtcctgctcagcgctgcctcccagggccaagcccaggacatgaacgtctgtaggctggcgagcgcacagctctgtggaggttctgctatcccagttttatagactaggacgctaagccttgctcagagaggcgaagtgactcgcccaatgccacacagctaggaaggggtgaagcaggttttgaatccaggactgtggccacagagagccagggttcccctcccaccgtgtcctggcctctgtctgaggctcagctgtggccgccggagtgggacattggtctcctcccccgcagaagttgggagcctttgttggctcaacagacatttatcaagcacctgcacttgctgggctctgaccctgtgctgggcggggggaagtggagtgagaaaactggtcyctgccctctcaaggtccagtgggcaggagtgacaagtctctggcagggacacagcaggacgctggtgcactgggggagccgcagcatggtctccagggtcagagaagggctccttgtcggcaggacaacggccacaagacagcgggaccccaccaggcagaacccagccaggtcgccgtcagctggytctggcagcacacgtggaggggctcagagagcacgggcaggagccagcggggaggcccccatgaggaagtggcgctgagcagggcctagaggagggagggggttgggtggaggggcccctgcagaccctgcctgatcactgctctcttggaagacctcaccccaagagtatgtgcactgcaaaagggactscaggcctctctctccttctttcagaatccttcacgcccgaccacaagcccctgatgggggaggcacctgagctcygagggttcttcctgggctgtggcttcaacagcgcaggtgagtccgggcagcagccctcctggcccccaagagggaggtcctgtcattcccagagctctgggggaggcgggcgcaggagcacygtggcccccgacagtggtggggacaggagaggctggggagtccagccccttctgcttcccagagagtgcacctgtgccagggtccagtccagcagcagtccaatcaggaggcgtgcagcaccccaggtgtgagagcagagcttggagtgtctgtgctgtccgtggagatgggggcacatgtttggacatgggtgggggaccctggggggcagaccgcagccctgcrcttctcttcctgccaggaatgatgctgggtggtggctgtgggcaggagctggcccactggatcatccatgggcgcccggagaaggacatgcatggctatgacatcaggtaagtgcccattgggacctaagggcagggccygccactcaggacaggtggcgtggggtaaacagcgagggctactgagaaaggagccttgcctgaaatccaggtggcttcctggaaggggcagcagtgagggaggaaggccaccagcagaaggtgggcagtgctgagggggtggctggggggcaggtccacgcccctttacagctttgaagatctcttgtcccagggtcctgcctgagcccctggacagctctggagtcatcagtgggatggcatcaccccacctcacagatggggagactgaggcctgggggcaggagggagcggggctgagctgggaaaactgtgctgagtgtgtatgccrcggcttgcagccaggcagccccrgctgtcccgttcaatcgtacactgacaaagcggccaggaatgagacccagtgcaagccacttcctcgtctctaatgcagggtgayggggaggggctgtgraggttctgggagcagggagggcatttgtactggtgaggcrcccagcatggggtctgcacatggaaacgctaagtcatccccagccgaggcatggactggggtgctggtggccagagccggtgacggcagcctatcccgatggccttctgccagtcagggycatctcttgcagagcacaggacagtggtgcaggcgctccccggcaaggggggaggctcctcctgtgtctygtcctcatggcggtggcctctccgacccacacagcagggcctgtggcycgggccactccccgtgcrttgtggggtggctgtygaggcaggacggcttggagggagcccggcctccgggtctctccagcccactctgctcccggctgctgctgctggtggacagcctccctggggaggcagtaggtgggtgggctccggagggagaaggcctggctcagctcggtgcgcccctcgcctctgctgacctagtcctttcctggcctgatgaggacattacgcccactgtggagaagaatgtctgaccccacggagacagtgasactgaggccccccagctgccacccctccatggcacccgacacagtgaagcctcctctggctgactcagagcccgtctgggcctgcgcccctgcactctcccaagcgaggaatgtcccggaaatgataaaactgtaaaggacttcaaggaagggccaaytcaggcccctcctgctgcaaacagcaaaatggaggtgacttgcctgaagtcacccggcttttgaaccagagccaggtagggacccagctccctccccaggagggacagtcytcatgccctggcctcccttggggattccagctctggaacccaccaaccagggttctgtgtggcctctctgtgcctctgtatcctcggctgcaaaatggagctgcccagcctgcccagctcctgacctggggcctagtcccgcactcagcagacaggatgtttgctcatgggctggcagaggccctgaggcgacccctggcaagttgggggcaggcctgggcctccctcggtcagctgtcttccttccatcactgggactttggcgggagtgtgccatgggctgctctggggctgggagccaagggcacaggtggggagcccctgagagctggagtacagcaggaggaggagcacccaccctggagtacagcagcaggaggagcacccaccctgttggtcccagacccctgccaagcagcctggctggtggcacccagggcacacaggctaatgccgtcctcagcccagccgtcactgaygtggggcttccaaaccccttcagtgtgccagagtggacggccgccaccagcaggaccagccaccggcccccaagggctgtagcactaatgcaatgttctgccacctcgggcctgcgcccggggactgagacaagacacagaccctgaaggagagagacagagcgaggagaggaaggaggtgcctgagaaagtcgttgaaagacccagaaaagaaagtgaacagagagcgtcggcgccagaacggagctctcccctgctcagagactcctggttgctcccctcaggccagagccagaacacgcgtgggtcgtccttcatcatacacatgggagacacgcacagcgagggggcgtccygggagaccaggcagcctgagccgtccctgggtgcggggcctgtctgggctccgggctgcgcgtgagggtcccagggctgaccgggcaccagggggcttccaggccatggcagccgccctgcgcgtgagttccttttgaaatcagataagaggctgtctctccagccccatatctgtcagctgcatggcccttggtcagtcgctcctgttctctgagcctcagtttcgccacctggaaaatgggaacaatgtaccaccctcttggagcgcactcgaggctcatgcgtgtggacgcttggcccagtacccaacagaggcagagccagagtgtgggctgggctgttttttcagggaaattccttggggaccaggtgagccagggaagagttgctctttatttaagtgaaaagggtggtctgggccggcctggtccctctgcccacttgctcacaggccgaattggcagctgggactctgtaggtcactcgctgctcctgccacccgacgtgcacctcactgctgcccccaagaatcctcccagaccttcactggctccatcaccccctccttcagctcctggtcagcatagcctggcgcaggtgtgggctgcctttgccgtggccttgccgtgtgactgtgaacacttgtgagacccttccgagcctcagtttccccctgcgtgaaagagttaatcttgggtcccatgcagaaggcagctctggggacaaagagagagggatttcctcccacagcagcactcagctctgagcctgcactggagctgggtgccataagcgacagcagctgttaatgataatatcattaataataatcctcacgtctgcacctctactccccacccatccagatcagaaaattctgcttgctagaattacgtgcagactaagaatcagccctgacaggtgtcactgaggatagaaacgcctctgatgtggctgctgaggcagccttgagtgatgagtgaggttctagcaggtggagcgtgasggggaggcrgggtgctgggaaagccgggggctgacagggaggtttgtgcgtgggaggcggctgcagggccctgatgcagctgggcccgggtctcactccagccagcagttccrcactgtckgattcgggacgggtggctggtctgaggagaccagggaacaagccgcggggcactgattgctctgcccactcaggggcagcagaggcctaggccgcaggtgcagccacagagctccgtagctccatgagaaatagcatggggcccgccgggttcgtgctggacaccaccgggggctgccgtggccrcacactgtgtccccagcctcgaaggaacaaacccaaaactatygcagccacatcatctccggtcccaggcgctggattgggcagccgctccccagacacagctgggattttcccccagagactctgtacctcttgggtccctggtctgacccacagacgaggcccagctttgggatcacagacttggggaggcctgatgggacaggcggccacccttgcccccactcccctgctggcgggtggaaaggggggttccttgatgaggagggggacactggtgttctgacgcatcaccaggctaaacttcaaagacccttcacatggaccctccccagagcattctggggatctgagcccatccctcccaggggccgctccctccccagtcatgtaggggcaccccaggactccccagcactggaacctaggcagcagacagcaatgtgtggagagcgaggcyggagtcccatgtccctgtgggggatgagagcctcagctgggccctctgtccacaacgcccactcactgagggccactggggtggggtggctctgggggagaaagctgagttcacccaagggtggggcgaatggagagtcaggggcccgctcaatgctgagccacaaaggggactctggwgcaggggaccggggtccaggcttaccctgggtcctaggctagcccttccctgacgggccatccccaaagcagtgacccgtccccctgtctgcggcaggcgcttccatcactcgctcacggaccacccccgctggatccgagagcgaagccatgagtcctacgccaagaactactccgtcgtcttcccccacgatgagccgctggccgggcrcaacatgaggagagacccgctgcayraggtaacgcccctacagctcctgctggggactggcagcgagggtctgggacgtcctcagggcagcggagtgacagaaatgcaaggtgtaccccaaccgcaggtcaggtgcggtgacaaggtgtctgtcattccccaggtagtaacccggcacccccatgtgttgggcacagtgctcagggccaagaacattagggaataaagtggaaatggctccctcccacccrggggcttctgttstagtggaggagcaggaacgcacacccaggaaccgccccctgccaactgctggcagcagcgccaacagggcaggggtcctgggggcggggtcttggtgggtgtatgcagccacgtattgggrgagcagccagaacacggcgtacattggagaggggctcctgcctgtagagcctgctgcggaggctcttctgccctggtgagcttcgactcacccattcagtgaaacccactgtcaggtgcccctttctcaggtctgcccctgtgccctcccctggtcccccaaagacaaaggagctccttctctgcgctcccagccccgtctccattccttccccctctccctggccatctcgtgctggacgctttgctttctggggaacaggggctatgtcctaggcactctggttcctgagcattgaggtrctcgggggatgtttgttgaacagatggatgggcggggaggcaagagggaggctcagggagcaggtggcgtttaaactgaagaaggggcctccctcacctgagattccagtgtctggccccaagagagatcctggtattagctgtacctcctggggagaggcccagagtggtcacagggctggctcccagactgccctggccctttggcctggcttggtggaccagctatgatctcaggccacacatggccctggggtctccctagcatgcccccgggcctgtaatcagtaatcacgcccttgccagtcctgacagttcagaagcctccctgggtgaatgcagggtttgctcctctcgcagtcagctcagacgcattcctcagaactgagcagctctaccgaagaaacttggcaagggctgaagcacgcccctgccccccagggaaatcttggttcacccacgcctcgacttcccttcctagttagcagccttcttgcgacacttgacagccgcttaagtttgttctctttctttcttttataaagaggggagcctgccctcttttaatgggctcttgagatgaacagtttgcctccttagaaaggtggcccatgggatgtccccatggttcactgagaggtgggtggattttgtgccctcgattgccatcccctcagaatcccaggcaggcagggaggacatgtccatgtcattgatgaatgctgtggycttgggcgtgcctcctccttcttggggcctcgggggtggaggggagggcaagtgctgttgggacagaccctcagcgggccatctggaaccagatgctgcccccgaggccctctcagccctgcgctcggggcctcrttccagtcagagggggtggcccctgggtagggcccttccaaacccgagagtgggttttcttttttttcccaaaccaaatttatttttaaagaaacctcccactctgtttctctagtgtgttcattacattcgttgttgtgattaagtaggcagatcttaaaatgagctattttaactgctctaaagtgtacaattcagtggcattaagtgcctttgcagtgctgtgcaaccgttcccattacccagttccagaacattctcatcaccccacagggaaacaccatccccagtaaacagcccttcctcatctcctcccaccagccttggcaaccactaagctgtttcggtctctatggatttgcctgttcaggtcacttcatatgctggaatcatccaatacatgaccttttgtgtctggcttcattcctgtagcatgttttcaaggttcatcctgtgataaaatgtgtccaaatttcgttgctttttatggctgaataatattccatggtgtatgcarwccatgctttgttgatccactcatcagctgagggccacgggggttctctcccctggttagtggttgcgcatagagctcagtgaacatgcgtgaacggaatttgtttacaaccccgctctcagttctcttgtgcatacttgggagtggaattgctgggtcgtatggtgcatctttctgctagggcagccacagcaaaaggccacaagtggagaggtttcagcagaacttttttttccccacatttctggagactgggaggtccaagatcaaggtgtcagaygatgggttcctggagagggctctcctggcttgtagtcggccaccttctcactgtcctcatgcagcggggagagggccctggcgtcgcttcctcctcctataagggctccagccgtatgggattaggacccaccctgatgacctcatttaacctaaagatcccatctccaaatagagtcacgtcagggtcagggctttgacatacgaatttatgtggggatgtgattccgtccatagcagatggtaattctacagatgggggttctcagggccaaggcagatcagggcaggtggtaattctacagatgatggttatcggggccagggcagatggggcaggtgctattctgtagctgggggttctcaggatgagggcagataggggaaggtgataattctacagatggggttctcagggtgagggcagatggggcaggcggtaagtctatagatgggattcctggggcaagagcagatcagggcaggtggtaattctatagatgggggttctcagggtgagggcagatggggcaggtggtaattaattctatagatgggggttctcagggtgagggcagatggggcaggtggtaattaattctatagatgggggttctcagggtgagggcagatggggcaggtggtaattctatagatgggggttctcagggtgagggcagatggggcaggtggtaattctatagatgggggttctcagggtgagggcagatggggcaggtggtaattctacacataggggttctcagggtgaggcagtgagggtagctgcaaacactgggctggaggcctggttccaagagtcagggcctccttgctctccgcacccttgggtgtaaagtggcggatgtggctctctgccctgcgcaggggtatcaggccatgcgtgacagatgcctgttccccactcctgctcaggaactccttggacaaggctgcgtgttccaggagcggcatggctgggagcgaccgggatggtttcatccccgaggcccagctccggtgannnnnnnnnnnnnnnnnnnngtgtcagacgatgggttcctggagagggctctcctggcttgtagtcggccaccttctcactgtcctcatgcagcggggagagggccctggcgtcgcttcctcctcctataagggctccagccgtatgggattaggacccaccctgatgacctcatttaacctaaagatcccatctccaaatagagtcacgtcagggtcagggctttgacatacgaatttatgtggggatgtgattccgtccatagcagatggtaattctacagatgggggttctcagggccaaggcagatcagggcaggtggtaattctacagatgatggttatcggggccagggcagatggggcaggtgctattctrtagctgggggttctcaggatgagggcagataggggaaggtgataattctacagatgggggttctcagggtgagggcagatggggcaggcggtaagtctatagatgggattcctggggcaagagcagatcagggcaggtggtaattctatagatgggggttctcagggtgagggcagatggggcaggtggtaattctatagatgggggttctcagggtgagggcagatggggcaggtggtaattctatagatgggggttctcagggtgagggcagatggggcaggtggtaattctacacataggggttctcagggtgaggcagtgagggtagctgcaaacactgggctggaggcctggttccaagagtcagggcctccttgctctccgcacccttgggtgtaaagtggcggatgtggctctctgccctgcgcaggggtatcaggccatgcgtgacagatgcctgttccccactcctgctcaggaactccttggacaaggctgcgtgttccaggagcggcatggctgggagcgaccgggatggtttcatccccgaggcccagctccggtgagtagtgcctgctgggctgtgctgctgggaggccctgccctgacaacccccttgcccctccrygtgycccgtccttgcccctccgtgtgcccygcctccccaggtggttccactgtcgtgatcagttattctgcacacgggaagccgagccctgccgacytgcccccaaggctcagtgcattctttgtgccgttcacgcaattcccactcctcgtcctccccactacccgtccgctgtggccaggccttccatggcctaagtgggaagggctgtaggcagagcagaaggggtgtcctgcggtggggagacagcaagaagactcccccaggttgcaggaggaatggagcgtctcctaattctgtgcatctatttttggccactccgactgttggtttatgtccgtaggagggcaggcactgggcaggttgatgcacccagggtgctcagtttcccagtggaggtttcacagtggcctggactctgggcgtcctctggggactcccagggacctgggtcctcagtgagaggaacaaaggcagtcctgctgtgaaacctgggacccagaccctcgggagcaggggacgcgaggccttaaggccagctgaggggtagcatttgatccagatttacagaaatcsaaatccccttcccggggctgcgtctcaccagtcccctctggtgcacccaccttccatccccatggcaacccacagcccaggccaggctccagagctccagggcatcgggaggggagatgagagccagagctggctaacggggccacggctctggggtcagagccttgcaggtcatcgtctcttctcctgctggcccctagggacatgccgtcctcatgaaccctgcggggaggaggggtctgggcagaccctgtcttgaagtgcaacccactgtgttccagtcagatctggccctggaagcccctctcccctgtccctgggcgaggagaggagagtcaggaacacaccccaggtcccaagatgggcrgattttgcacccccacccgggagccagcctgggtgtccaggacaccttggcagggctgcagtgggtgggatgtccctgctggggaggggggtactccatgcagagatgccagcaaagcctgactcccttacaacctcacactggctcccacttgtgtgtgaagaggaggtgaggcttgggcggrcggggctggcrgccctgggaggttaagaattgcccrcacctgcattcacagctgtgccgtgtcggcagttaggagggcaggtggcggggtggggggttgtctgcaggagcagcggccagggaggggcatggggctgtggggctgtggggtgtctgatgggggcagatcccagggaggccaaggcagtggcagaaaagctggactctggagcccacgcacctgcctggcttcgtgccactgccaggtccaggacttgtctgtgcccttgggcgagatataacttctctgcgcctcactttcctcatctgtagaaaggggcacacctggtaggagtgtaagacgcttcccgcaggggctggcccagagcaggagctgggcctgggattgccgtggctccagggagcagccctggctgaggtcctgggtaaccacctctccctgtcgttccccaccttgggtgcatccagctcctcctccagcctcctgggccctggctgggctctcagacccaccaggcaaccctgcggcctcctttgtgcctctgttttgcctggacctcatgggrgccccctgcccgcgtccacaacacacgggcactcagtgcagggctctccgagggcagggccaggcctgaccccatcacagcctcagcgggaccccgctctggggagggaagcggggaggggccaaagaggcaggctgaggaccacgtcttttcttcccaggtcctcgagtacgactactacggggcttacgggagccgcgcgcacgaggactacgcctaccgcaggctgctggcagacgagtacaccttcgccttcccgccccaccacgacacggtgcgtagctggggtccaccgtgggggtccgtccttctgcctgtccctcagataagccattgcrccggccctcggctggccctgcaggggctcccctcccccaggagtctcttcgggctctgcattcacgcttttttcggctgactccattttgaggaggaatcatgcgttttcctctccccctcctccctctgtgccgagattttgccagcagccaggcctgagcggaagtggtgctgctggggatggggtraggtgggggcgraggcaacgggctggggcccggtggggctgcaccgctctgagcctccgcctcccgctctccggagctgcgccgaggctggcatgagacgtggtgggggaagggggtcctccctcctggaagccagcgcagagtagatccaggacaagggggccgcaggctcctgggcatcaggccccgtatgggcccctccaagggacaagcagagggaaccagagccgggagggccgtggcctggagcctgcttgctgttcctctggctccaaagtgggcaggcgaggctgctcacacggggcagctggcagcccgtcgcccctgcctggggacctggctcccacgtgcagggggtggaggtgaggagtcttgggggtcttctcccccgcagcagcctgcaccacacaggggcgttctcccccgcagctgtccgggaaggagcgaggccagcgtctgccctggcctgcccagtcgtgttgtaaagtgctcacaggtggagcacagctgttgtccccgtgccaccccagggagacgcgtgacacctcactgcgaatctgacataggagcagagccaaggcctgagcccagagtctcagagcccagggacagcttaggaggcatccacgagggggttccttcctggggcctctrggccagtcgcaagtccggcttgggtagggtctgaccctgcggtcgtccgttgccttgaagggccccgcttgggttcatgctgtgctgtcagtgccttgagactcttcatggtctttgagcaaggtccccactgggtcccgcactgggttctgtagccagttctgaagggaakaaaccgttcatttccaccatctccccgaaagcttgctctagtggtggaacatctgttcaaggcgtcggaagagggggctcctgcaggaaggaggaggcgtgtgtgtcatgaagcgccgcagcagcagggccggctcagtgcccgagtcccttgtcgctgcctcccagggagtgctcggggctccgtctggcacctccgcacccacagcttctaaagcctgtgggactctggccctcgaggatgtgggagctcgggggagatgccaacttggctttgtggcttcatccggcctccgcaaacgcgcctgaagccgtcctaaagcacgaaacacgtgcttgttcttggcgctggcagcttccccggcctgctagaggagcccagcgcgggaggctgctgagggttttggttggcagccccggtggcatcagcaaaggtacagcagaaaccgacaaaggggagccctgtcctgaaggacagtratgcctggtggggctggagaagccatggagagctcaggaggcagatggtccctgtggtgtgctggtaacagcttaacaaccagctctctggggcagaggggaggaagctggctctgtagcaccggccaatttccctgatgtaaatgctttctccatggctgatttcaatccagtccgccaatgaggcatcactgaatgtggagctgggcagggatctgcctgaccagctgtcagggtcagtgcacccctgcacagcctggctggaccataactctgccactgcctggctgtgccaccatccctggcctccctgagtatgtgaggggtaatatgagttcccttgtggaaactcaaagggagtttgggaggagatgaaacagcttcccgacacacggcagctgttcaggaagctgtggttgttgctgtcatgattatttttttcctgtaacaacaatgaggtgggcacctctgctcagcagtggggggcatgttgagccctgaaggggaagaccaagtagaacatacagtgaagaatagaagattctcaaaacctcacccaggcatttgtaaacctggggaaggaaatagggagtgatgttgtttatgtgtgtgtgtgtgtgygcgtgcgtgtgtgtgtgtgtgctttgaaaacagctttattgagatctaattcgcatactatatgatttattcatttaaaaggtacaactcagtgttttttagtgagttcacgggattgtacaaccatcaccatgatctagttttagaatgttttcatctcccagcaaaagataccccacacctcaccctatccccagcccagggcaaccctactctactttctctctctgtagatatatctagtttggacgtttcacgtaagtagaatcataaaagatgtgtgcttttgtgatcagcttcttccacttagcgtgatattctcaaggcacattcatgtcgtagtgtgtgtgtcagcacttcattccttttttttttaatttttcaaatttttatttatttatttattttttgagatggggtcttgctctgttgccccaggctggagtgcaggggtgcaattcggctcactgcaacttctgcctctcaggttcaagcgattcttctgcctcagcctcccaagtagctgggattacaggcacaggccaacatgaccaactaatttttgtatttttaatagagacgggatttcaccatgttgaccaggctggtcttgaactcctgacctcaggtgatccacctgccttggcctcccaaagtgctgggattacaggcatgagccaccatgccaggccacttcattcctttttatcccaatcatattccattgtatggacccatcatattttactcatccattgatccgttggtggacattggaattgttttcacttttgagttcttatgagcagtgctgctgtgaacatccacgtaccaggtgtcgtatgcatgtatgttataatttcttatgggtatataacgaggcctgggtcaagtggtatctctgtttaacattttgggggaacgccaactgttctccaaagtaactgtaccacattacattccccaccacagtgcgagagggttccagtgtctccacatcctcgccaacacttattattatctgactttttgattctagacatcctggtggttgtgaaatggcatttcagtgtggttttgatttgcattcctggaacaactaatgatgttgagcacattttcatgggcctgttgtccacttgcatatattctgtggagagatgtctgttcagatcctttgtcccttttaaaattgggttatttgtcttattattattatyattattatttgagacagggtttcgctcttgttgcccaggctggagtgcaatggtgtgatctcgkctcactgcaacctccgcctcctgggttcaagcaatgctcctgcctcagcctccycagtagctgggattacaggtgcacaccaccacrcccagctaattttgtatttgtagtagagatggggtttctccatgttggctaggctggtctcaaactccagacctcaggtgatctgcctgcctcagcctcccaagtaattatcctgcctcagcctcctgagtagctgggattacaggcatgcaccaccacgcccagctaattttgtatttttagtagagatggggtttctccatgttggtcaggctggtctcgaactcctgaccycaggtgatccacccgcctcagcctcccaaagtgctgggattacaggcatgagccaccgcasccgactgtctttttattattgagttgcaaatttttttatagtttagttacaagtctcttatcagatctgtaatgtgcacacactctccccatcctgtggttgtcatctctcttccttgatggcattgtttgcagcttttaaaatgttgatgctgtccaattcatctctatgtttttgttttgttgcttgtgtttttggtgtcatgtctaagaacctaaccgaaggtaaaaaacatttatgttttcttctaagagttttatatcttcrcttttacacttaggtctaggatccatgaaaattaattttttttgcatggcgtgaggtcgggtccagccacgttcttttgcatgtggctacccagttggcccagcaccagttgttgaaaagattgctctacccttggaattgtcttggcacccttgttgaaaatcaattgactgtaaagatgagggcttatttctggactctcaattctattccgttgatctataggtctattcttatttagtacctcactgtcttgattatgtggctttgtattttaatagcaagtttggaatcaagaaatgtgaattctgcaattttgtttttccttttcaatattgttttgagtattattggcccctttgaatctccatatgaattttaggattggctagtcaatttctgcaaagaaaccagctgagaattttgatagggactgtgttaggtctgtagatcaatttggggtatcttgtcatttcaacaatagtaagtcttttgtttcatgaacatgggctgtctttccacttatttaggtcttctctcatttctttcaaaaaatctagattttaggatataagtttgggactttttaattaaatttattcctaagcattttattatcttgatgatattacaaatataattttttaaaacttccttttgagactgttcattgctaatatagaaatacaatagttttttgtgtgtttttatatattgaccttgtatcctgcaacctcgttgaactattttattagttctaacagttttttttcttttttttyttttttttttttagkggattccttargatttcmtatatacaagatactgttttggcaaatagggatgtttttatttcttcttttctgatctggatgccttttayttttcttttcctgcctaattgccctggctagagcctccagtgcaatgttgaatagagtggcaagaatggacccccctgtcttgttcctgatctttcatcatgaagtataatgtttgcaatgtgatttttataggtgtctttcatcagctgagggaagctcccttatagtcctagtttgttgtgcgtttttatcatgaacgggtgaattttgtcaaatacttttctgtatctgttggaggatcagatggtttttgtcctttgttctcttaatatgttgcattacatcaattgatttttgaatgttaaaccaacctcatattcctgggataaatcccattgatcatggtgtgtaatctctttcctatgttgttggatttgatttactagtattttgttgaggatttttttgtatctatatttgtaagaaatattggtctgtagttttcttataatatctttttctgcttttggcatcagggtaatgctggcctcctagagtgaattggcaagtatttcctattcatattttttggaagagtttgggaaaaatgggtattagttctttgactgtttggtaaaattcatcagggaagccatctggacctgggattgtggacaatttttcaattacgaattccatctcttttttgttttagttctattaagatttgtcatgtcttcattctgtttcagtaatttgtgtgtttctaggaatttgtccatttcgtgtctagtctgttggcatacacgtgttcggagttccctcagaatcccttttatttctgtggggtaggcatgatctcctgtctttcattcctgattttagcactttgagtcctctcattttctctgtcactctagctagaagtttgtcyattttgttgatcttttcaaaacatcaactttttgttttgctgttttttcctatttttcgattcttatttctgttctaacatttcattccttctgcttgctttgggtttaattatgctctttttctggtgtctcaaagtggaagattgggctattgatttgagatcttctttcgtaatgcaagcacatacaagcagaaatttccctgtgagcatcgctttagctgcatctcataagtggttgtgtgttgtgctttcattttcatttaattcagtagcttctaattccctttgtgattcttttctttgatccattggttctttagcagtgtgttgtgtaatttccacatatttgtgaattttccaattgttcttctgctattgatttctaatttaattacatcgcggtcagaggacatcctttgtatgatttcaacctttttgaatttattgagccttattttgtggcttagcatattatctatcctggggagcatgtcctgtgcttgggaagcatgtgtcacagtgtgcacctgagctgagaagggcttggtgcgggctggaagagagggaggggaggctcagtacaggtgtgttggamacagcccccgttctccacgttcttgaggaagaagcacaccccaaaggcccccgtggcattcccacctgtctggaacttttcagatcaagaaggagtgcctggcctgcagaggggccgcygctgtgtttgacatgtcctacttcgggaagttctacctggtggggctggatgcaaggaaggctgccgactggctcttctcygcagatgtcagccgacccccaggtatggagcctgaggttggggggcatgttcctgtcactccawgggcacagcctcaggcactgagatgagctggcaagccaccctgtcccctcgggcaccctgagcacactgctccttgccctcacctggctttgagctccccccgtccggccccctttgccccatccsaggccccaggccctcattactttcctccacctctccctcctgccttccttctcctccctacctctgccttcctctctactcttccagaaaggatgtgtggcagctggccctcagccacgtctctcctgggactgtggggcccagtcccccccatgctctcacaggtgggattgccagaattaaatagaaacacaggatgctaagctacatttgaattttggatacataatgactcatttttaatgtaagtatgtcccaagccatatttgggacatacttgggatcttcatctgccttttcgtcacccacccacccacccacccaacagctcatgcgtccccatcttcatgagtgttctgggctgccagaacagaggatcacaaacctggtggcttaaaacaacamcaatttattgtcacggttctggaagctggaggtcaaaatgagggtgtctgtacctgacactctgcagaggacccttccttgctcttccagctgctggtggtggccgggartcttggccttcctcggcatgcagctgcgtcactgcagtctctgcctgtgtcacaaggccttctccaggtgttctcttttttgttttgttttgttttgagacggagtctcgctctgtcgctcaggctggagtgcaatggcgcgatctcagctcactgcaacctccgcctcctgggtccaagtgattctcatgcctcagcctcctgagtagctgggattacaggckcacaccaccatgcccaactattttttctatttttagtagagacggggtttcgycatattggccaggctggtctgaaactcctgacctcaggtgatcctcccacctcagcctcccaaagtgctgggattacaggtgtgagccaccgtgttagaaggacagcagtcagattagatgagggcccacactcatgacytcactttaacctgatcatatctgcaaagacctcatttccaaataagatcacactcccagtcctggtgaggactttcacatatcttttgtgggggacacaattcaacccctaacatcatctcttcagccagccaaccaacaaacccactccccagactcccaggcacctgctgctcacctcccattaatccagccacccactcagtcttgcatccacccatccaccagcccacacatccctgtttctccatacatctgttcccccttctgctcacccactcccatcctcccatccatctgcccaccttcccatctgtccatccatcctccatccacaaagtaatttatgccacagacatttatggagtcttctccggtaccaggcacggagctaggagccccagaatgaayggggggcatgaatcctgtccctagaaacttctcagcatggtggtggatgggtgggaggggccagtgccaaggcatttcaagaagaaagaagcttccttcccgcaagggtgacggtgatgggatgtcctgcccatggccagtcctctctgggtcattaagctgaaatggcatccctgggctgaggagctctccaggtcacctcccagtagggcatcctgtctgggggttatccagcctccgtgacaaggagctgcccctgtgagcggccctggggaaactgaggcagcacagacccggctggggcctcagcacagacccggcttccttctccctctcgcaggctccaccgtgtacacgtgcatgctcaaccaccrtgggggcaccgagagtgacctgactgtcagccgcctggcacccagccaccaggcctccccgctggcccccgcctttgaaggtatgggatgcctctgtgcacacggcrctgtgactgcggcctgctctgtggactggtggttgtggacagggcaggatggacgggatgggctgctgacggcagctctgtcattagctgttgtgcccgctgtggtcagagctgggagattagaggtctcgtttcaggctaaatgggggctttgttcaggcggcattgctggagctcccagtactcagygattgcatctctgaacctgtccacgctgttgcggttcggagtggctgcagtgtgggcgtgctcggctcggtttcccggaacaaagcgtaccaatgctaggccgtgcctcccactcaaagcagtcagctcctttctgccactgacatccttgctgggttgacttctcaggcccgtgtgaccctctagtctggagcttggataggcccttagaagacgtccagttcagggcccacgctgatgcctgattgcctgctgcagtcccaccatgtctgcttgcataccctcagggacaggtagctcagtaccttcatcccttgtttgctcagccccaactgttacgcagagccaggacctgcctcttgtcccttcagctccctgatcctgtccctgggttcacacaggagccatctgatctctcgtcctgtaacccatccccaccagggatgaagaagcagagagggaaacattctctttctccaggaagaggcattgccacctctgggatgggaccygcacaggggaaggtgctgaccgtgcagctctctgtgctgtccccggggcaggggcacagtcagcggggagggctcagcccattcagaaaacctggcatctcctggttcttgacctgactccgtgctgctggcaaatgtagttgtttcctcactgggactcggtcagtgtcgagccccagcttgggcactgggggagagaggcaaggggagaaaggggctcattcatgatcagctcataacccgcaccttcggcagcagtcattgagcaccgactgtgtgtcaggctcagtttgaggcacggaggacycaacagtgagccaaacacaggaggttctggcccatgtggagtttgtatctctggtgggaggaaataggattaaaaaaataaaataagtggaaggtgtaggatgttagatgggtcaagaggaaaaatgaagaccggagggggtgggatattgggggccagggtgggaagacagcgctcctcactgcccagcgggtcttcggggctgggggctggcaggggctcctgggcctctgcggttctgccaaaagcagggagtagtgaggtgagccctgcggtctggaggctggtggyggagatgaggctgagagcgtgagtgaggggtcctatggggtgcgcagagctcgcccaccccttccctcctgccgttggcgacgtggaggctgagggagccatgggctgagccacagcgctcgtgcctcatggatccatgagctcgttccttcgctcgttccctcaacagtcatcacgtgagcctgcactgtgtggaagcaccaggtagccagggtcgggaggagktgaaggaggccggtggggcttcagggaccccacagtgggctgtatgtccagacgggggcaggaagggccccgtaacacctggagggggacatgcaaggggatgggaaagagcgaggtgttagggaaggccatgtgaagccgccgagccgggatgagcaaggcttcctggaggagagggccggcctgagcttggaaggatggggaggagccactggctacaagsgtgtagaggtgagaaccagtgtgacctgcccatcgctggtcgtctctgggtcattcagctgaaatggcatctctgagctgagaggagtgttgcctgtaaggagctaggcatcagcccccagtagaggggcggcccaggcacagcccatagccgcagacttagtgagtctagctagggagacagtagaggggccaaaatgaggacacaggtcaccaaaaatcctggccaggtcctgccactacctggctcagcgacctgcccccccgagcctcagtttcccccattggtggaatggagtgaggaagacgcgcctcccggggctgcratggagaattgagtcagagtctgggggtgctgggagggctggggagcagcctccctgagcctcagtttccctggctggggaatgaggaccttgctcgtcccccctcataaggggaagctgtcaggaaagtgctttcaacgytgagccatctcccagtggtgcacaattagctttccagaggattctggtggattcctagagctgagggctggggatcggcggtgctggttgctgggaaggtttgcacttggtgggtgtggagttagcacagtgagtcacatcccccagggctctgcgggtcctggggacaccactcaacaggagaaaaccaccatgtgggctttgctttactttcaggcttcaaaactgcactgtttgagttatgaatatgcatgggcattaaatatgcgcgtgttgaatacgtgcgctacctacccatgctgcatcagatcaccacggagccgagagaatgtgatgatttacacaatgtgatcaaggtggcatacaaagcagctgtcaatctcaaaagtaattttaaatggtctttattgatctttttgtaagattacaaaaggatacatgctcctgggaaccattccaatgatactgaaaagcacaaaatcagctgcacagcccacagctccccccacacccactgccgatggtgcaagtccccggccaccctgccttctcactgctctctgccatgtcagctttgcaggccaggcctggacctgggctgactgacctctggcctcaggactggcgtcttgttttcagggaagttgatcatggatggtcagggccacaggaggccaggcccatcagctgccatctccctgggcaccagttggcctcagtagctcccatgccctcctgggagaggcctgggatggctgcagactgggggggccactcaggagccaggggcctgagagtggccgtgtgtgtgtgtgtgtgtgtgtgtgtgtgtgtgtgtgtgtgtgttgggggaggtgaggtagggtgtctgtctgaatagagctgaggattccatccagaaacggccccagttcaggtgtcggggaaccccttgaggactggcttgtctctttgccttcattctctgttgtgcttatggtgtcaagaggaagaagrgagggagcagcctggctggggcctgcctggggccctgagaggtctctcgtccaagggtgcttccaatagccctgtggggccagatgttgtgggtctgccccttttacagatgagaaaatgggggctcagagaggtgagaagcaaggccggtgagccgcagaactgcatctgggccaggctggcctaggcctgtgtgttcccaagacaccgtcctcccagggtaggggcatccctttgaggtgtctgcagaggggtgggtggtaggggttgagaagcaggtccttctcctaacccccatggctcagaggatactctgcaaggcgtggccctgggggacccagggagggacagatacggttcctgggcaytgtgaaggcacaggcccctgagagggcatttgttttctcagccgggagacccttgggccaccctctctgtccccacctcccaggccctgaaatcctgctctaagtccaggtgcctctcttccaggggacggttactacctggccrtgggcggggccgtggcccagcacaactggtcccacatcaccaccgtgctgcaggaccagaagtcccagtgccagctcatcgacagctccgaggacctgggtatgatcagtatccagggcccagccaggtgagagaggactgggagcccgcccctgggtgcacctgctgcctggacccaggtcctccaacaggcccttgggcagaacagcttgtccagaatgggccattctgaatagttaagygctctggtaaaccagagatgccattctgaataaatatcttcaaagcactggaatgcagataagccggtaacacgagtcagactgaaatttacagctgttcagtcactgaggaccccaggatcccagaggggagggcagtctctgagtcaccagtgcagtctaggaattaccgtccaccatcccaaagtgggcagaaccaggccagatttcgccctgctacctggtaatttctgtacgccaccttgatcacatgggcagaataatatcctataccgaggggtccctggctcctccggaaacaccctccatgacaaggttaaggcttatccatgcgtgcattccttctataaacacctgccgggctgtgttcccyacccatgagaaaccaggaccggggaagaccctcggctgctggctcatgcacacagccacagaagagtcttgggcaaaaggacggctgagcaggtgtgcaccttggaaagacccctctgactgtgcttcggaggctgggagaagggactgggggtgggggacagggaggaaggacatcatgttagcagccaccartggagcacctgtgacttgccaagcctgagccaacatctcccatccccacggtagccctttgaggtggtcataattgttcttatttttactgatgcagaaactgagaaacagagaggttgagacatttgcccaaggtcacacagctggtcagtgccagggctgatggggatgcgtcccccttgtgctcagaagcctgcacacgctcaccgccaccctttttcaagagttaaaaatcctctgtgagaaaacggcctagtctaggccttccattggtgaccctcccccaccaggctaaggggccaggacactcatctcggtgtgcttcctgccgccacatctgccttggggctggacagggtggctctgctggactgggcaggaggaagaggcacgagatgagggcactgcttctggggacatggaggatatcaaaggggtgatctgtctctggaaaatgatggtggcagcttcggggagaggatgggaaaggagaggaggagaggcrgggaggggtgggggggagatgagtctccagcctgaaggtcgccgaggtgagcacttgaygtagcagggctgtgtcctggtgatatcctgtcagcctgggattctgccgagacctctggctggagtgcccagacyctgccatggggtcygctttccctggcaccccacgctgagtcctrggccagttgctcccctctcaggctgcaagggaccgagctgttgctktccgtccaagcatatgcactgtggtgctcaggggcacacggtagacgcgtgcttgctgaggaagggatagaatcggagagggtcgagtgctttaacactaactggcttctgccaagtgtttgacttgaggctgctcatagaaaccaacatgcattaaggagacatttgggcagaaccctgcaggaaacgagtgacccagccttggtgttctgggggaactgctcccagcagtggtaacagcaggtgcaaaggccccgtggcaggccagtgcgtatgtctgaggcacgcattgaggctggratggagcaggccaggagcygggctcagagggcagcagggtgagatactrgaggcccagcagctgctcctctgagggaggggtgctgagcagaggaggaacatggtcgggcttgggctttggtgggggggtctctgctgttgggtcagcgggcagggggccagcaggcctgtgaggagcctcaggccaggcgaggcagggatgccaggagggagtgatgagctgagtccatgcggctcacgggcgagggtttggcgttgtggtggttcccatggactgggcgaggctcatagyacccgacagtggatggggtgtgctgagagggtcgggggarggtaggggmcagagacagcttccgcgtgcatgatgaagagtggagggtgctggccgcagctgccgggaaagggactgggatgcggtggaatcatgcagtccccagcctggcccacaggcagccgygatgctgtgtgcttttcatttctcacctgggtgaccccaacctccgcatctctggggtagagggaggggtgtcaakgcctggtccttggaatcctctggcttcattgccacgccarccttggacagggagtggggatatttttagtgtgggggaggcaggtgggccgtggagggaggaggtggcagatggaccgatcaaggtgcggcccgggggcggccggtgcgcccagcctcattataagctgctccaggcggtggcgggggaggcagccagggcgggaagaggagctcgctgcctcctggtaatttcttaactttctcctccaaaatgtcctctatctttcaaaaataacccaaagtttcttagatgaataataatactggtgctgctgataaaggctgcactttcggaattgttattcaggacgtgctcagcacacctactggacaatggagtaggggctgtgtgagctgctgccccatggaactttctggaaatgctccataactgagtggtccaacacgcagccactaaaccctgtgtggctactgagcctttgaaatgtggctagtgggactgcatttttaatactagtggatgtaaactcaaatagccccctgtgctggtagaggctgggctcggtggctcatgcctgcaaccctagcactttgggaggccgaggtgrtaagatcgcttgagtccgggagtttgagaccagcctgagcaacatagcgagatcctatctctaaaaaaacaacaaaaaaatttttcaattagctcagcacggtggtgcacacctgtagtcgcagctacttgggagcccaaggcyggaggatcgcttgagcccaggaggtcaaggctgcagcgagctgtgattgtgccactgcaagccgccctgggagacagggtgaccttgtctcaagccaaaatgaaacaaaacaaaccaaaaccaatatccttgcgtggctggragagacggtgtcgtgcagcccagaactggccatcgctgtggtcatggttagcaccaggggctttgtgtgctttcttgctggttcctcacagtggccygyggcatcacagatgagggactggggcttggtagggttcaggggtaagtacagggcstgggactagaaccggggcctctgactgggaagctcgtggacccctggaactgggcttcccctgaggttgctgagcccatagcctgggtcagagcccttcaaagccttggaccaggtggcagctccaggcttctgccccagggtcccttccgtgcggctgccactcaaggctgcagagagcatgtgcttgtcaggtctgaggcrctggtatcactctccagggcttggcaccacgtgggtgctgagtggttacataagggtcttggccaactgtaccacagctgagcacctcaggctgacgtgggtggcggctcccagcactgtgacgattgggattagggtcagcagtacttctggacagcccaccctgcagcctcaacacctgctgggatcccagagggacagaagtgggggggcgtctcctagcaatgggggcctcaccctgctgtgccaagccagggtgttcacagtcagttctatttactgagagcctgctctgtgccaggcacattgggatagggggatgctgttggcacggagctcctgggggtggatgcattgggggtgggtacaaccaatgtgagagacaccctggcaggagactgtgggatcttggacaacgagtacctgcccaagacctagggagtcagggagggctycctggrggaggtgacagctgagccaagagctgaaggatgacaaagggttaagtggtgacaggggaaggggtgagaatgcgaaggggcacaagagggctaggcctggaggtgggcacggtgcccaggaggtgagggcttcctgggagaccatgggtgttggctccagtgaggtctccggtacttgcgcaagtgtgagagtagatgtggtgctgggtaccacggagcagggaaagtggggagcgaatccccaccctcgcagagcttaaaagcaggggtggacccagcaagtctgtgcaaactgtccagtatggactgagtgtccagtgctcaggaacattcccgggccctcatagcactgtggcactcaggtgcagccctgccctcggtaggtgacagtcccctaggaggttgaaatggctcttagcacctgctgggtgctaagcccagctctctacctcctccaagtctgcagcctgagcgtctcacacccatgtcaggcagaggactttggggccgaggtgcccagttggagggttaggtcagggaacagarcggggtggtgtctgggaagagcactttctgcagtgggctgggaggaggccggaatctgctccaatccggctctgccttgggcaagttactctactcttctgtacagcactgaggccaccatagccagctcctctctcgggccgtggctaccaaagcagcagctgaggcccctctggcctcygaagagttggaaacctggagaggcctggggatgtggattgtggattgtggacctggtccagatgctctgttcctcctggcctgtgggcttcaagggcattctatggttagataaccactctggcctcasttccccatctaagaatcrcgagtcccgttagagctatctccaagtctggcctcccccaggggtcctgctagccctagcgttaccccgttggaaggtggctgtcttatgtatatttggaacgtacatctgtcttggtgtatttttattaatccatgtttattgtcatctgtctcatgaggacagggacttatcccactcatggcaggtccccrgggcctttcctgcccaggccccacccgtgagcacttgctgactgagcgactttgctcttgcctgcagccgagccattttgcaggaggtgctggacgcagacctgagcaacgaggccttcccgttctccacccacaagctactgagagccgcagggcacctggtaggttccagctggccacgtcctctgggtcgtgggtggcagcatggtgtgaggggtgcgccrggggatctgggggctgggggctctcgggcaggttcctttgcctccctgggcctcggtccccaactgtgaaggggggacagtgggaccaggcggccctcctacaggctgttgggagcttggagaggtcatgtggatcaaagtcacagcgtcttccatccctcctcggtgcctggtgcatgccagggactcagtcccagggaaggtggccttggcctcactgcctgcatcgccacctattgtatcccctcctgaaaggcgcggggcagccctcccgaggccaagtgacctcctggaaacgggagggccgagctctgctgagcagtagctggctccggagagctccgtgtggcagcctcccagctgccattgtgggcgtgggaggaggggctgctggggtgggagcacagccagtccccaaamagcaccccacatgtcccccaccaactctagaaagcctstatcctgggggccagagcccgtcccttctgagatggtggtagtgtccggagccagcactccatgggacctggccccaggcaggaggctccctcagagaccaggatcggggcccagattctagttctgggccagcacgwccctcttctgggctttgtttccttgttggaaaacaggcatcttggcatctgctttgacttctcgaggctgagatgaggatggtaaacacagcagcccctgtttgccgagggcttcctgtgtgccagacactgttccgagaacatcacagcacactttcccatgtaatcctcgccatagtgcgggcggctctgttacagggtctcccaacctcagcactactgacgtttggaggagatcctctctgctgtgagggccctcctgtgtgacacaggtgtgtggccgcctccctggctgccgcccactaggtgccagtggcacccaccgtcgtgacagccacaagtgtgttcagacatggccaagggtccgctgggggcaggatcgcccattgagaacctcagtgcatgaccaccctgcttgtttgcagggctgtaagccatgtagtggcagcgggggccgggcctccagagccctccagcgctcatgctggaggagatgtcgccctgcatgacggatgttacccagatggagctcagagaggctggatgggccaggctgctcagggccgcccggctaaagaaacccagaaagcccccgatatgtgtcagtgacacrgatgtggccttcaggagggggtgggcgggtgcacggccgcgtttggaggcagctccctgtctctccttcctgtatgttcgtctggggtttgggtggggaaatgctaaggaaggttggggaggagcgaggtcctggcctgcagagggactggaggtcctgggggacaaatctgggttctgttagcagataaacaatctggcgatgactgtcagggaggaggcggccagaaactagggagatcccrgcggctctgctctcacctcccctctccagaggctgcacaggggcaggaagcagggccggctgtgtctagcttgcttcctgcctctgtggtgcaaagctgcctgctgggaccagagagggtgggcactcagagagagcagcacagctggatccaggccacacggccttcagatggcccgactccagctccagcaggccggggtccacgcagcatccagctttgtctgcagctgggttctggtttgcagaaggggaggggggctgcgggttctcccaccttgctgaggcttggcataggtgctgcttctgtctggtttggctacaggacggggagacgaccaggtgggaacacgtcccctyccatttgaggcccagcagccttgcccccacccgcacggccactccagcaagctgctgggacttgttctcagacaggcggctccagctgcctcccctctcytggggctggccctttcctggccctggcagcctccccaagcctaggcagtggctgcctgggtcagcctctacctgkgtggcctargagccaggccaggccaggtgcttgctgagctgacccaaaggctctgcttccgggatgacatcccccagaggaacaggccaggccaaacacagcgtggggggtgcagggggtgcaggggccgcctctccccacagtctcctgctcattggtgtaaaatcactggtgttgtaaaaagcacatcacggctgcataaaatactgctcattgctcggtttccaaycatcactgcgcrtgggtttcagcacaggggctgagtgcagacctcgcttctagcagtttccaaccatcactgcgcatgggtttcagcacaggggctgagtgcagacctcgcttctagcagtttccaaycatcactgcgcgtgggtttcagcacaggggctgagtgcagacctcacttctaccaagcccactttgggcacgacccttgcccmctcagaacaaggatgctgggtctgtgggcaggtctcgtgagctgcggcacgaagctcatctggctgggacatggtggtcagcggcatctcagagkaccgttggggacattcatagcctgccaatgagttagcgaaaacccctctaatcccatcccagagaaaccagggttgacagttgagtgtgttgcccgccatcttctttccgtcatctgtgactatctgtggattttaaaatgtaatcagggcatcccatgcagtctgtacacactgctttattctccgaatgtcgtgactgttcccctgttcctttgaacgttccccgagaaccacttggaacgccctcagctgcgtctccagtgccctgctcatgygtttcacacmgggtccacctctctgctttggaagtggcccygggaggaacttcccttgaacaccgtcctcccagtagatgctgactgttggtctgagagagggtagagctgggccyaccaggtcggaggtrtgtgcggttcatggtcccgggtcactctgtggtgtgttcttctctgtccttccgtatttctgcgcccctcgcttgcccagtgctaccctaggtctcaggcggagtgggagagaagcacaaygytttctaggctggggtccctgcgtgtgggatgggggggaggggaaacacaggggaggtgggacatgagcgtcaactggcrtgcgcgatcgtggggacacaggaaayaggcggcggggaggtgctacacgcataaggaggcccagctgcygggaaacacgccgcgcaccrgccgtggcagttatccatggtgtacctcccagcaccgtcagctcacgtagggccactgggactctcagtcaagcactagtgttttactaaacttaacgatccgttcccagtgctgtgcttctcgtcctctccctcactagcgctcgagagactctggagtgaactctggacatgctgcctgggagcctgctgggtgctggaytggggtcccaggatggaagatgtggctccttccctcgatgggctcagaccccgagtgaggttggggcccaggaagggacctgcagccacagcccagcctgtactggaragaggtcctaggcagggtgaggggtgaccccaggccaacgggttctcatggaaccgagagtcccgcaaagatggccacagagaactgagtgttggcaagaaccagacagggtggggcaaggccccgagtgtctcracctcttggctagaaaaaaagtgtggcccgtgttggggggctctgccctgggactgaccccaggggcctgtggacgagccgggagcccacatcagctgcccctgctctacccactacccaccagcattctccccatccctgtgggccccatcctgacacctcccagyccccgtggcaggaccagggcrgcagatgtccccggtgctgagggcaggcttccatccccacacagccccagccaggagctcgtctctgccgacagccagtggcccagggccccactccttaggaagacagacgaccttagcgcacagatttactgtcacctgggctgagtggccggctctgyggggtcattcccatgctcatgttcttggagtccgtggggtccatcgrggacagactgggggtgagctggggctaaccatcttcacctagagaccctgatgcccagcactgagcgcagccccactggcttctcgtccctctccctccttgtcctcccggcrgctctctggagtggccagtgtgggcctggcggccaggtctgcrtgtgtctggagtggccagtgtgggcctggcggccaggtctgcrtgtgtctggaggacgactgtggccctcaggagcttgaagttgctgggtggccggtgggtccagatcccatgagatgaggccrgggactcgaggagcgtgtggaggacggagcggccaggaatcctgtcctcagtgacctctgcctcctcttgagggccctggggaggtgtgggccaggagagcagaggttctgggcccttagtgtcaatgttacagtttttgctgacctgggaggctgtccctcaaagtggccagggccaygcgctcccaggtggccccagcctgggacacagtgccctccccatttcctggccagcaagacgggtggggatacagccactggccacggccagctccccctgtagggggcctcacaggcaggtgggagatgggagttgagtcagccacagacactgggkggtttgggaccaaagcatccaygttacccaaggctcggtggagctcaggccagaagcctggcttcccatcctgcccggtccytctgcgggtcgcctctctgggcctcagtgtccccacctgtagcacggagtctagcacaatgtctaaaattctttccgggcctttccataagtctgtccagacactctggattctctgaatccagggagaatttcatattctcctaaataatatcttgtgctggcttaaaaatgtgttgatgacatatccctcaacgtgaagaaacgctgggctggagcgtgggcctgagccaggtatttataggcgatcagttgggttccagccaaccagatgcaggcgaggaatgcgtgtgcctgcgcagtcagcggaacctctgggttgaargcagttgtgagggccgatgaggacaagggccagagctgcagacccgggccccgggtgygagagcgggcgcctgccgctgcccaaagaccctcctcrccaccagacgaattgggcgcgattcccagctgagcactgctgctgttgtgcagtgattgttctccgagaggctgggatctgacccaggctgccacgatccctggactgctagaggaggaagcagggtggggagaagttattgtccgctcagcagccagcagaccagctgtccttgctccccaaatatcttgcctcgaggccagcaagattycccgtgggtcagtgctctcccggcgtgtctcccagagctccgctcggccagacacggtgttcccagrgcccctgccgaggacgggccccgccgcgaagcagcatgctgggctgggagcactccgtggggcacggtgatcaagtgattttctctgaaaattaatttcagctcaaaaggaaattgaatctcttttcctgacagcragaagtcctagtcgcggcgctgttaggatttgattagctcaggatggagcagtcctgcacccacacacgttagataactatgacatgccagtcagagaccagctgagttccagccactgcctaaacactcgctttacagaacccgtgcagatttgctgaggcctgagacagatacccgatatcatgggcaggttccctgatgcagcacagagagactggtggccgcaggctggggcaccgtgttccctgtcacgggtcgagctgttgccaygatagtgtgaagggcctgggccccaaggggaagttggagcgagggtgtttgtggagtgggtggtgggaagcttcgacccccacccgggtttgctgcttctgtctggggcaagtgacctcaggcagaactgggtgcagagggctctgagctgggggccttggagacttcaggggcaatcggttccaggttctcatcttgcccttgtaaggaaagaaaaggtgtgagccctcccctcacccattatcaggggcatgggagacagccctgtaacaaaagactggttcacaagagaaaagcacaccagatagatttaatcaragctttatgtgacatgggagccatcagaaagggggacccagagacccagggaagacggttcctatgcttaaggtcggtgaagaatggggagccgtgtggacaggtgttggacggcaggggatgcctgtggggatggactgtggggaggctggcgaggccagctstgcagctcccccttggcctctccgtgcagtgcttctcactcccaggcatgggacaggacccctggagcaarggtcttatgacccacagtcagacaaggtaggcggagaacatctttatggccagctcctccccagaaaagtggggaaggcttgagttgtatttctaggtctcatggctggctttgggggagagggcctctactgtccatgacccatctggggaaagaggaattctggcttctgtgacttgctgcaggggagaaagagggcgggagacaagaggggatgaggaggtcagagagatttgggctgcaccagaggccttctggtcccctttagtcccgagtcctcatgccaggtgccctgcttgggggatcatggtctgaatcctagaacccttgccgcagatgagcctcgagcctgctggccactgtggtggaggctggtgggaatgggtaccagtgctgtgtggcccagggagggaggcctcctgcacctgcccactgaccgacacttgccacctaagtggcytgaatggaatgggacaggcaaggtggggggtcctctcatccttggggaccaatggcatcccacagaactccctccagggcctggaagggtctgacctccagaaccttccaaaaagagagggtcctcaggccaatttggagggagatagccatggtcatagtagtggcgcttgcctaagtgtgggggactcagcgggcctcagcccygccccacatgatctcattccacagagggatcctctctcatcacaacctatagtccaggagtctgagccccagcgaaggccaccagtggcaggcggctctgctggcttcaggaatcattcccctcttgtccaggccaactggctgggaacagcgcctggccactgggaagaygggcaacaggcagccctgtgggtcctgagcccttgcccccagycagggccaagcargaaggggactctgttcccagcagggtccacgctatcacaaaggacccctgccccaaccctttatttgcagagctacatctgataataacagacatgtcactccaggggactgattagttccatgggtggagaggtcccctgtagccccacccttcatgggtttgattccaaagcacctattcctaaacaggaggcagagttcccctcaccttggtcttcctccctctcagcttgacccccacctggccaggtatctgctctggtccgaccctcaagctgcacccaggtgaggtcaggggcccaggattgaaggtgcatcccctacggattctttcaacaagaatcgtgcgtaataagctctgtctgggtctgagaacattgtcgattcacctcactcctctcacccctggaggatgtgggtttccaggctgacagttatgttcgaagctctgtgcttsgaagatactgttctacrgtagattagcatctactagagccacgccaaggggtggtttcagggtttcaggcctctctctctgtcttatgtatttgcgatggagtctcactctgttgcccaggctggagtgcagtggggcgaccttggctcgctacagcctccgcctctcaggttcaaccaattctcctgcctcagcctcccaagtagctgggactaaaggtgcccatcaccacagccagctaatttttgtatttttagtagagatggggtttcgctgtgttggccaggctggtctcaaactcctggcctcragtgatccgcccaactcggcctcccaaagtgctgggattgcaggcgtgagccactgcgcccggactctttctgtgatttccatgcagggattcactggtatttatcctgtttggtacccactgtgctttctgcagtctgactgctcatgaccgaccatcttcacttctggaacattctctgctgttatctgtttaagtaccgcctttccccccggtctctctggtatctccttgaccttctgttggacgcagactgcagcttcctgtccggcccagggccattccctcacattccccgaattcccatctctgtgtctacaccccccggcctcccctggcacctctgttcctgtggtccaggatgtcgagaaagtgccggtcacttagttcctagcctcagtttcccatgaagaaaaggagttggtttgctggctggtttgttaatttaattgtacagttcggtagtgttaagtatgttcacattgttgggaaacaaacctccagaatgtcttcattttgtgaaactgaagctctgtccccattgaggcaattccctttccctctccccagcccctgtgccctccattctgctcttgatgtctatgaatttggtgactccagggacctcatatgagtggaatcagacaggatttgtccttctgtgactggctcccttcacttagcgtgatgtgtttataatgtttttgtccgcgttgtgttatgcatccgaagttccttcctttttaaggctgaataacattccttcatgtggatagaacactttttgtctgttcatcatctgtttttggtgtgtktttttttttttaatttcagacagggtcttagtctgtcacccaggctggagtgcagcggtgcgatctcagctcactgcctcaacctcctggtctcaagtgatcctccccccttcagccttccaagtagctgggactacaggcacatgccaccaaacccagctaattctaaaattttttttgtagagacagggcctccctatgttgcccaggctggtctcagactcctgggctcaagcagtcctcctgccttggcctccccaagtactgggattacaggtgtgagccactatgccctgcttgttcatcctctgctgatggacacttgggttgcatctacctcttggctattgtgaataaccctgtgaatatgagtgtgcaaatacctcttcgaatccctcctttcaattcctttgggtgtatacccagaagtggggttgctggatcacatggaagttgtatttttaaagttttaaagaactgccaccctgttttccacagtgcttgcaccattttccatttccactaacaatacacaagggttccagtttctccacatcctcaccaacactcgttactttctttttcttgtttttataattgtcatcctcatgggcacaaagtgataactcactgtgacttgggtttgcgtgcctctgatgggtagtgacgtggagcatcttttcctgggcctgttggccatttgcatttgcttttgagaattgtcrattcaagtcccttgcctattttttttttttttaaatggagtctcactctgttgcccaggctggagtgcagtggcacaatctcggctcactgcagcctccacctcctkgattcaagtgattctcccacctcagcctcctgagtagctgggactacaggcatgcaccaccatgcccaactaattttttttttaaatatttttaatggaaacagrgtttcactatgttggccagggtggtctcgagctcctgacctcagatggtcctcccaccttggtctcccaaagtgctgggattacaggcatgagccaccacacccggcccctttgcccatttttaatggtggtatttgactttttattgttaagttgtaggagttctttgttctgtctgggtagaaggcccttatcatatgtaagacttgcaaatgttctctcccatcccgtgggttgccttttcactctttgttagcgtccttcgatgcacaaatgtgcttgtgatcaatgtccttccatctgacttttgcttttgtgacctgtgcttttggtgtcctctccaggaaacccttgccatttccaactccccatgccttcttccagaggttgtacagctacagatcttacccttgtgtctttgttccatgtctagttaatttttggacaagatgtaaggtacgcgaccagcttctcgcttctgcatgtggctatcggatcctcccagcaccacttgttggagactctttccccatgagtggcctcagcgcccttgtagagatcatgtgaacacatacgtgacggttcatttgacttcactttctccaactttgctgatttcgtttaatagtttcagcaggcttttttggcatggaattttcaggatgtggaaagggtttaaacaaaacctgacataagacccttcctgctgatcttccataattctgtgactccatccacggccaggagttccatcttgcaatttggggctttcagagcccacctgagtcagagtggccaaggacgacgtgccgggaccatgtgcttggtgcacacgcacccaaccctggccgatgggtcagagcagggcactgaggccaagtgggccgacccccatgggcgctgggagacgctgttcccacccaagcccggctgactgggagcccgtgtttgttctggatgtcctcgcttggcctgtccctttccttgtgggtccccacttggaagaactggggactgatcccactccactgctttggtggagaaaaatgtaagacgcctcaacaactagtgattccgtgaacttagagaggcccctggatttccccagcctccctctctttggcaggaagcaggtgtggcccccgttttgctccttcgttcagggactgtttcttgggccaggctgtgcacggcgtacaatggagacccagacccagctgaccccatcctcgctgagctgctggagccaggaaggatgggactgctccctcccttccacccgtgaactccaaccctctccctgagctgggtgacgggtctttgtctgaacagggatccgcaattggagggccgtgcataggtgcactttaaaaattatttttcctgtttcaaaatgagattggttttgagccccgagctcctccataggctatctaaaattagaaccccgttgacaaggcaatctttgtcaggggcctacggcttgcaccaggraagcagggaaatgtcaacagtatattttctgtgtcaattttgagttttttaggaggcctgggcaaatggcaacttagagcaaatttgcgctatttccaaagcttttagaatccagcccctcggcggccatgtgattaaagtgtcaggtttataaggagctgcccctgtggttgggagagcggcctctgccctccttcccacaggcgtatcccagcgggagctgtacagggagggcctttccactcagagcagtggtggaatcagctcctccgctgtctrggatcctgcagtcagcctagctctccccattccttttgtgagctctctggtcccagggctgagcactcaggccttcccatgggagtcagtgggttcaacggtttgcctgaaggtgaggacgcagactccagttactgggtgtggacgtgccaygcaccygaaccaagtgtgtgaggaaaatcacrcctcctgtgcaagaagccccccaygctgtctgtggcctccacgcagccgagtgctagcctgttgtgcaggygtgcgggacacaccctcccaaagacaccagctgtcctcrgcggagcagggtgtgcctaggccckgctcagtgcctctgggagcctctgtgtccgcctcagcccacagacattaytgaccgtgttcccaccgttgcaagggccgtggagggacgagatgaagcttagcccagagcacccgataatcggcactgtcacttctgcagggcttgrgccatcgtgtctttcacagtcaggtatccacagccccacaggcctttctctcctgcctcccaccatgtccgctgcccaacgctgggcctttgcacctcacctggaaggcccgtctgcgacggcaatctcctggtctgcctgctagcctggtctggcgtcccaggcaggggtcttgctttccggccccttcctcacccagaacatggttgtgctcacggccgagctgagtcctgaagggcagaggctatggctgtcttcagagcccggtgctgggccggggctgaccagaattggtgggtgacgggctcctcggacaacgggcttggcacctggctgtccccttccctgatgcctctatccccacctggtgcagccagggtggtgtcccctgagctgggctgctgccttccccctgctcctcgcagacgtgtctcagagcttctgaaacagataaagctgggctcccaaccccatcttacagacaaggaagggtgagaagcttgccccaggtcactgctgtggactgaatggtgacccccaaaacatatatctayatcctaactcgtcagaacctgtgaatggggccttgtttggaaataggatctttgcaggtgtaattaaggtcaggatctccagatgatattatctagggctagggaaggtcctaartccagtgacaagtgtccttagaagacagagacacaaaggggaggctgtgagggctgaggcagaaatcgcagtggtgcagccacaagccaaggggtgccgggaggtgctcgggaggtgctcgggaggaggctccctcgagagtggaagggtcgtctccggagcctgcagaggaagcgtggctyrcccacatggtgattttggattttgagcctscagaaccgagagagagtttactgttattgttttaagccaccagttgtggtcgtttgttatgacaggtaggaaactaacccagtcctggagaagacctgaggtctgcagatagcaaacctgccatctccccttcccaaaggtraccccctacttctcctcaaagatttccagagcagctggagggagcagctctccttggaagaccccatttcttgatggcaatctggctgggacccagggccagctgataatcctggtgacagtaggagctgccaccaggaagtggtggcctgggcctggacctcagccatcttacatggccacatctaagccatgaccttgtcccccaggtccgagccatgcggctgtcctttgtsggggagctgggctgggagctgcacattccaaaggcgtcctgcgtgcctgtgtaccgggctgtgatggccgcgggtgccaagcacggcctcatcaacgcagggtaccgcgccatygactccctgagcattgagaaaggtgagtgcagggtctggacagcayggggcgggggcgggcgcagtgggggscagtgacgctcgagacacctggaggccgagaagctgtttaccttccctgtgttgtcacccggcttccttctttccacaccatgatttcctcccctacaccccagcgcctgacatcctccatttccccaaaacctcttgctgcccagggtcttcgtgcagggccccagggacagtgttgggatctgcgacacctacacacacctgaactcagagagctgaggtgctgcctgacacctgggggtcaggcccaggctgggttggaattgagggccttggtttctctgagagctgtgaagaatggagccagggagcaggtgctgtggcctctggaagaagcccagaccctgwccagagcaaggatgaaggctcagagcgggctttgggcggttccccagcgtgttgggcacccagcttgggcgtcaggcagctcccctgggtgttgggcamccagcttrggcattgggaagctcccccttcacragcccctccctgacgcccccacctgagggtgcagagggctgcagtgctgatgggcagtctgctcgggggrgcggtcgccccagggaacctyctggagttggggatgcccctgcctcctgcccaggtgactaagcagctctgagagtgtggctaggggctggagggggtgggtttaggcagcatcctcatgcatctcctgaagggcttatccccctcagggtggcaccgaccccatggattcccttcccacaggctaccggcactggcacgcggacctgcggccagacgacagccccctggaggcaggcctggccttcacctgcaagctcaagtcgccggtgcccttcctggggagggaggccctggagcagcagcgggccrcaggcctccgccggcgcctggtgtgcttcaccatggaggagtgagtatccygctgttccacgcccaccyggaagcaactgcctacagccagggcaggcaggcgcttcttggtcccccactcaaagcccctggtaccaacacttcccatgtgccagccrtgctcttccagaacgcacccaacagcccactgcagataaggaaatcgaggccaaagagagaggccatctggccaggtcacatgttgttaaaggcagaaaggcagagagagtttgctctttttttttttttttttttgagacggagtctcactctattgcccaggcyggagtgcagtggcgcratctcggctcactgcaacctccgcctcccaggttcaagtgattctcctgcctcagcctcccaagtagctgggattacaggcgtgcacyaccacacccagctaatttttgtacttttagtagagatggggtttcaccatgttggccaggctggtcttgaactctcctgacctcgtgatctgcctgcctcggcctcccaaagtgctsggattacaagcgtgaggatcccaacatgctgggattcaaaccaggccagtgtaaggttgcgcacctggggcccctcccaggccagcagggcccgtggggaggtagagaaggctccacactcttcccatgcaggtctcaaaagagaaaggtgcagccaagcccaggccacccctctgtggcaggtctaggccgagggccttgggagggtgaacccagggagcctgacctcycagtcactgcaacacgacctcccatcccgttctggttcagtctccccacagccctgtgatagggggagaggggctcggctggggccgtcatccccactcacgaatggagaccacatggtgccaaggagcaggggactcacgcccagtcacacggcagaggtggaaggagagactctgcctgggggcgacctgacctcctgctctccccactgagagtggctttgagcatgctgctggagcccggcgcacgtgatccctgggctactgggagagttkggattccaggaacccgagtcccacttgggttgcagggcagtctgagaagatcaggccctgatcagaggccctcccgtggtgcccacgggggtctgaagcacaggtatccggggaagtgggcggctttgggctctgtggacatggagctgacagccagctgcaaacactgccacttctcccagatttctggagccttcaaaaggagtgtcagagtgacgaggggagggagagggaggacgagggagagggagggtaagggagagggagggtgaagggagagggagagggagggtgaagggagagggagagggaggctgagggagaatgagggtgagggagagggagggtgagggagaatgagggagagggagagggagggtgggggagagggagggagagggagggagagggagggagagggacggtgagtggagccgtgtcgtcgtcatccygtggcttctccctgggtgcctgtcaggctctgtctcttgtgtgacagcctgtccagctccctgaatcagctcagctcctggagagggggccccttgcagacaggtcagcatccatgggtcctttctgcttgcctgaccccgaccttctggccctccatgaagtacctgcagcctgatgtctgggtttaggagggcctcggacggcccctgtgacccagtgcgctctgctcaggggtttcctgtcaggctgcataatagctgccctgcgccgcggctctggactgttgcagttccaggacagrcgcagagaagatgctggcagtggagtcacagagaacagccctgccacactgctctgggactccgggcagttggggcctcagcgtcctcacgtggagaacagaaactagggtgacaccaaagatgtttacgaaacctccttccagcctcgtcctaatctgatggacaggtgggacccaaacrgtgactccaggctgaggatgcaggaggtgccctcaacatcaccccagcccttccattcagggacccctttgcatagctgccgccgtgataacccattgcacagggagaagtctgcagactggcaacaaaatgttaycagttagccctgggtgctggcctttctttgattttagcttacttttttttttttgtcttcctgcttttaatctttaaaacttttacagtgagcattcatgtattacatgtagtaaagtcctttgaataaagtatgtattgtactataaaaaaaatgaacctggccgggcgcagtggctcaagtctgtaatcccagcactttggraggctgaggtgggcagatcacttgaggtcaggagttcgagaccagcctggccaacatgatgaaaccccrtctctattraaaatacaaaattagccgggcatggtggtgggtkcctgtaatcccagctactccrgaggctgaggcaggagaatcgtttgaacctgggaggcggaggttgtagtgagtctagattgtgccactgcaccaaaaaaaaaaaaaaaaaaaamcagagttgaacaacaatggaaggaaatcggaagcaggggccctcccaaatatacggggctcgcttctggaaacagcaaagtccactcctggttttgatgttttctattcatcccttttactcactcgaagccygagccctgctgtccaggccaggtgctgggctggctctggggaccagcgwagtcctagtaggccagccctatctgcstggagccacggttgggtgtgcatcatgcagccccccattctcctccaggccgctgtggacgcgtccccaccctgcggtttctggggccccagctttctctactgcttcttccagcaaagtacccatgtttggcctggaggccatctggaggaacggccaagtggtgggccatgtccggagggctgactttgggttcgccatcgacaagaccatcgcctacggttacatccatgaccccagcggtgggccggtgagtccccttctctgsccctgctaaggcagatgccgatccctcaccagctccaaaccagctccctgcactgcaccctgagtgtgccgggcatagggaggaggcacgggtgtggtccagaagaggaggagggaagagaaaggagggaggagggaagagggggaggaaggaaggaggagaaggagggggaaggaaaaaggggagagaggaagsaggaggwggagggagagggaggagggagggagaaggagaagggggaggaagaggcctcagcaggtggaggactccccagctgtgcctgggcagagccaaagctgctctctgttttctttctggaagaatccgactttggtgattccaggctttttttggttagaaggaggtgccagccagccaggctgataccttccagctcctcacaccagagacccaaacctcaggccacccacagcccaccctttgcctggggtgcaggggtggcccccagggtgaccgactagagactcagagacccatgttcctatcctctctttcctcacccccgacacccctgaccccaggcaaccccmccccctccaggtgaccctgacccctggctgcaggaggcaggaacaggctggaaagagcaggcactgcccccaggagcaagtcccaggacagctctgggtggccaggggtggtggggcagggggtgggcagcctccccagaaggggaaggggtggtctctacctccacctccttttcccatctttctggcactgcaagtagaggtgccggtgaggagggtcgtgtctctccatgggagccgatctgacgtttggcctaagccctaagtgaggccgggaggtgctggcctggctccagagccttccagcctgagcccctgatggacacgtagagggaattggggagggagcgagcacttgggagaagccatgaggaggggtaggctggagacggagcagccttagcaagagctgcagaacatgcgcaggcccagctcgcaggcccaatggggaggggacaccgccaggcctcgggcaagaccatggtcctgtggagctgtggggaagtggcagcccatggggctgagtccggcggtggagctgggaggctggggacacacttgatgccactagcctttggatctgccttttacttgctttgtgaccttggataaggatcctctcttggagcctcagtttcctcatttataaaatgtggacactcacctaccatgcagggctgtcatacaggccactgcacaragtgagtcttaatatgtggggattgtgatgrcatggctcccacggtgggcagggcctcctgacacagccctggggccatggtcctgggggccacagccctggggcccagccaaaccggagtttatgggctccatgccagggtgggctggggagtggaggctcctttgccatttcttcaaagaacagtaatgctcgcctttctccggagtcagggatgggtccataaccaacgtgaccagggaagccgaggttccgaggttaaacggcatccagacaggcagccsgggaaccagtcgatgcacccagagcggccggtgcacgtctcctgccccctccatcagggctgtccagagcatttgcaccatggaaatgggcaaatgctacagtcacacccacctcaccccagagctggttgttaaacattttctagcacccaagtggggtaacggaggtttctkcctaagatagggaaacctgctcattgatgggaaaggctccgagatggggaaggcgtttctgcctcgtaggtatctgttagcaaggccagatgcccgctttgagttgtgcmtgcccgtggacatctgaaggccaccagctctccatgctgcctgcctgcggggggcagctcagagctctcagccctrcaggtgcacacatggctcagaagcaccactcctaaagctcctgtcgcagaaaaagcttggtttgttttttatttttttcatccagtcctgagctgctaggaacaagaaggagccctctgactcccagagcrgagcccgagactccctcctgtggccctgaccttgggtttaattgctstaaaggaagaacagcttccctgagtggcctagcctgccctcctcatagcagctgcagcaaaagtgccaggcgtcaccagcwgtgccaggctggaggtgacaccctcctcctgcctaagagcacctgcacctggggctgactggctcccgagsrcttgctggggagcccgagccagggtgtgggatggggagcatgcagaggccaagctgtctagaaggctgttccagccgcccctgccccgagggattcgagccggattggcccccagcctcggcgctgctctggccgctgtgcttgcccgggtccggggaagccaccgtgttgctgctgtttcccaggcatctggaattgctgggrtgggaggtgtgttgtccggtggaagtcatattggytgccagaccttggctttgccggaccccagatgcccatgtccaactcaagatcacatggacacgaactgcacctgctctggggcaatgcctgggttcagaaaggagtccctggcacagggatgagtttgcccacagggcaggtagcaagaccaagaccccctcctccagagaarcaggcagacgtgagccctgtacctaccaacagagagtgatcctcatccccacctctgctcctaggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctaraaggtgcttagtaaatacttgataagccccacgtgaaaacagcgaagcaaataggcttcatcttttactccaggcttgactgatcggtggcgggcytccctggggcacttggctgaagagcatgaggctgtgtctgggtcaggaaagagaggtgatcgactggcattgtctgccacagcgcacatggaggcctgggaccaaggccattcttcaggatggtgcctctcggctctcaggtcggaacaggagctggaaagctcttcttaccttgctsgacctccctgttcttcaggtggcaaagcctcctgagagtcggcagcccgggaacacagaggagccgaagcagggagcgggcggggcctcagattggtgycctcctcayccacacagaagtgccagctcctgcctcagtttccccttgagcccctcgctcaccaggcccaggcaggagggacgtgctgctgggtaagagtctggtggagtccccctttctaggtgacctttgtctttgctgttgatttggacgcggttcctgcccatgccctcctccttgtctggcccttgcaggaggaccctctcttaggctctgccctgcacgctgccttgagatggggtggctcctctgcccaccttctcttccccctgataactgcctgtgtgtcagaagcagctctgcctctcctgcctgggaggggtgtgcatctctgtccatcccacgtgctcagtcccctcccttgtccccccgagcccaggttcagatcaggcccgtcagagcggcactgcgcagtcttgccaggcatgccctgcaatctgggaagagcgggaggcagatgcttgagggtatcgtggagccggggccccacagagccacacacacagcaaacagcgatctgggggcagcagtcctggcaggccccagctgccactggacgctcccaggccacgcggcccactgtggactgagctcgaacaaagctgtgggcagacgtttgggttacagatggctgtgaaaagtgggtttggccccctgagtctggggagggggctgcggctggagacmagggtgggggctgttggctttcacacgcttcaggctgaaggaacacctgcagcctcmccttgctcacaggcgggcctggcttctggatgagacagctttgtgggagccaggggaggagaggaggggagccggctccccagatggcctggcctgcttcctccgggtctgcggtttggccatagacccctggattgggccggtgaccacattcatctcacggcccatccctgggggaaggctgagratgaggggaggtcagagcccgggttccgctccaaattgtttctcgtggctgcagctggggaatgcacgcaacrgcaccaccctgtcccgaggagagagmacctggctgcgctccctgtcccgaggagagagaacccagcacccctccctgtcccctgtgtgcttcccccgcccctgtggagagagaacctkgcccctcggggagggcactgggcattgatgtgagcgcagcctccacaactcacctcccaagctcatcacctgcgggctccatccctgcgctgccagaggtcctggccccgccatggctcccaagtgcaccgcccggggaccacatcacaaaagacccaccttcccagaccccgagccaggtcttccagacctcaactttaaaaacaccgtttcgtagctatttttaaattttttttctggaaatattgataccatgacgctcactgtggctgagtactgcctctcaggaattctgagcaaactgttttgaaagtgcctacactggccgggcgcagtgactgacgcctgtaatcccagcactttgggaggccgaggggggcggatcacctgaggttgggagtttgagaccagcctgaccaatatggtgaagtctcatctctactaaaaacacaaaattagctgggcgtggtggcacacgcctgtaatcccagatacttgggaggctgaggtgggagaattgcttgaacccaggaagcggaggttgtggtgagccgagattatgccattgcactccagcctgggcaacaagagggaaactctgtctcaaaaacaamaaaaaaaagaaagtgcctacatcgtcaccggcagagcgctataccacagtgtgcagtgagacagccttgggccatgtgaaaagttgggggtatgaatgggacgcagaaaggttccattttgtttttttttgttgttgttkttttttttttgagacagggttttactctgttgcccaagctggagtacagtggtgtgatctcagctcactacaacctccacctcccaggtcaagcaattctcccacctcagcctcccaaatagctaggattacaaacgcgcaccaccacagcctggctaatttttgtatttttagtagagacggggtttcaccatattggccaggctggtctcgaactaccgacctcaggtgatccgcccgcctcagtctcccaaaatgctgggattacaggcgtgagccaccgcgcccagccctaattattgtattttttgtagagacaggatttcactatgttgcccaggctggtcttgaactcctgggctcaagtgatcctcgcatctcagcctcccaaagtgctgggattacaggcatgagccacagcacccgaccttgtatcattttaattaatttaaaattaatcgtaagtagccacatgaggctagcrgccaccagaaagcacagccctggtgtgctctgggacccagtcgggcaggcacccctatgctggctggagcctggggtcgccccacttctctcaacactgatgggcatgagcattcctcaccccagggctctgagcacctcacagatggggggttgtgccaccctagcagtccctgccccctgggaggctggggaaccctctcctcggtgggcagatagggagacccaagcctagggaaggaaagtaactaactcagggtcacacagcaggggcaggaatagcaacctgggctgctggactcacaccccaatcattcggaaggtgggcgagcccrragtccctttggcttggggcatgtaggtcattttcaggtaacaaagcacttcccctaagcctctaaataaggaacttattttagataaaatcccccacaagggtcctggggaaattcctgtttcctaagtaagcagaggttgagcattcagacactggagtcagacctggggacacttcgagctccccggcttactctgggtgaccttggcacctaactttaggtctctgagcctcagtttcctcctccatcaatggaaacagaaactacatggcttcacgagattgccacrgctgtgcatagcctcagtgtggggcaagtggcaactctcagcaaccacggggttaygcttatctgggtgtaggaggtgcgggtactgctggagcgkggtaggggggacacggctgctgtctctgcaagaggaagaggataaccagcctgagagcragagtgtgagtggggggtgaggtgggggtggggttgtcgctgtggcaggttccagagctggctaggattcccaatcactgccgctcttgggcmccaggtgaggtacttatctgggagtctyagtttccctgcccgagatyggcaggctacaagtgccccccaggygtttgggcaggaccctgggacccttctctgggctggcaattgggtgtgatcgcgggaagaggcttcttgggcctgctccgtgtctactgtcacctaggctgtaaagatgacagagggccggagyggctctccaggctggggcctggcatttcacagcgctagcgccgtgacttatggaccacaagaagctgtgatttatacaacgtgaggcagagctsctgggctcgtgasttcccttctgtgatgaagtgaagtgccttgcagmagcagcagccgcttagctgatgcgaggggactccgaggcccatccatctccctctctccccatgaggctgggcagcgttttgctgaagtggctgaacacaagtgcatctgttactgtctccagaaaccatcaaagagctgaacttgtccctgagaggcagctcagagggcaggmaggggagacccacccaggccagctgaggcagcttcaggacgctcagggggaagcacttggtaccacgcctggcacagggaggaggctcaggagcaagsttctctctcctggagcgacggcccggagtgcaaacatacccacctccagtgggtgccagcccaagtgtgagctttattggctcattagcccgcacggcatcagcctggttttacagatgagaaaagtgagggtcaggaatgtgaaatggcccgcccaaggcacactccctaagtggcagaaccacgcggaaagcacagccctgactccaccccggtctgttcagcgctggccccaccggcagagaagcaagctggtgctaataattccaccccacgtggaaccggcgcccagaagccccgctggatctttgccgcctcgtcttttggtgatagttgttgtcagggcttccctttaggtgggcgaaaatatctgtttactcaggaatggagcaatttcccaggcgagtctctaactagctaaatgcctggtcctgcctccgtcgcagggaagccgcccactgtgaaacacgagccactcagcagggaaatgtttaagcggcacccgcacccgctgcacaccgggagcagcggggcgggggcgggggygttcccggtgattccacaccccggcccagcatggtgcctgtcccagaagccaggccacacccagtgaggcggaacagggctggcggagggctggaccctggaccactgtgcrggctgtccctgcactgagtcagccgggtttaaatggacgaggtcgtggtccactcggtccagggtaggtcaacagggcacccacaccctctcagccatgcaggggaccctgggggaagaaggctggattggaccgtggtctcaggcaggggcgtggtctggccccttcatcctgggcrtgcagkgctgttccatggggatcgtcgcagagtagagtgcacagtgccggtgtgagcccacagggacagcatggaggagggggaggagtaggtcccccctcagcctttgcccccaccaatgctgacaacggtggggccagcagggcttcggccctggctggtgggrcactgtggggtgggctcttccagtgtggagatgaccttgggcaggggctgcarrttccattcaccctgcaaggaagggggcaggaggtaaactgaggctggargggcaagatgggtggctgcttccccagccacttcccagccacctcttggattcttgccctcaaactcagcttgtctcaaactgaactcactctgctcccccaagttgctttttgggggtcctcacctcagtaaatgccccctcccctggcttcccattcacctagtcaggaacctgggagtcatccaggcctctccccgcctctgtccccacccaatttaatcattcaccctartgtagcaaccagagcccctkgctgcaggctctgatattttttagctatctcttcccctcaaggctacaccaaatgccaagttttcaaccccatcagacgtccaccccacactattctcagcaagccagtattagcccttccttcccttggtgctgaggatgtttgacttagcagttaatcyggctcccaaatgcttctgggaaggatcttcctggatctccaggctgcggcaccttaygcgactaactctgcataggccctggsctcctgaccacagcccagtgggcccaggataaattagatgccttcgaataccagtgggtctcagataaggaggaaaaaaccagctcgcagcttcagactggttcgtttcttaccttcccctcccctrgtgctttatttttaggcaggttagtgcgccctgctcacaccacctgcatttggcattyggtacagtgtggaggtgtcaccagagagggtgcctgccctcccttccttgcctcgttattggttctctctctctccctctctctctctctctctctctcctctctctctcctctctccctctccctctctccctctccctctctcctctctctcctctctctcctctctctcctctctcctctctctctgctggctggctggctgtctaggcctatgtgtcaccacctggcacttgctctcattgtcttgtgcgagtgcttttgccagcagtttggagtgcagrcccatcacccctcactggggccccccatgaggcctgcctgactgcatgccccacccgggcccatggcagcgcacctggaagcggacggctgaggacttgttgcagtgcatggagatgggcgcgaagctgyacagggccttcagtacgtcgcrgttgaaggagttcsagggaacagaggtgaactgctgagacacggacgcctgagggcaggtgcagacatcctcgttgttgaacctggtggggacaaggaacagccaggctggggagcagctgacgggcagggagcccagt

SEQ ID NO: 13384 - DNA, 12726 bp, Homo sapiens
  misc_feature (1)...(12726): n = A,T,C or G, or insertion/deletion polymorphism (see Tables 1-2)
actcaactccatagacagggcttacacaccggaccaaattgaggactagctaaaacagggatagggtgggtgcacctttccatgagctgtgtccgccagtgtgtcatgtcagtttacaatttccatggcaacacctagaagttactgcccctttccatgacaatgacccaacaacctggaagttaccaccctttttctagaaatttctgcataatccaccacttaatttgcatataattaaaaatgggtgtaaatgtgatggcagaactgcctcggaattgccactgtgggtactctgcatgtggggtagccctgttttgcaaggagcagcacctctgctcctgttgtayactgtcccttcaataaaagttgctaacaccaccaccttgcccttgaattctttcctgggcaaagccaagaaccctgttggcctaagcygcarttctggggttcgcctgccctgcatcaccagcacagtggaaggccacaagctcacagcattttcatccgtaaacaaagcttggcaatatctctgatggttaagagcttacgtgtttgcgccagtgagacttgcactcagtcttctttgagtgagacttgaactcgattctgagtctcctccttcctagatggactcattatttacttatttatgtattcactcatctattcattaatttatactcttagtttgatatcaacatctgtaaaatggggatggtaatgtggtgatatggaggaaaataaaataactctggcattgttcttactatttacctctgtactgtcatcgttatcattcctttgataaccgtgagcacctgtcatgggcctggcactctagtaggctctcaggatgcacaatgaccctgtccctgcttgctggagacatargagaagcccccagccactgacatctgggtgttgtaagaaagcaagaacagtcatggacactgctaagttttgatgccaaagagccaaatttgcagtaccagaatgtcctttccatgtgtgacccaaagttttggctactgaagacgttgcatgccctmcaacagtggaagtggtgccctgaatacgccagaaataatcgtggagtcaacgaagatctgggagtattgtttggagacatctcagtattsctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgaratataatgacaaccttsstgaaagcaagaccacagggcctrtcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctacttcctcccttacatcaccttctcctctggctttgtgtcctttctgtctcttacaaggacaccagtcrttggacttaggacccacctaattgagtatgatctcatctcattccttatcttaattacatttgcaaagaccctgtttccaaataaagtcacattcgttggttctgagtgaacatgtttctagggggacactattgaacccactgcactgcatcaaacgtatgggtgtgctttctcttggcctttctcctatttgccttctctgtgttgggaattgtggcttcacacccatctacttatccctgcatgttgagcatcgtctgttacctgaagagcagaaggatgataaaagtgaggaaactgaggcacaggcttgccccaggttacacagctagttatgatggaggstgggtcggaagccaagcgccccccagcccccaccccacaacaggtgtatgtggcctctggtttatccttctttccccctgctcaccacatggcttctcattttgaaaacccrgtggctaataaagtagatgagtttcaggattgcaaaatattgtgatcctggcctttgtccattgtgtaatcttcacagtgaccagagtgtttgcagttcctasgaagttcacccattcccaacagtgtcccagggtcaagctcagatgacctgtggtatttttatacccatatatgtgtcaatgtttataacttttaaagttgttttcaggaagcactgaggcatgtggtcrttcacaggtgacaaagacagaggctcagggaactcagttggttgctgagctttaaacccaagtctatttctgaggctggactgagtctttgagaaaatgcaaagtaacctagcatagtgtcagacacaaaatagtcagcaaataccatcgtagattcaggcttctgagtccaaagctaacaattctcatctccaattcccatcttcaaatattaaaataaactttttttttaagagacagaatctcactgtgttgctcaggctagagtgctgtggcatcttagctcacagcagcctcgacctaccaggctcaagcgatccttctgcctcagtctcctgagtaggtaggactataggcatgcaccaccatgcccagctatttttaaaatttcctgtagagatggggtctcagtgcattggccagactgacctaaactcctggctacaagtgatcctcttgccttggcctcccaaagtgctgggattacaggtgtgagccaccatgcccagccttaaataaactcttyagtgtcaaaaaatctacgtgaggccaggtgtggtggcttacccctgtaatcacagcactttaggaggccaaggtgggtgggtcatctgaggtcaggagttcaagcccagcctggctgacatgacgaaacgccatctctactaaaaacacaaaaattagccaggtgtggtggcatgtgcctgtaatcttagctactcaagaggctgaggcaggagaatggcttgaacccaggaggcaggggttgcagtcagctgagactgcgccagtgtactccagcctgagagacagagcgagactctgtctcaaagaaaaacaaaaacaaaaacaaacaaaaatctacttgaaccaataaaaattcccatccccacctagaattctaaatattttataaataaagtcttcagagcctagatattcactagaacccagtggtcacgtgttcctaatgggtggaatattattttgaatctttccatgatgagagttacattgmtgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaasaagagtcatttgtaaattagggaggaagagctaaaaaagattcctagcaagaaacatcataaaggggcttgataaagccaaaaaactraaagaaaaaaaaaaaggaattagaaacagagaaaagaggcttcgtgttgtttgtaaatttgtgaataaatctgttaaagaaatattggattcatattcaacttggaaaacagggaaaggccttttattgcatgcttwgaagtttgaatacactttcagtagctcttcgttatctcaaattaaatcttaaattgagcttgtggttctgtgaattaatactccrgcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggyaggtgcttcctaaagcagaaaaatgtaagggaagtcatcatcgcttatcatcacctgaatgttcaccatggtgacccacatctcaggatgctgcaaaacgagagaggtcacctgtctgtgtaatcgcatatagcattctaaagatgttccattcattcagcaaatgtttaataaaggcttcatctgaagtttaatggacattgtttgataaaacagacccagtcactggtgtcagggagtttatataaaagtatacacgtatctgtgcaaatgtgtgcatttaaggcccgccgagcmtgagctgatatgcatgtcttaactttgctgtttctctaaggggatggaaggattggctaccctgagctttctagacttgttattttttttttttttaagacagaatcttgttctgtctccgagctagagtacaatggtatgatcatagctcactacaacctccaatgcctgggtttaagtgatcctgccacctcagcctcccaagtagctaggactrcaggcgagagccaccatactgggctaatttttgttttttattgagatggggtcttcctatgttgcccagcctggtctcaaacttctggcctcaaagcaatcctcctgccttgatagacgtgttcattgtaggtttctagcctctgaatccaaattttatttttctagtactttattttattttactttttattgattgaaaccttgaaataaagtttttaaaaatctatttgattttaaacgatctttagaaatatatgaaggttaaaaataactctcattttgctttttataaacagtccactcctacatgtagacacatttagatgcttcattttgcctgtagaaagtttttctaacaataaactgaccaatgatgatgaaatttttattgactcaaatgtgtgattggttgatttactgtattcagtccaagctcctcccaaaggttagctcattgactctacaactctgttttcctcattcattcattcctctaatcaatatgtattgctcacttggtacatgtcagatactttcctaggtgytggggagaaacaagcaaagtacttcagggcctgtattagtttgtttttcacgctgctgataaagacacacccgagactgggaagaaaaagaggtttaattggacttacagttcygcacggctggggaggcctcagaatcatggcaggaggtgaaaggcacttcttacacggcagcggcaagagaaaatgaggaagaagcgmacgtgagaacccctggtaaacccatcagatcttgtgacacttattcactatcacgaggatagcgcaggaaagaccggcccacrtgattgagttacctcgccctgggtccctcccacaacatgtgggaattctgggagatayaattcaagttgagatttgggtggagacacacccaaagcatatcagggtcctaggcaactttgtgtgagaacagaacagagaggaagcgacacacctttcctttgggagcaatttttgggttgcttttgtttttatttgttgttttcattcctggtagtaatagtaacagtagaaaatggcagcgttatagcyataaacaaagtgctctgtggtttctctctcaccatcccctaaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatmtaagagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatktgscttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccrcctgctatgccccagccagtccccatagcataacgggctgtccttggcagttgtattcggagtctggatgttgctttgtaaagacatttaataaaatattgtacaaagacaaccgggaatgcctgtaatcccagcactgtgggagtcaagacaggccgatcacttgaggtcaagagttcaagaccagtctggccaacatggtgaaaccctgtctctactaaaaatacaaagattagcctggcgtgccctgtaatcacagctacttgggaggctgaggcaggwgaatcgcttgaacccgggaggtggaggttgcagtgagccaagatcgtgccattgcactccagcctgggcaaaaagagtaaaactcagtctcaaaacaacagcaacagaaatgtattctctcacagttctggaggccagacattcagaatcaaggcagggctatacttactttggaggctctagctaagaatctgttccttgcatctttcgtttctggtggctgctcgtgattgtgggctgtgaccatatcactccaatccctgcctctgcagccacatggccttctcctcttctcctgtgttcctttcctgtctgcctcaaatctccctctacctttctgctatgwagacacttgtttttggatttagggtcttcctggctgatctcatstcaagatccgtaacttaattacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttmcttagctgtcctctgcctccatctccctttcyctgtaagtggaagtggtattcattgatcacacactacatgccggacwccaagctattacattttttgaatatgtttcttcyttgcctcttgaggactaaccagccgggtttagattatttcctccccgtgtcgctttcctgcccccacatgttawagatggtgcamgggaaccagagagctttgatccctggtttctctggtcacaaacctgctctcctctccagaactccaggmtgcctttctgtgggggctaaatcaaatttagctgttcccccaactgcaaagtacataggcatcaagtgaaagggtaaatgcatgaaaacctgaatggctgatcctctaagacagkgagagcagatgttaattgctcactgtccaagtgctgggctctgtgataagagcttcacgcagatgacatcaaagcaccatgtgtgggggaagcacgatgatcttgaccattttacagatgaggaaggtaaggctcggtgtcatcaactcacagaggaagtggagctggagtctctgtggctccagggtcaggtgtgtagtctcgaaggctgttttctgttctgcaagtttctccttaacacatttccarccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccscatctctactaaaaataaaaawaaaaaaaaattagccaggcatggtggtgcatgtctgttatcccagctacttgggaggctaaggcaggagaatcacttgaayctgggaggcagcggttgcagtgagccgagatggcgccactgcactctagcctgggcggcaagcaagacaccatttcagagaaaaacaacaacaacaaaacatatggccagcagccagtgttgttatytcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccctggtgtgtctattagctcctcaggctgtgaggccttaatgacacccctgccaacattacaggaggcagcaagtgacagtaggaatgagagaggccagctaatctaatctgtacgccccacaggagttgggggctgaggacttcaagacctggcttctgctccctgtcacagtggcaaagacaatgacaataaaagcacagcctccagagagaagagccttcgatggacctgggtgttaawccaggggccaggcaaaaactgggggatgcagaataggaggttgggctggaggtgagtgagaagaacggatacggttaggaccaacatttaggcaatatgaccgtgtacaggattctaccaccatcgtcaccatcagtgttactgttccctgccatctgcctrtggggtgtctaccatctaaagtycagcactgcactgggcatttttaaattatcattagtatataattatatataataataatttaatttataactatatcatttattaaggtcctactatataccaaattctatyggacacatgtcctaataataaacgtgatatmatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgtagttttcccccttttagagataaggtaatcaaaacttatagaggttaaagggacttgccaaagcgacacagccatgaatggcaaagctaggatttaaacccttggacttcttctccttgccattccaccccatcataaattctaaacatcataagcagaaccatcataagtcagggtccatctggaagatggatggatggatggatggatggatggatggatggagagagagagagacagataggcagacagatagctagacagatggacagatagagatttttaggaactggcgaattggctcacacaattatggaagcccagaagtcccaagaagtgtagccagcaatctggagatccagaagggcccatggtagaaacctcatccaaaggcagaagacaagcatcccaggttgaagacagtcaggcaaagagagaaaattatttcttactcagacttttgttttattcgggccttcaacagattagatgagatccacccctacagggcagggcaatcagttttactcagtctactgattcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcntccccaacctaaggaaactgagacccagagrttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacrtatacattcagcagaggaaaaatgatgtgaggtctggggcttgctttaaaatactttggggccagacacagtggctcacacctgtaagcccagtgctttgggagtctgaagtggtaggatcactagaggtcaggagttcaagaccagcctgggtaacatagtaacatagggagaccctcatctctataaaaaatttacatgaaaaaaaataaacaaaatacttctgcaacagcagcagcaagagctgccgcaatgaaagaagaaagaaaaggagggasaggatgaaggaaagaagcagtrttaacattctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttykctcactggtttctatggctctcccctcccccactttttctaagaagtggtagtacctatctgactattttcttggctgcctgaagaggcctcaaaattagagtaaacaaattacccattaccagggaagcctccttcctcccagcagattcccagcatcttctttcacctctaggagatattttccaaggtcactaaattaagccttcagasaatcgaaaaattgaatctcagtacctctattttcctaacaaaatttctgcagcaccgattggggctgacaggtacggccgtgcagctttctgggctgttcaggtcgatttggccaagcaggacggcatcagcttgtattggagggaacatctgagcagctcagggcyccctgggagtcagagcgttccctmcctccttgccactgtaaatgactatttctgtcgtttgcagagtgtccttttctttctcctacagccccatcctyaccctctatagccatcaggtcaggtgcgtcttcttcatttatttatcaaaagggccatagcaatcattgcaaacatgtttaggaggatttggaaaccatgttcttttaaagggcactaatgatgcagcagtaatcacagtgctagtggaaggggagggcagaatgtgatgttttgggagtgaattctgtaagagaagaagggactgcgttcctagccctccagagcttgcagctatcacagcctggctggtggaggggcttgcagagctgagaaccactcagaatttgggggctgaagaccctggctgtctgagcaccatctctgtgactttcgaggtcatgttttccctccagccctcatttccccctttataagctgtgtcttagctagtgctttcagcaaagaatatctttaggctcctggaggattgatatcccctgaagtagcccctgaccagcctccaagatgtatcctaaaagctcctatggaagtttacatttcactcaaaatatctgtgttcatgtaaatgtaaaaatgatgtcttaagatgcttagcagtgaataaaatgggtgctctagggagatgcagtgagtttatcctgtggctttgagtatacactggtaccctacgtgggagaccccggtgcccatgcccgggtgcacaaagccagcatcagtgacctgcacaccaggaggcaggctgcatgatgattgggtgcaagtccttaggtgggtcactcagtctttsttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttrctgagcatctatctgtagcactgcatgtcaagccaagctagagtacagtctcttaggagacayaggggaggaaaacatccttggcaggttcgcatattggtgatctcgtcgtaattttctcaaatacccttcctctttcctcacttttggtgataactacctgtgttgctcttgtcacttttgcctggatccactaactcaccacctaggtatctgcaaca

SEQ ID NO: 13385 - DNA, 18138 bp, Homo sapiens
cattaaataattaagtcagttgaggtggctcacacctgtaattccagcactttgggaggttgaggcaggaggatcgcttaagctcaggagttcaagaccagcctgagcaacatagcaagacctggtgtcatgtctacaaaaataaaaattaaaaaatttattttttgtgtgtggtggccatgtgcctatagtcccagctacctgggaggctgaggtgagaggatcacttgagcccaggagagtgaggctgcagtgagctatgattgcaccactgcactccagcctgggcaacagagcaagaccctgtctcaaaaaaaaaaaaaaaaaaaaaaagcaagagaacaaaatccacagcagtgagcattgtattgtatatgtaacttagtacacaggcaggtattcacctgtgataagatgcctacagaaggatctgccgggcccccaagcatgtgagttttccctgctggtggggcaagtgcctgagtcctaacccggccagcacgggctttcccagtctactcagttttcrccaggagcctgtacacgtgctgattcctggcaaagctgaatgtctatctccacgtgtctgttggccagcatgtggataacctatggtgccctcgcccatcttcccccgggccgatcttccagctatgttgggggctccctgcacacttgagacgccactccttggctatacatgctggacccttcggctcccaggatgtcccttgtctccactggttttgtcctgtctttggtctgtactggcatcccaaagctgagccttgagagaccagctgatggggctgcagacgcggtggggcagagcccagcctgccaccgtaggagggagtagtagtggctcctggtgcaggtgccagtcttaaaggccaggtgagctttggtctggtctggccaggcagtggaaggacagaacctgcatgargtggggcaagtgttgggacaccmccaggctctcacccrgtcctagccactccgcatgctggccttgccagtcttgccacatgaaacaccttccctctgacacccaaaatccacctgacccatgtcacagataagtgactggtgctcagcccagtcccaccactggtgggtggctgattaggsgggatccagcatgtctggtgccagcccctccctgaggaagctgcctgccctcctgcctgcacctgtggtgccttcctggccgcggccacctgtcccatcccagttgcgcagatggcaggctccgcaggcctggctgggtggcaggggctcaggtcagagaggatctcagtgtagtcagcaaatgaagccctctcctccagccccctccccaccatccaccccttcctattctcagcagatggccttgaaaatagaagccaccagagcagatgtctccgagcacctttacctgtgccctcctctgtgtctgtgcccaacatgctgcycccccccaagaagaactgcccatgtcgccagcccagggtacccctcacgtgtggcaggccccactccagccggcctcctccaggttatcagctggcctgcatcgtcagcgtttttgcccatcagcgcactgcacacataatggacacacaggacacacaaatgcaggctgcagcatgctgcccacgcacacgcatgcacacacagcgtgccgcccatgatgcacagatgcatgtgtgggcctacccacgtgtctgagtgcacatacatgcatgtgcacgtgtgttatctccaccgtttcattctttaagcctgccccttcctctcctgtcctcacagctctatcccgctccccgcttgctcctgaactctctccaaacaggtttctcccctaaccccatgacattctgtaaagggcactgtgacctatggaccgagttttgctcttgttgcccgggctggaatgcaatggcgcgatctcagtttaccgcaacctcccgcctcctgggttcaagcgattctcctgcctcagcctaccgagtagctgggattacaggcatgcaccaccaggcctaattttgtgtttttagtagcgacagggtttyaccatgttggtcaggctggtcttgaactcctgacctcaggtgatctgtccgcctyggactcccaaagttctgggattacaggtgtgagccaccacatctgaatctgtcccagccgaccgctcccttatttttgggacaccttggcttcgggaagccctgtgccttcttggccccaagaccctctcccacctcctttcctggaagccccggctggggcctcgggcctctcacctcccatccctggtgcctcacactccaagcgccctctttatactcatgaccccatctccagggccatggacacctcttggctctgccatcttccaggtgctcagctttcccctaatacccgggaggcctcctagattctcctcttctgctcacaccctcacctataggtcaggggcctggcaggaggcrgcacttctctccagggaccsctggtgccctccgcctgctccagcacagttggcttcagtggctgcggcctctccgtctccctgcagtgcatactcaactagagttgtcgagaaaacctaagccggccataccacccctccgagggcccttcccactccccagcgtcctcacacactttccrgggcctctgtgcttgcagccccagcctccccctactgcctgtggctccctgcctgggcacacacagacccctgccctggtgggacaagccctcccagaggaagaggagtgtgcctgggtcaggtcccagcaggagcatgatggggtcaaaggtcaactcctatcccaagatggcaagacccccctccgccctccacctggggcttcctaggtgtttggaagtcatgctctgcccattcccctgccccagccaccctccccgcagcccatcctccctccctgaggaacctgccccttcacagctgttcacacrtccctgggcagcctctagtgcagcagcgatgccatgaaaccaccgtggagggcaccatcagccttggcactgctgccttaggaggtgcagcatgtccacactcatgcccacaggggacagctttcatcagaagacactgcagcagagatggcggctgcaacccaaagcagggggttcccctggggctggatctaaaagtgacctcaggagaaaaaggcaagaggctgaggtgaggcagtgctgtggagccccatggcagggagtgttactatgtctgctgccacttgcacttacagtgggaaagacgcacgcggactcacactgaggctggctggggagggaggggacaggcacgcagggcttccgatctgccgtgtgttgctccttcaactgggtcccgggctcccaggcatcatgatgctctttgtatgtgtgtctaaaataattcactagtgaaaccacttcccaacccctccacttgggcctcaggggaaaatccaggatccttgccgggcattccaggccccatgggacctggccagtcaggtggcctctgcagcctttgtgtcacactccagaccttggcccctgctttgccctctgccagaaatgcctctttctgcccatctggactttgtggctatgtccatgtccacaggaagcttctaggcagcagagaaacagggtcagacttggcttttagaaaaaggtctctggggcaggcagatcacttgaggccaagagttcgagaccagcctggccaacatggcaaaaccccgtctctactaaaaatacaaaaactagctgtgagtgctggtgcatgcctgtaattgcagctacttgggaggctgcagcatgacaattgcttgaacctgggaagtggaggttgcagggagctgagattgcaccactgcactccagtctgggtgacagaatgagactttgtcttgggaaaaaaaaaaaccctctgggatccccagtgaggagggcaggtcagggcacgggggcagggaagacatcaaggggtggagagagacccgccctgaggcccagtgcacagcctggcatccactggtgccctttcaccctcattccaccagtagccatggagacggctgtatctcaactccagccttcgaagagggcaagagagcaggggagccttgagccacagacagcccacatgggcaccatctccccaagatgtcccccaggktttggggctcccaaaggccgattgttgactccaggaccttcactcactttgctctccccrccatcgtactcagaggcatccagaaccggcagatgggagaagccctagggagataggcctagatacaggaggagacatgtggagctgaggcaaaggcgggtgcggatgccaggcccagtgccctctatacccctactcctgctgacaacctggctgctgtaagcttggcagttgccatggactccctgggagagatggcgtggcctggaacgtcccccgccctgaggtggggcagggctggtggggtytggtcatccccctggtgggtccatgcatggcagcctgggcaggatacatgtgagtgcctacctgggctggggtggcctgaccctctctgggcctcacagctttgtctgcctcatggtactgtccacctggcctctcaggactgctctgtggcgtgtgtgcttaagggattgagctcgttgggctggggacagaggcctgcctaggtctgttgagagggcccaggtaagacttccacccagactgactggctggggcacacagagaagccaggacagggctgattgtgtgtgcaggggcgtgccctctggacgaggcccctcccaccggggcgaggcagaggccttgcttggttggagcggagtgggggagtgggagggtctccctggtgagatagtactggaagggcagggacagcattctagggaaggaaccagaaagagcccctgcatggaatgtggggatttcaccatgagaccccggctgcctggcctctgagaacgtgtgtggggggattccaggtggaaggtcgtgtctgggaggatgggtggggggttgagcagtcattgcccctctccagatctgcgtccacatctgtaaaatgggcctagaattcccagccgctgggggcgagtgaggccataaattagttgagatggacccaggctcctaagccccctaggtcatgaccccaaaccttggaacccccgacggagacggtgggggtggccgaggcccaatcgaatctatcccgcccagatgtgggaagaaccgcagggcaaacccccggcttccctcctggccgctcctctctttgaggccacctctctgagccctgatttgctggcgggtgaactggggatcatcgtgtccactgtggctggtggtcgtgaaacgawgtggaaacatgagtgttgaggccgagatgggcgcagtgcgcgctcctaaacagctgtccccatccgtccgcccctccctcccttgcgcgggtcagctggagcgggggcgcgccaggcacgaccctggccgggcagaaggcggtggagcccttaggggtcgcggctcctacccccggccctcccatgtgcagatggggtagcagcctggaggtttttcccaaggtcacgtaaggtcaaagaaaaggggagctggacgcgacgaggaaagtcacgcacggcggagggcgggccacctacgcgcgcgcccgagttcgcagagcagcggcgccctcccgggctagggcagctcggagctcggagcctttcttcgcccgcagctcgggttccgggagccccgcccccgcccatcaacgccccgcccctttcgccacggccccgcccctcctctccgttctccccgccggcgctccctcaagtttctccgaagttttccgcgggtccagcggtgcgccccgcccgccggccagtgacgtaacaatggtgcagcgcggcggccaatgggtggtggcgggggccggcggcgcgggccaatggcggcggcggacggtcccgctgtcctgcctggccggggccgcactgcgccgcccgccgcccgccgcccgccgcccgccgccggcgacggcaccgccgccctgcgatccggccgcggcggctcagagcgcggctgcggcgggcgcgggcggcggtggctccctcccgtgcgtccgtcgtgggacctttgcccgctcgcccgcgggggacagcgcgcgctccggtccgcggcaggggcggggacgcccggcctgtggcccccgcgccccccatggtgagtccccgtcccccgcgccgcgcccgcggccgccgccccctcctcctccggcacacgcgcacgcaggtgcagccctcgctgcgccggccacctgcgcgcggacgccccgytcggccccgcgaccctccgccgcccgacgtctggccgtgcaggccgggaggggacgggtaggaggtggcgggtggccccgggcgcggcgctgccttcratggcccaacccccttattcacgagccgcggccgtgactctgcccggtgacgtggggaggccgaactttacgtaacccgcccrgcgccccacgcgtgccggcwcagggcatatctggggcccggaggcccaggcttggggaaggggctccagtcacggtgttgcccacgggccacagcctacccgcaccgcgccgctctctttaactcagttactgccagtgatagtgacccagtcagtgtgtgtggacgcggcctgccttctgtcccaggccccttgtgaccaagggcttacccttgaaagaaggcagtagggaggttgggacggagccagaggtcagacgcctaggctcaggtcggggctggggactcagagggcagggtcagggcyyaagctcgattgcctgtgggttgggggtccccaccaattctggaatgagcccaaactgagacgcaggggacctgagttctaggcctggctctgccgtggcttgctgaccttggagaattggagaagcttgtgccctgctggaaagtgggatggcagtacccgcttcatctagtagtcggggagatcaagagaggtatgggacctgaagaggatggcagactgtgcagtgcggtgcacaccggtctccaggttgttttcaccctcctrtctcctcccaggagctaacgtgtaagcaaacatgtttggatagagggctggtgccacgccccaggctcaccccgcccgcacagccgtcgtccacccctcccctttcttacagatraagctgaggctcggccagggactgtgatatacccacatccccggaactaggtgatcgcggtgcaggaaccaggtaggtctgagtctggatcatgcctctgaacagcccaggaagaggctccaggggcctccaagtggtctggggtcggagatcagggtcagggttgcgcttgggctggagagtggatttgcctcagcttgagatgtgggcccaagctttctcatcccctccctggccttttctttatttggggtcgtatgaacctggcttaggtgggaacagaagctcttccagtgggtccctgggttggagaggggaggggagatttgagggcatgggcagcaagggcatttccagcagaggtgccagagagcaagtcagtttcaaggagggagaacaggtacagctagatcaaggatggaggcggtggttctgggcgtcggagagatggagctgtagggtgactggaagggcctggccgaggctggaggtaggtacaggcctggtgggccaggaccggaggggctgtgtgaggggcagaggggagtccccgggcctccccagtttccccgcgcctcaccgtggcctcttcctttccccgcaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccggcttccgctgctgcgcggctcccgggccgcacgtggcgctggcagtgcgctacaaccgcgtgggcattctgcgccgcatcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagctgctgctgcgccagctgggccgcgacgccggggccactccctccgccgccggagcccccgcctcagctcccggggagccgcgccagcgccgcctgctgctgmtggacctcctggcgctgtacacccccgtgggtgccgccggctcggcccgccaggagctgctgggcgaccggccgcgctggcagcggctgctgggtgaggacaagttccagtggctggcgggcctggcgccgccctcgctcttcgcgcgcgccatgcaggtgctggtcaccgscatctctccaggccgcttccccgaggccctggacgagctgccgctgcccccattcctgcagccgttggacctcactggcaaaggctaggcccggagcaccctaggcgctggattttgggacaaaactatttttcagagcgttgtaccggcactttatatatattgatctctgtacggcacaatctctgcctcatctgtcgcatgcactgggggctgggcttggatggtcaggtgagttccaagtggcaggttttctgggtgcagctgggctcgggccttcagctcgctgtccagcccctgaagggagtgaggactaacctcccaccttgatctagagcctcggacaggtgtgcgtcccagatgggtgacagctgagtgccgcaggagctcggtaggtgcaggggtggggactggcatgtccaagcagcaggacagcgtataaaaaggcctggaagccaagagaacgagctctgcagcgtagggttctcacgggaggtcctgtgcggycagccttttgcaccctgtggactccgggccagggagggcacacagggctggcaggcccgcggtggctggtgttgaggcatgaacaaattgtaccgggtatcccccaccccactctgaccaccagttcctccttggatatcactccccctgacaggcagcccacccaggcctggatttgtccctgtctcccccttttgcttttcccccatgactaatgggcaccaggtcttgctgctcctgcttctcacctctgcagtggcagcaggcccctggccccaggtgcatgccggtcagtggggttggatgtgccttcctccaggcctgccctctgtccaagcccggagtgggcttggtgggctccctggtggcccccagtgggtgccaggtggtgcccggggttattgaggggtggttgtatcactgtagggacaggcttcttgccccagcctggagagctgttttcttcaggaaggttctggagatggagacttgtttgcgaattcaccacaactccaggctgggaggctgggtctcygctctcagagccgagacaccagggaggatagccaggctgccctgcctgggaattctgctgggccgtcaaattcaacccgcaccaacgtgggcaggagggccacagtgtcctgccaggagcagagggctgaaggtctgcaggaggaagarccactatcctggtggggggcacctgctgcccaccctgcccccagcgtgcctggggggagcacacctgggcatggaggagtccagggtgctgggccacacaagagaggtgggggagaggcctggacagtaggaagatcttgcccagggtcctggatccgccactctgggggtgaccttggacaaacctctgccttggccctcagtctccccatcaaggtttttccattcaggaggttttgggccatcttcagccaccctaccagccctgaaaaggatgtgactcctgtttctgggaagtgtgtggtgtgttaggtgggcctacagccctggttgtggggagggaaggatggagagacagcacagtgacagagcccagactgcaggctggagtgagggttccacttccccgctgctgtgtgtcctggaccagtgcctctgaaccttggcacttggggcagtggatattaacatctttccaagcccaattcttggggcatcagggcctccggtcctctgggaggtggcaggtcctcagattggagatgccatgggggggggaggtgcctctcctttggagggtatggaagtggagacaggagtggcctggcgcagctgccgtggttcttaggggctgggcccggggagcccatggggcttgtgcctagaaagcctgggctcctcactggggtctagatgtgcagacttcatgtctccccagctccagctctgttctctataggtcagcctccacaatgccagaggcccagggctagccccctccacgtccctcctagatctacagctgcccctttgatgacagcgccattgagtcccctgggctgggggggtcatgcaggggtgaggcagctgcctgccgccggtactcattgcctggccaggcaggacacaggctggcgggcactgagagtgggccccacgaaatccattgtcaggttaccaggatgaagaacccaggctggtcgtggagtgcagggcggggcctgccggaagaattatgggcactgcagcaggagggcagcctgggccattagctcctgatgtcatcgatttgggtgaggggacagggaagtcagaggaagctggccagtggctctcacgmagacttacagcagyggagtggtgcctgattcctrgtacagctgctcccactgagtctccagggatctgtggttcaggaccccctgcaaccccctcccagacccctgtactggtgggaggagaggacctagaggaaaggtgctgggcagataagcagcygagggaggccctgggtttagcttatcagtcttctgggccctcctgccccaggaagggcagcgaggaccatggtgttgcccctgtcatcgttatcgtcctggccatgagcttgcaggactgggagggccggagtcagccaggcagacggcagcacagcatttgcctgttggcaggtggccttggtggcttcccaaaggcaatcgctccacgcagaacaaaactcacttttttggggggtgaagcaccttggttcatttgtttagttcgttaattccagcagtctgtttctaagggaaacatggctgcagccsgtcctgcccctccacccacccaccaggtgcccagtgttcccaagggccccgaatcccaaccttattcaggcrtcagcatctctgcaccccaaatgcctgttagggaggatagtgaaggctgagccctcctgggctcatcaaaagccagcagtgagagaacacccccatctctctgaggtgaccttgtagggcagtccgtgctgtctggctggcctgggtgaggtgggcagggaccaaggcctggcgcctgggcctcgctggccttgctctgcgtgctgacttcatcctgatagtaccttgattttcctacygtgacttccccttctgtcgacttcctcaccaactttaaaattccgtattgagagcagtttcctaagttacctcaaatcctattcagaagaaggttcttcctggaagttgggagggcggaaaacaagtttagtcacagaagactactccatgtttgagcttctgtttcaagggaagtgagtaactgccggaggagccctgcccctctgcagtgtgtggtgttgccctgatacttttcagattgaggtgttacttacatgtaataaaatgcacagacttaagtgtatactttgatgagttctgatgaatgtctacatgtgtgtaatcaccactgcaatcaagatggaaggaaaggctgggcgcggtggctcacacctgtaatcccagcactttgggaggccaaggtgggtggatcatgaggtcaggagttcgagaccagcctgaccaacatgatgaaaccccgtctctactaaaaawaaaaaaattagccaggcgtggtggcaggcacctgtactcccagctactcaggaggctgaggcaggagaattgcttgaacccaggaggcggaggttgcagtgagccaagattgcgccattgcactccagcctgggcgacagagcaagactccrtctcaaaaaaaaaaaaaaaaaagatggaaagacagatttctattggtgattcttaaaagtaatttatttatttatgtatttatttatttatttgagatgtagtcttgctctgtcatccagactggagtgcaatggtgtggtctcagctcactgtaacttccgcctcctgggttcaagcgattctcctgcctcagcctctggagtagctgggattacaggcgctggccaccacgcccggctaatttttgtatttgtagtagagactgggtttcagcatgttggccaggcaggtctcgaactcctgaccttgtgatccgcccgcctcagcctcccaaagtgctggggttacaagtgtgagccactgcgcctggctcttaaaagtaatttctttctgcttataaaattcatgttcactgtagaacactggggattgagtagagaggtccggccacgatgcagggaaacactgtctcaagcgccccaccgccccacatggtccccagagacagggcccctaagcgctcacgtacaagtaaaggcgctgactgagtgcgtcatctgcacgcatacaagcactgctagcattctggcatatgtttctttcagcttttttctgtgcagatatatattacatttttttctgtgtatatttatatatatatgaaaccagatcagttacacaatttagtatttttttaaccttaatgtagtataagcatttcccccattgtactttgtaaatatgatttttaagaagtcattggtgtctactttgtgatatttgactcaaccagccttgataacaaagagtagttagagacaactgaatttttaaaatgtaaatctgctttatttttggaataaataatacatttacatggctggaaattcaaaggatacaaaaaggcatatactccaggcaaccactatgaccagctgctgatcacaagtagagaacttgtttcttttcacccctcttgctcctccccggagttatgaaaaatttcaaacctgccaaaagtttgaagtttacaacaaataccctccaacgtttgggttgyctccctcccccttctctccctttctccctctgatttcttacagaaccacgctttcatgaccatgcccgggaacttcacgctggcgcggtgaggtcctgcgcctccgcttcctgcacacacgtgcttcttaatagctgcaggctatttcatgagaggaatttgctcacgttaacatggctgttcccaaatgccaggctgttttaagtgtttcctaattataaacaggctgtgctgtttcccttgacctaggacttgttcttgaggacagaagtggaggtggcgagatgcaaggcctacgtacggaccggcttccccagtagggcggcgccaatggggggctcccaagctgctcccatctcacctctgcttccggggtgctgggggtttgggccagtgttccttctgcttttgtgaagggcccttacactcgactcgaagtgctcctcctattggtttttaataaatatatttatggaaagctttatgaatttgcgagtcatccttgtgcaggggccatgctaatctctgtatcgttgcaatttttgtatacatgctgctgaagggcgcactcctcttattgttgtataggtttttaaggtaaatattcaacatcaattcccatttgttgcaattatttcccttctttgaggtttttaatttgcagcatttttacatttatttccttctatttatttatttttgagaaacaaggtcttgctctgtcgccgaggctggagtgcagtggtgtgatcatagttcattgcagcctcaaactcctgggctcaagtaatcctcctgccttggcctcccaagtagctgggactataactgcacatcactgtgcccagcagcatttctgtattttggagaaatcaaatctatgtacttattttcctctgtagcttgtcctatcacttttgagtttagaaagcctttgccatccagaaatcagacagttttcccactggttttagattctttaatccatttaatattattttgcccagagaatgaagcagtggccacattagttgtgacaccccccatgccccgcccccgccgctccttaagcgcatctgagatgccctctccattctgctccctccctgtgggccttgctagcctgttgcctggccctccgagggtctgggccatgccattcaatagagtggcccctgctggggctccacctgtcatcacttagcagttctcacccgtttcttcttcccaggagtgacgggacagtgaggaggcatcaaacagcacaggtctgcagttctacagagctggcttccagtcccagtgctgtgtgaccttgagcaagttacctaacctctctgagtctcaaggggctaatgagacttccccttgcagggctctggtgagaagcacattgggcacagtcatgggcatttgtgggtactaacattattcctccctgcctgccccaacaaaacaatcccagtggggatttgaactgaaatcaagctacacctataaattcctttggaaagaatgaggtctttccataatgtgtgtagtcctccatccaggaatgtggaacatatcttcctttattcaagtttccttttatgccttctggaaagctttgctgctcttcacacggcctgaggtttcttgctgaggtcatttcctggcacatggtgtgtcctgctgctgtgctgggcgtcatcttttgcgtgtgctggtttccagcagctctggtttgcgatatggtttcgtttgctggctgaagatacagaaccaggggctcgaacccctccaacgcctgctcacacacagctccatgaggaggcagccctggacctcaccccacagcgtcctcctcagaggctaccatggggtacagccagctctggagcggccattcccccataacagccacttgggcaaaccggtgtgtatttcaacaccagccaggccaggacaggtctgctgacgcactctccctgtggtggggctgggctggcaggttctcccttgcactgccctcgtgagtgtcggctgaggacacttctcacagctcaggcaccacactcggccaggtttggaaaaagtctagtttattgcactgactcaaagcacaactaaaaattaaaaccagaaagaaaactgtacaaagcacgaagctacaactttaaaagcatcacctagacgcgggtttaattgcactacagtcccatgggtgaggagagctttgccatccgtgaggcgccgggcaaggcacaacagacacagagagatgcagcccggcctggggctgcctctgctgccaccaacttttacaaaaggttctagaaaagggaagtgtgaagtcagatctgggatttcggcatcttgacctcatttggacatggaaaacctccacctatgtggctggctgggtcctgtcagagaacatattttatcaccctccacctgcggcctgggggctccctgacaccaaggactgggcctgggccaggggcaggctaaaaaaagcagccagcctggtgtcctgtcctgaagctgcctccgggagggggcgggatgtgtggcagggcggcctakccctcacacgcagaygccagtgggcggggtgggcactgcccattgtctgaaggggccacagcagccgtccatagaggcactggtttcaacctgtcaagtgtcaacccatacccygcagaaggcatgggctgccactcggagccagcccgcargtcccgtgaccgccctgccagtcaagtctgtgcggggatgcctgcccctctgaggctgcaggcraggacagtgcargctcargacaaacccgggaaggaacaaagggcttccactgttttcggaaaacatatctctcttctaaatttgtaagatttgatttgaaatgaggtattttatgcagatttgtaatacaacaacaaaggcaataattagtagactcgtcctctgaggatgcatctggttttaggatgtccgccagcagcattagttaaacaccattccaaagacatttctaagtgagcgacccttgctcagctcccccacgccccatgcaccctcctgtgccgtccctacctgggacacacgtgcacacatccaggttccatttgcacccatcaggctttactgtttcagctgaagwgygctctccaggaggcgggcagcctgcgccgtgtgtgggcagtgaggtgtggtgtggtgtggtgtggtgagatgtggcgaggtacggtgcggtgcggtgcggtgcagtgcggtgtggggtgtggtgtgttgtgtggtgaggtgtgctgtggtgtggtgagatgtggtgaggtatggtgcagtgcggtgtggtgtggtgaggtgtgctgtggtgtgaggtgaggtgtgttgtgtgttgtggtgtgcatgtgcgtgggttctctcctggcatggccagcgctctcctctcaagcccggcctcagcttcctggccagagcgtctggcatggaatgtgctctgcagctttgtctctggggggacacccccctatgatgggacaaagccatcacygagcacatcccgcgctgcagagagctgacctttggctccatctggccctggggctactaatgtggaaggaggccctgggccaaaccagctgcccggctacccttggttctgggaggcctccggagaccactcccaccaacaaaagctggagctatctgtggatgagaccaggacggcagcacgtgggtaatcggagtgcatgcagccgggcagtcgccactgtcctgagctaggaggcgccactgctgcagcaatcacgccagccaygggtggaggctgtgggttctggaacgagacagaaaccaacatagatgaaagtaagtgtgcgggtccaacctggccagaggtgtctggacaagtgttgagrcagygcgtccaccagggagtcactcygaagcccctgtgcccgccacagacgccgggcccctccgcgtgactcggccagggctccttcagatgacctcccactcgtcctccaggtcctcagggtggggcatggcggcctggctgctcttctgggtgccgtgcgagtggctgaacgtctttgtcagccgttggaggaggtagccgggcgggcccacagcccacagctcatctgacgcagtcactgcagggacaagagycaatcacatacttgtcaatcacacagcctgtggggtgggcacagatggagctgggagcttgggcacagatggagctgggagcttgggcrcaggtctgggcttgccacattctaggtgggggacactggacaagccaccatctccatgtgaacttcgtaccctcagctgtaagtggatgtcaacagcaccttgtccttgcccaggagactctggcagagcccaggtgtccagccccttccctccctgggacacactcctggctttgccctcagttcttgctttgagagattggagcccagtggggtcggcttcttygagagcmccccgacatcgtccacaggagccctgggaaccccaaggggccttaagcccactggccccgggcacctgcctgtgaaacacgacacgctgccgggaattttcttccagtagtcccc

SEQ ID NO: 13386 - DNA, 18238 bp, Homo sapiens
  misc_feature (1)...(18238): n = A,T,C or G, or insertion/deletion polymorphism (see Tables 1-2)
tcttgcaagcctcagcctgattttatgattcgcacacctgctccatgggtatgacctcatccaacccctgtgaggtccctcccatttccaccccaccgcaacggaagaccccttcgcagatgagcacctgacacccagagagctgatgcttctcacaaggggcaccaggaccccgagaaccattctcttgattccacttctgcagcctgggtgaccttcaccagtgacccccgcactcccgtctgctcatgtgttaaatgaatgaatcgtcataatttactatatgctctgagctcctaacacaaactaagtcgttactcctcgaaaaactctacgaggggatcctctgattttaaggataagaaactgagacacagagaagaaaaaactcttaccagggtctcccaaaatagtaagtagtggaacagagatctgcacccatgctgtctggatccagacccagcgccctgaaacagcagcttgtctggttccagaaggaacggaggccgtggtgagactaagttagaagagggccagcacctcatggggaggcccttcgggcaccacgagtccagtcccgctccggaggtgggcrgtctgcaggccccctgagaagggggtttgaggggaggctttttcctgctggggaatctcaaagggcttaaaactgcagaccgagaagccgggaccttgcccaggggtgatggggagctgcaagggaaggctgtgagcaggggaggggcggggtgatctccaagtgcagagagaccctctagggccacgtggtgaccgacaggaggctgtcctcccggacaggaggrgcgagggtccagagagagaggaggacgtctgagctggagccaggccaaggggacagagaggaggggacggggcagagagaggcaggggccgaagggacaaggctggggaccgatgggctgtaggggataaggggagagatggggcaaggtcagtgccaagggcgtctggccgaataactgggtggtcggtgacgctgcccctgagatgaagaacgtggaagaacagggaaggagggtttggggamatagagcaatgagttgggactcggtaagtgagaggggcctagggacagtggtgcagggggcgcccaggagcaggtggctgcccaagccggagttcagggtcagatggaggagacctgcgtggttggtggatgaaccacgggagttgatgaaaaactcccagggaacgttctcaggaggaggagccgggcaaaagtgagactcaggccgcggtgggcgggacccaggccgcggtggaggtgaaggacgtccgcggacacgtccaggaggacatcgatcgcgcgagcctgagccagacacagtgggcggggacggggcgccgacgtcaccgcgtgggggcggggctgcgggagccgctggctgcgcgccctccagggagccgagcgcagaccgggtgcgcgcctgggttcggcgcggcgggagcgccctcagtgtccccgtctgtatcaggggtgcttcatcagtacctgcctargctggttaggaggaggagcacgtgcgatcgtgacggraagcgctcakcacagacctggcaccgaggaagtyccaggggctcggctcctttccctcgtcaccaccgcgccccaacagagggaggcggctgcaggggtggcggcgaaagggcccaccgggcgttccggagtcggaacactgattcctctcccgcgtggcctctcgcttctgcaggaaccttgcttgtgctgcctcctgtctgggcctcagtttcctccgtattcagcaggaagccataaggttattaatataaacacctcacagggctgccgggagccggagtgagatcctacaaagagagcacttggcacggaggagtggcctgcagccgcattccataaacagggctgctcagctgaagcggtggcccagggtgaggcccgcagactttgagcatcaatttgtggggagggaggcaaagggacataggagttctagaatagcttccaacctggggatctattatgtctgccggtctgggcttgtagaatgtctggagacccgacgttctagaatgcatgaggtttctggggactccagagtgcccgatgttcgaaggttctagagtgtttggagctctgtggttctaggctattctaaaatcttaccttccagagtgtcctccactgccagaatgtcttagggcctgtgcttttagaatctgaaagtctgatattcyagaaattccaggggcctgtarttctagaatggctgaatccttcccataaagatgatgactttccacacatggggagagaccacgcttacaacaggtcccatccttcactgggtgacctgagtgaggtcagtccctcctgtctygggacctcctcattaattaagccaaaatagactctagataattgcttggggccctctggggttctgagacattggaagccagcctcaaatacccaaagccttgggtcatctcagtgatcatctccagcctctgggatgcagaatccagatttcaagctctagaacccagaaataagactacaggaccagartagagaccctgggttcccagactctaaattcagactctagagtcaagattctagcaatctcagaatcgtgaaagccaggtccctgtctctcaattcagccttttaaaaatttatttacttatttatttatttatttagatttttcatagagatgaggtattgctgtgttgcccaggctggtctcaaacccttcagttccagcaatcctcctacctcagcctcccaaaggcatgagtcactgggcccagccacagtccaggttttcaatgcaaaaacagatttgaaactccagactgtatgttccaaagtctactyctgaaagctcagaggctagatccaccctgtagaatccagaccccaagcctggcatggtgkctcacgcctgtaatcccagcactttaggaggctgagtcaggtggatcacttgagatgaggagttcgacaccagcctggccaacatggtgaaaccctgtctctactaaaartataaaaattagctgggcgtggtggtggtcgcctgtaatcccagctactcaggaggctgaggcaggagaatctattgagcccaggaagtggaggttgcagtgatctgagatcrcrctattgcactccagcctgggtgacaagagcgaaacttcatctcagaaaaaaaaaaaaaaaaagaatccagaccccacaattcaaaatcccaaatctaccatttgtagtctaggccccaggcttctcatagcaggtgcaaaggtttccagcctcgattgccagattccaaacaccagattccaggctcctattgtgggttctarattcgaatgccccgggatccagaatcaaggttcacgatctgtcactcaaaggcccgactccaggatccagattccagacccccagcccaagaactcagactttgaaatccatattccagactgcaggtcattaatctccaactcaagatcctcaaatccrgaatccaagacccagatccagaaccagatccggatccagaacccgggatccagaactctgccccaagcccaagaacagggactttaggatccagtttccacactccagaccccaaattccagactctgtcttttgatctcctcctaatttctgtttttgtcctcctgtcccctcccccttgaggaactgctcctggtggagaattcctctttgtggactcagacaacagcttcaacctaataaatgctcattaggccaagtctcccaccccaccagcaaccaaggcgtctctgcctgtaaacctgactctcagccacctcccaccccaccctacaccaccacacccccagacccagctgggactgggagcttataaattcaggcatcctggtacctgctcccttctggcacccaagctgccctagatgctgctggaggatctggaggaggtgagagctttgagacaagactgagggaggggcaaaggggagattcactgtgccctggtttcaaggggaaacgttgaccacgcttggagaactgagtgtcaagggcatgggtagatccacgtgtcctttaccaatgccccaaattgaacctgaaccaagaaaatgtcctggaatggccagaaggagctgcagtggtggggagggagggggatggagtggatcaggaggacgtccctgaagtacttgtatcagagccaagaacgtggtcaggagtgatcacgggttcaagtcagttcagcacaacctcccggaggcctcctgtgtaccaggccccaggtggggcagtgctgaggtcacagaaagaacctgacctgagccccatcttcaagacccccagatggagaaaagaacaggccagacctcagcaagtatggggcatctgcrctgtaatggagacagaatgggtgctgtgggattcaggggagacacctgttaggtgttggggcctcccagaagaggtgggggcagagtgtcagaggacaaagatgaatttggaagatatggggaagaaggatttcaattcacyctcaaagcttcctgaggcctcccgtgggtcgggccctgcagtactggagacccagagtggagtcagaccagctcctcggggagctgccagtctcgtaggggaggcagacaccactgagggtcaggggaggtcagagaaggcctcaaggaggaagcggggctggaagggaatggcgttggatatgcrgtgggaggaatagcctaagcatgaaatggcaggagggaaaatggcagcactggctgcgtctaggacarggtcatgggagacccagggagaggggctggaagggaagaagccacttttgtccttgaaagtgaggctggagccaggcaactcatgcctgtaatcccagcactttgggaggctgaggcgggtggatcactagaggtcaggakywcaagrycagcctggccaacatggtgaaactccgtctctactaaaattacaaaaattagctgggcgtggtggcacacacctgtaatcccaattgcttgggaggctgaggcaggagaatctcttgaacccagaaggcagaggttacagtgagcggagatcacgccactccactccaacctgggctacagagccagactccgtctcaaaaaaaaaaaaaaaraagaaaaaaaaagaaagaaagtgaatttgaagagctggactttatcctggtggtgccaaggatccatggagggtggtgagcaggggaggggcacagccagctccagatgtagaaagaccctttggggtcatggctggagggcaagctggtggaggggactggactggagggggacccaaaaggccagataagaggttgagatagaccaggcgcggtggctcatgcctgtaatcccagcactttgggaggccgaggtgggtggatcatgaagtcaagagattgaggccatcctggctaacacggtgaaaccctgtctctacttaaaaaaaaaaaawttccaaaaaattagccgggcacggtggtgggcgcctgtagtcccagctactcgggaggctgaggcgggagaatggtgtgaacctgggaggtggagcttgcagtgagccgacatygtgccactgcactccagcctgggtgacagagtgagactccgtctcaaaaaaaaaaaaaagttgggacaggggtccttggtgatgatggagagagatccaggggctggtagcatggtgctggaggctgacaggtggaggaggtggggcagggtctgtccgagtgcctagaggaagagtaaaccttccagagatgggggacccagaaggaagcgcagagtggggttgggggaaggggataccrgtggtcagaagaaatttattaacagtggatgggataagtctgtgtctggagggatcctggtggaggcagaagggtcctgcctcacctggattctctcactccctccccagactgcagccgaaccctggtccctcctccacaatgtggcttctcctcactctctccttcctgctggcatccacaggtgaggtggccccaggagggggccaggtctgtgggagcaggtgcccccttcccaagcatgtctgggcccagtgatctgccagcccctacctcacccagagaccactaaagatccttccttcaccctccacctgtgccaatgtccctaagcccttaccgtcaggtgctggtgctgctgctctggagtcgctatgttgcctggggcctctcgctgcccacgacaaggaacacggtcctggggttacacaaacctgagctgagtcctggggcaaccgcttccttgctgtgtgtccttgagggaactgcttcacctctctgggcttcgaatgccttctctataagacagcacccrcttgagacaataacagtgaggtctcaatagcataacagaggtaatatacatagcaagcattagacaagtgctgagaggccaacagcacagacagactccagcttgagtcccacrcctgccactccctgtctcttacagggtctttgaggggattaaatgtggttgtgtgtgaggcagaagcataagcctggcycaggtagtgcccyttcaggtgtgcaagccaggcacggtgcttagagcttacatacaacgtctatgtgtggtgggcaccmccgacctcatttgacaagggaaggggctgtggctcagagggacggccacaacatcaaggtcaccttgggtgtcaggcaaactccagattgaactcagctgccacacaccaagaaattaattgtaacctgatgcctctcttctggagaaattggggggtggactttcattaacgttctgccacaaatgaccctcactcctgggggcccytsagacccccacgcctccagcctcccctccggctctctctgtgcactcacctacctgcctygcgcctgcctgctgcgcccagctggggcctccaccttcctctggcttggactggccaggtgcagcctcggtgcccagctgttcagcccgtaccctccgcccttcggaggacgacctcacccttcctttgttaagcccctygtccaccacatccgcattcccctggtctcacgggggcctttggcccagttcctgactgtgatggggagagtgtgggcatttggtctggctgtgcaaatcctgcccctgtgtgggtgggagtgtgcatggcttcaaccttcaggggatgcatccacattgcccagtggagaggggtcctggtcctgtgaccttgaatgtctctaatcatgtccttaagcataatgccattctgtgtgtgtgtgtgtgtgtgtgtgtgkacatgcacgtgtgcagkgggtatacaaggccctgtatgttcacatcctctccacatgcatgagccagatccccatatgtgaaacccaatcagtgactccacagatctggcttgggggctgatctagagatggataaatatgtcctgccctggctgcctctggcttcagctgcatgtctytgaccttgaatgcccagccccgtgtctgggtgctgccccagacagcaagtccacatctgagtgttggccttctgggttggtgtctgcagctctaactctacaaaatgtcttgtgggtgaatcacggttttaaccttgacttttttttgtttgtttggttttttttgagacggagtctcgctctgccgcccaagctggagttcagtggtgcaacctcagctcactgcaacctccgcctcccaggttcaagcaattctgtctctgcctcccgagtagctagaattacaggcacgcaccaccacgcccagctgatttttgtatttttatttatttatttatttattttttagtagagacgggatttcacgatgttggccaggctggtctcaaactcctgacctcaggtgatccacccacctcggccttggcctcccaaagtgctgggattacaggcgtgagccaccacacctggccaaccttgactatttattataggtaattctgtgcagatgtctgacttatgttggccatctccaggatggacctgaactttcacacgtatgtccctrtgactaaatccaggtgtcatttgcaaaaaacaactaatattattaagtagctaccagggctaggtatcactcaccatacatacacacatgcacacacacacatacacattcctacctcatccttacaacaatcttcattttacagatgaggaaacagaggcacagacaggtcgaataacttactcaaartttcacagctagtacattcgaacccaggcttaaggacccatctttgtccagaccctgtatgcaagtgtctgtgacactggatgccaagactcacactagagatgttgaatttaggtctgaacaatatccaattctgtgtgtgtgtktktgtgtgcatgtgtgtgtgtgttgtattcatgtcttaaccatccatattcatatacacatatgaacatctgtgctgtgattcttttttttttttttttttttttttgagatggagtttcactcttgtcacccaggctggagtgcaatggagcaacctccgctcactgcaatctccgcctcccgggttcaagcgattttcctgcctcagcctccagagtagctgggattacaggcacccgccaccatgcccagctaattttttgtatttttgttagagacagggtttccccatattggccaggctggtctcgaactcctgacctcaggtgatccacccgcctcggcctcccaaagtgctgggattacaggcatgagccaccgtgcccagcctgtgctgtgattcttgaagctgcaacccatgtgcatgcaagtgaatttcagcttccagtcctgtccatagctgtacctaagtgtggaagctggatgtgcatgtatgcatgtccatgaccttgtatagccacatctgggactcatactgcacactgaatttggctgacatgtccagactctggggccaaggctgggtcacacatactgagtggccacatgcgtttgacgtctgtgacaatttggtgaccgtgaatgactggtttcaagtgaccacctgtctgaacctgtatccagtgcccctgtctccacccccaaccacagaggacttcttgccctctggtctgttccccttsctctctctcccagagtcttatagcaaatggggtgggggctagagttctggagaaaacaggcagcggttgtaaataaacaacagggcaggcggagcatggtggctcacacctgtaatcccagcactttgggaggctgaggcgggcagagcatttgaagtcagaagtttgagactaccctggctaacatggtgagacctcgtctctactaaaaatacaaaaattagccaggtgtggtggcgggcacctcagctactcgggaggctgaggcaggaggmtcacttgaacccaggaggcggaagttgcagtgagctgagatcatgccactgcactccagcctgggcaaaagagtgagactccgtctcaaaaacaacaacaacaacaaaacaaaaaacagggcagggtgtcttgagaagttaggggaaaggcataggcatatagtagttagggcagggtgcaaggaaggtgtaggaggcaatgtaaacgtccctgtcctcaggcatcctctaccccttctcttagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcmcactgccaaagccggtatgaaggcaggggctcarggtcctgagggagcctggttcggggggaagagctcctakatttgggggaagacggaggcagacgccasaactcctgggttctgaaagacgaggaggccggatgtcaagcccctgggttaggaaggagtgtgtgtttcaaagccttcgatctctgaaggaggaaggagaagactagttccagcttttgagcctcagttctagggatgtgagaatcctggattcggggacagaccaggagggggctgggagtagttggaggggatcgagttctaggagtgtgcctgacttcagactcgttggtccttgaggagcaggggctggaaccattggcttcagggtcttgggaaaaggtaatgggatgtcgagatttctaaagggtcgggagacctcgggttgcccactctttgatctttctgtcctctacttgcgggtaaccactggcccgcactccactggcgggaaaaccactcgcccscacagcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctayccacgcgttgcccccaccygggggaggcctgtgtggtgtctggctggggcctggtgtcccacaacgagcctgggaccgctgggagcccccggtcacaaggtgcrtgaaaggatggagctggatgcgaggcctcaaggaatcctatgctccagggctcttgggcggaggggacaagggccggaatttatggatytgctccaagtccactgtcttccccagtgagtytcccagatacgttgcattgtgccaacatcagcattatctcggacacatcttgtgacaagagctacccagggcgcctgacaaacaccatggtgtgtgcaggcgcggagggcagaggcgcagaatcctgtgaggtcagagcctagaggggccatcaggcggaagaagagggatggggacaggtgtgggagtccggatggggttggattttctttgctttgggccagagaagatgctagggtkaggcttggagatggagtaggaagagaagttagaataggggtgaggttggarttggggttataggtggggattgcgttgtttgaggtggataatgtgatagttagtttgagatggcatgggttggggttgagaatgggaatggtttggtttgattctgggtgggaaatacgtcagggttgaattgggatgaggtagattttgtttggaatgcagaagacatgaagattgagattggattttgagatgggcatgggtttgatttgattttgaatggtgaggatgtgggctgagttggatttaacttagtacagttgcactggagttgcatgggggtragattggatataggttgggtgagttgtattgagctgtgttgaattggggttggggttggggttgggttggctctgtttgggataaactgggctgtattgagttgagttgggttggggttccctgggatggggatggattgggtttggggtgagattgcaamtggtgattaggatgaggatgaatccaggaggtttcacycaacctgagaccccctcttttccccacagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccragacactgtacactgttccttttcacccaccaccccgatccctaggtgaggagaagcrgcttgaagcagggctccattcattcaacacacatgaccacccgtgtgatcttgaacaagaggcccaatctcacttcgcyttggtttccttatctgtaaaatgagaccatcttattgctgacttcmaagggctgttgtgaggattaaatgagatgattcgtctgaactgattaaaatcgtgtctggcactgagtaaataccctctatctctggatcccagttaaaggacctaacagacactagattacsaagaatggctttttctttaaggtttagttctgggccgggcatggtggctcacacctgtaatcccagcactttgggaggccaaggcgggcggctcacttgaggtcaggagtgcaagaccagcctggccaacatggtgaaaccccatctctactaaaaatactaaaaaaatttagccgggcgtggtggcacacgactgtaatcctagctacttgggagggtgatgtgggaggatcgcttgaacttakgaggcaggagttgcagtgagccgagatcgcgccactgcactccagcctggtgacagagcaagactccatctcagaaaaaaaaaaaaaaaaaaaaagatttasttstgggcttcctggtagccatggcaaaaaggcaaatactgtcctttycttagccaggtccctgatatacarcaraggctggaaytctgagctgctttgattttaccaaaaagccaagacaacctgttggaagcctatgggtttaccattgaggctgcaggaatctagttcctaattatcttcagagaccacaaaatgtgatgttcaaggtcgctgaatgttgaagtacatgaacctggctcgtgagacctaaatattgtactggtggtgggggggaagggtcattggaatctgtggttagcctgatcttgacctgggagggaaggttgtccagatctctgggactttggaggacaggacgttgagcacccmtaactgggagcaagaagtgggaggctcattgagaccccagcattgtttgggagggacaytggattttgtaatgctaaagaacttaccctgggagacccctgaaacttcacattcctggatctggaggcactaggaatgtggtgatgtgtaccccaaaattttattatgaaaggaacagtagctttggggacctaggtcctgggtctgggagtgcaagaaccagggcattctgaagkccaaggcttatatttcagggggaactggcagctgagatgctagtatcttggctccgagtggtgcagggaatcagagccctaactgctggtgtttgagggcaccaggtctgggggtgcagggccttaattgagactgaggtatatggggctttgtaccaggggtcactgattcctccgtcttcctgtttctgcttcccctcagtccccccttgcctcactggctgctccccagagcaaagccccagagccacaggccctgccccacctggcttcaaccccaggaatgcgtccagcgtgatccagggcctgcagaacaggtgctggttctccctccccgtctacagctctggggatcggrgssgggggggcaattgtccagcccccaggcaacaggggaagggccttggccaacatctgggtgccagcagggcaggggtggggctctgaggggataagggcttttaaaagsctccccagggaggttccccagttcctccacctgctggcccctggacacctctgtcaccatgtggttcctggttctgtgcctcgccctgtccctgggggggactggtgagacagtggggggatgtgggagggggaacgggccctgattctcttgctggcctcacatccccccccgataagaccttcccctccaacaccccaccctcatccctctggcycacagtctatcctagtccggggtgccccggctcttatctatcttgcgcggscccaccctaaacttccacccccgctcctccatgttgtcatagtgytcactcccacaccagattcctgctcctcccaggaagcctcagtactttctcctcttccctagccaacgccctgtcccaccgctttaccaaaggggcagattctgggccatctctgtctctctctggaggaccccaaccctcccatgggcttcccccaccccacaggactctgatcatcccctcctgycccctagttccctgcggccacctatttggctcctgagtctacaaatcccaccacactccagtgactttttccatccagctgtccgctctcaactgtgtcctccagaccctgacatctggtctccccagtccttccagggtcccccaaatttcaccagaaaaccctgcttcccaaactggcatgtgggatcccccayctggtatgkgggggggtctgcaaatgtcccttcccacccagcacccccagctctcccaggaaaaacaccamaccctcccaccacatgctcctttccttggggaagttccatcccgccccaggccccagcccttctctgcctgaattgttcctacacagctctggttttctggaaccccacsccaaggatcctgaatgccttctcagccagcgcttctgccctggcctcccccaagtcagtatgtgattctacaacctcacrtcaagtgggtcctgcattgcattcccacagctgcttggcgcctgttctcaccacttctccaatcctcttcctaggattgcctccaagaggaccccatatccttccagtaccctcagaccatgaaccccatccccatgagaaacgaagatcccatccttcaccctgtccgagaaggactgccactcacgcctccctcctcctgagccccgtcccagtcctgaccgcaactgtgttctcagggccccaacctcccctcakattgccattcctggttcacaggaaggaccccaaaacctctcrgaagcccacctctagccttaaccatagccctttcttttaccctttaaccaggaagccctgaaatctaactgtcccagccaagctggccccttccaaccccaatgtagggaccccaagtcacccccaaactcttcagtcsagatgctcttctttacctctcagacctggtyccctaaagctgcatcctttcctgaacctcaaaagcccaacccaggtcctgtttccctagcctaggagcccsttagccctccagattcttcctcagtgagcctctgatcctgtcccacccttggcgccttgatscctggtttccagaatccytttccactcccctaacccaccacctcccatcccccagccccagaccccaaatgacctgacgcccagatgcagtgtctgctccagacactgtctcctgtctcctaccctgatccctggaggctgctctactgtcagagcacaaaatctccccaccaggtccagccaccactccaaaagcccagggaacagtccagagtcccaccccttcccaacaccccttgcccatgtccccaacctccagccctggtcctctacccgcaatgtcccttcagacccacagcccagctccctctcctagccttgtccctggcctctcctgccaaccctgcccttcctgacccagcaccgcctctgcaggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgagtgagtaggggcctggggtctgggaggagggcatctatgctgccacaggattgacaggccagtggcattccccttggataacctcaggcaagactggggggctgagscagagaggaaggctctggcgcaggtcgcctggcagggcagagctgggctggacacccctctccaaggctgcctgggtctcttgggatctggttctgcttgtgtctctgtgtgactgtgttctggtctctgtcttcctctctctcctctgtctccttgtctctgcatctcccctgtctctgtctgtctctgagtctctctgcggcatctctgtcactgtgtctcaccctccatctctctacccatctctctctctctgggtctctacctcaccgctccctcatccctactaaacacacacccagatggacctaagggaggccccagagtaaaggaagggctttatccccaacttgtgtgcctgggagggggygcctctccctctgtccagctccccgccccacaggatatccctccactctggagagacacagggaagggctggtttcagcgggagctgggtggggcaactgagggaggaggaaggaggaggcggggcgagaaacgcgcgggagggtgctgggaagggaagggggcctcgaccttggacttcaggccaggccacctgcccctggggagcccgcaccacagccccagctgcagctgagccgctctcaggcctcccctcctccctacctgcccccaccctccccacctgcccccaccctcccccagggcctccctcccttttctctcccacactcggtcactcctgcttcctctctgcctctgtttctagttctcactctgacgtcccgcgtcctttttcatttgtctgcttctcgctcccttccrtgttctgttccctcttcctccctcttccctgggcctgtttctcgctgtccctgtcttttatccttctcatctgcctcttttttgctcaccctgtttctcactgccctcccctccgcctttytcacccctctgtccttttgagctcttttttgctstgtctcttcatttgccttttgcactctcaaamtctttcatcttcccattcgctgtctgtatttctccataactatatctttcttcctctgtctccgcccacccacatttttctctttccctttctctctttggggaccctcccccatgctcccctgccccatccccttttccccttcccrtcttctcatccctccattcccatctttccccagcaattaccagctctggctgggtcrccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagaygctgtgaaggtcgtggagttgcccaccsaggaacccgaagtggggagcacctgtttggcttccggctggggcagcatcgaaccagagaattgtatgtgggggcagactgtgtagcccaaggcrgggatggggactcctgygtccaagggagaaagggccagggaagcaggtgaggtcgggctgcagccctttttctcccgggttcgtagtctcatttccagatgatctccagtgtgtggacctcaaaatcctgcctaatgatgagtgcraaaaagcccaygtccagaaggwgacagacttcatgctgtgtgtcggacacctggaaggtggcaaagacacctgtgtggtgaggcagccctgcccccagggtctggaagggctgagggaggggactcagcctstgaactggyttctgagagctaaccaggcatctgcttcactgcttcccagctagctgtagccactcgccccatcagtgccccagctccccctccttcccccgcccatccagggacaactgcatctcaccccccacaccagagttcaccgttcctcgtggtaatgtgttgttaccgtcgagtcagagagtagtcctggagaggtggcctctgcgatgtgcccrcaggggcagcgtcctgcagatggtcctgcccctcctccccctracctgtctgcaggcactgtccwcctggaccctgccccatgtgcngkmgctggaccctgaggtcccttcccccttggccaggactggagaccctgtcccctctgtgggaatccctgcccaccttcctctgggagtgggcactggaggccctgtctgcgagctggggctccccaggcagaacttgggccccgtagacctttctcactctcccctcccaccttgtgctcccagggtgattcagggggcccgctgatgtgtgatggtgtgctccaaggtgtcacatcatggggct

SEQ ID NO: 13387 - DNA, 29871 bp, Homo sapiens
  misc_feature (1)...(29871): n = A,T,C or G, or insertion/deletion polymorphism (see Tables 1-2)
aatacaaaatacagcgcctggcacagacctggtgcttatcaggtatttgcacaataactattttgcagaatgaacagcaggcttaaaaaagcagatgcccatctgctcattcagagcacccagctcccaagagcactacaccatcagcagaaattggaaacattccttcaccaccaaaggtgaggccagcagtgtctgtgactgcaaaacatgtacccagcatggggggatccagtggtcaccgccccattcaaggcaagcacaggtgttttcaaaaatgatctgtaaggctactaagagttaaaggtgtttctgccttaaaagcaaatgaaacaactaaaaagtcactgcccagggatttgagtcttttctttccacttctattattgagagagcctccagaagactacagctaagagggctgttattttcctactagaagagcagctgaggaaaggtaaaacagagcgagaatgatcatctatttactgtacaaccgctagtccgccactaagagaagtatgcaaacaagagcctccagaagatggctattccaccagtacatcaattaaccaaatagtgtaatgatacacacaatgtcactgacatgccagtacatcaatcagctacagagtataaaaccatgtgtggtccaaaaggaccctacaataatccccaagaatgctacgtggcacagtagctcatgtctatcagcccaactacttgggaggttgaggcaagaggatcacttgagcccaggagttcaaggytacagtgagccatgatcacaccactgcactccagccaggataataaagacctcatttttttaaaaaaaagtaaaataaaataaaaagatgctcccatgtgacagtcttacaatgcaggctagtgtctccaaagaagacttactgagctacacagaggaagctggacattaggaatcccacccagaaacatttgttaacccttacgaaatcactgattaagtttcaccagattcactgcttcaactttccaggtacccgtatttaggggggaaaaatccattcaccccaaatgaaatgattactggaccaaaattagttaacccaatcagaactacttgagtggccaagccattatcatcctataaagctggaaaggtttttgtatttctcaaaatcttatgactctcatcacaaatgagaccggaagaaatacaacgtttagcatggaagcatttgaactgtaggcacttttgctaacctacactttttttttttttttttttttgagatggagtcttgctctgtcactcaggctggagtgcaatggcgccatcttgtctcgctgcaacctctgcctcccaggttcaagtgattctcccacctcagcctcccragtagctgggactacaggcgcacaccaccacacgcggctaatttttgtattgtatttttcgtagagacggggtttygccgtgctcgccaggctggtctcaaactcccgaccacaggtgatccgcccgcctcggcctcccaaagtgctgggattacaggcgtgagccatggcacccagccttatctacattttatttcatgaaaagagttgtgggaaaatgtgaaggctgccagtccatcattttcttggttactttggatccttctcctttgttgcaagaatcataaatattcccaattcttttacaggcaaaaatgaaacgtgtgcccaaatatgtcctttaaaaataaacattaaacattatgagggaaacaactggcattgtggaaaatgtctgtgcaccctggctaagcaactcactattgcttggattatattaatatacacaccataaagctaaggaagaacttaaatttgagcctctgcatttctgtgctgagtaagctgtagttctttcgacttatcgccttcatacttgcctgtccaaacaaaaagatctcaagaattccactgaaatagtccaaacaagagcytaaacttacaaagctgtttttcagagctcaatagtacaacaacaggaagtagaacttctgggatggggattttgctatttattttttctttcaatggccacttttaagcaaragagaaaaaagtctacaggcattacaaatcctggaagctatgaatcaggaagtgggaaatggctgatcctgaaatggccagcctgaaaatcctggctcttttatgtagtcaagtctctgaagccaggaatttcagaaatcttaggcattttgcattattttctgaatcttaaaagagctgagacttgagagaaaagagaagggccaggataaatgaaccaataaggaagcccccagtctccagctccatgcccctaccaccacacaaatcttgcccctataattacaagctcagttgggacatgctccttacaaatgacgtttgtttacaatgctgctaaggagagggggtgatagcccatggtttctgcagacagagcctgccccaggcttcagctttctcattctttcccaatgttgaatctggaatggactcgggaccctaaatatttcacaactccaaacaccctgcagttgattaaaaacaatggtcacttttgttttcaggaaagactatacctgatttttgctaagtctaagtaaaatgcaaagacccatgcaatgaacctgcatgaatgctttcagacatgcagatttggagggggacactgctctcttttgagcaaatggagatccagtaacagagcggggctcactctgcaatggctgcatttgcatcaacgtgagacaccaaacaaatgcccgcacacaggagtctactatgtggatcgagggaaaagagggcacctttatccttccaaatatgacaactcaatagaaaacttctcattccaaagtcctaagggtccctacaacaggaagctactggagcttgtgaaatatttccagttattttctacagaaattaaacatatcaattctaccggcaggtcatgtgagatgacaggtttaaaaatgtatgttgattgggggagaaaagcaaagaaaaaaaatagaagaaaataaagtcatttcctgtgtcagttgtaatttgggaggcttttttccagtgcccttctaagtaaatctgccataatcaaatgtagtcaaatataactgcaatgtgcaaaagcacagtgatgacctgagaggaaggtgccactaagaacccctgggaccagtcttctatctcttccatcagacatccactactacctccccaaaaaggctcagggttatttcataaacaccagtagcctcccatgtatttaacttagcacaaataagagaaccaatatgtaagggattttttttgctcttaagaaccaaccattcctcttaccccagcctttacagacctggaaaaccatccctgatttgcccccagcctcatcccccactacaacttaaacaaaccttcctctccagccttgcttccagccccaaaatacatttttaaagttctgatgccaagaccaccccatcaagtctagtataatccttctgatcatctaagtaccctcctccaggagacctccaagatccctctgggcaaaatgatctcttcctccaattccagggctctttcccagtgtgctcactccatcctcactcataaaagcatctggttccattccacagctgggcacaccttatcttctcaagagacaatgtaagctctttwtaaaacaggggctgcattttacacacctcacatacctcctgcaggtccccgaacatccaaacactccaaatttgtctctgtctccaaatcctacaaaaccaaattctctctacccagctcagctcagcatccctggggccccgatctacctcatctgcctcctctgctctagagtaaaagcaacaccagtcacccccactctgccgcccactgtagccgaatccaagtggcactctcagcccatgctcttatcagtgcactgggggcaggcctaccatctaccaagcaccagaaatgcccctccgagctttgtgcagcccccttgccaggcagacagcctccagggccaggttcggcacgggaagctagaacacggggctgactgcacagcctggggcagacacacctcagcttccacacccacctgacaaggctgcccagaggatggagggaagtcagtgtttcacccactgccctaatgggaagacagtgtttctcacccactgctcaagcctggaagcaaaaggtcccaatgttcctactcgatgacccgccctgtcatgccctgtccagatatctaaccctcacctttctctgtccatcaagcagtaagaattcatagcagccagcacatatgaccctgagggcaacgttctaacaaagccaaagaaaaggtggcacactggccttcaattcaaagcccagggtggcaagaaaagggtcactagttccctgaaaataactggcatgcaaaattcaaacaggtaattggggtggagttcatggaaaagggaagagaaaacctcacatgggtttgtatacccttcatttaagcacactgtcttcaggcagcagaggtttcaaggtgcatgctaaamacccttgcgcaggtttcagagagcagataaaaggggctaaccaggctctcaggaagcccaatccgcacacgcacggagccgagccagtggaaaccataagcctgtctcatctgtctctaaactgctcacaggatgaacaggaaggcttgatcgatactgattttacagtcataggagtgactcatcacgaaattctacccagcttaaagctcagctgtgaacagaaacaaaacaacataatggcagggtcagatttaaaatagtaagtatgactggtaaacagttaatgctcataaacaattaacaatcaccttcccagcctcctggatttgctgggagaggaaaaagtactactgagggctctgaagcgggctgcagcagtaagtctgtcttctgtggcagccccttccaactcactgatgctggtgtcagctttacaaaaccctggagggtcacgaggagctgcttttaatagaattccacacatctgatgggtacgtgctcactgaggaggggagagaggaggaatgtacttacatggaacagagttttcagagagtgaaatttaagctctcctggagtataacttcctctatgtagctcctgcagagtttaaaataagcaacttatctgtcctaaaatgagagaaatggggtcatataaaatttctcaataattgagttcctctcaaactgcattcactttaaggaaagcactggggtgctcagaaggtgcactacacatttcaggcatttggttacagaggcgaatgtgctcagcgccatcctgaagacatgtactttcaagtactggattccatgtaaattttaatgatctgtaaccaactctcagacctggccaagaacttccatagagaatcctggtctggagatcccttcactatggcacactgctccactgttctgaactgcatgactgtgtcccctccaattcatatactgaagccccaacccccagataccttcagtggtatctgaaggtggggccttagggaggtaatcaggtttagatgaggtcctgagggtagagcccccataatggcaacaatgcccttacataaagaggaagagaccagagccccttgctctctccaccctgtgaggacacatgacatttgtcatctgcaagccaagaaatggacccttaacagaaaccaaatttggtcggcaccttgatctcagacttccagcctccagaactgtgagaaacataagtctgtggttttagccctcagtctatagtaacctgtcacagcagtctgagctaagacatccatacagccccgtaagagaaccaacccagggacgagcaacacctctcatcatctgacaccacctcctgcctgacgaccaggcaaaacaagcacatacacaaacaagcaaaaggggaggatgagagtggtcattcgggtttgctttggaggtccagagaaaatgcaagtccaacttccaggcacagaccagttgcycgcagcaggcttcctcccattggtctcagaccaaggtgagccactcccccgggcgggacagagaaagctcctctggaagccagacaagctcggccacctcgaagtcttctttggaatccagcaggtccaggcctgagccctggcgcctggttaaaccaaargatgacaaccaagcagaaaaaaatagccccagagagtatctgctggagaggcagacaggcggacctggccttcgacacacagcatgcgtgccatggtctctagcagcgcgtccctccaagcttcctggcctgtaaggcgaagcctctagcccttttctacttttaggatgctcagattcttgcctgcagaggtcaatccctttctttcaagggctcccccctctgtaatgaggsagtccatttacaataaaaaaaaaattgagctgtcaaaacaaatgaaaaacttccagtataatcataatcagtgagggaatcaaacatctaaacaaatctctcttctggaaaaataagaaaatgaaaaagcaattacacgtcacatggctgattagcaataaatttcatttgtgactacrgtggcatgagagtttgactcctgacttgctttccttgaaagaaaaaaattatctgcaatactgtctcttgatatagaaaacagacccattccatctgactcagctcaaacctgcgttttttttcaaggcctctcctgacctcacagttcccccgcagtgatcccgtggtacctaggaccgccatggacaaggactggtctccttgaatttgtctccccaactattccacacatatactcgcataaacaattgagaaataagctttttaaaattgtggtaaaatatacacaacaaagaatttaacattttaacccttgttaagtgtatagttcactgacactgattcacaatgttgctcaaccaccgtaaccatccacctctagaacttttacatgttcccaaactgaaactctgtacccattaaacaccaattcctcattgctccctccccccagcctctattcaccgcccctcaccattctactttccgtctctatgaatgtgactactctacatagctcacgtaagggtaacaattatgcactgtttgtcctttcatgactggcttctttcacttcgcagagtgtcttcaaggttcacagacattgtagcacatcatagaatttccttcctttttaaggctcaatgatattccattgtatggatagaccacattttgtttatccacccgtctatggatggacccttgagttgctttcactttttggctattttgaattatttgctgccatgaacatgggtgtacaaatatctgttcgagcccctgctttcacttctttttgggcatataccccaaagtggaattgctggatcatatggcaattctatgatgaatttattgaggaagcaccatatcatcttcctgttaaaaaaaaaaaaggctgtgccattttaacagtctcaccagtaaggcacaagggttccaacatctccacatcctggcctatgcttgctatcatctggtgtttttggtaatagccatactaatgagtatgaagtaccaattgtgggtctgacttacatttcaccaatgactagtgactttcaacatcttttcatgtgcctatttgcctcaagtagtaagttttaaatcaaaagaattaacccctcctcctaagagacctctcatcacagaaagcaaacagtagtatccttacctactagcattgttaaattggttagtctgggctcaaaacacttttgttttccttgcaaataccaccataggcaatattcgcttagcaaagaccattcaagtccatctaccaagttgcctaaacaggactaaccttgaattctggtctcaggaagaccttgtgcgatccagggagcagagcaagagagcagctccttctcgcaccatcctgcatcaggcaacacactgcagctggcttcccacctgactgaagccttctcctgttctggcagccatgggccgctccagctggggatgctcatccttgcaagcagccatccacgcacaaagggcacaggttctcagggttctccacattcaatttaaaataccctaatttgtgttgcagatacttaatctaagtgtttttcagatcctgtgccctaaattttggctggaaacatagtcccactcacatccctcatgctcgtgaccaggctcttccccaggccacatgacccccaattacctccccctccttgaagaaggaagagactgaagggcgaagggacatccacagttcacattgataacgcaaatgatccatcaccatggcctcaaaagggccttggaatccaaatgacccacttactggaggaggatgcttcaaacggaggcagatgcagagtcaggagggagacagggacagaaaaggaggaagctgtgctgctatccccagtggagcgcttgtcaaactctctttacaagaaatgaagctgggttcctgccgggcgcggtggctcacgcctttaatcccagcactttgggaggccgaggtgggcggatcacaaggtcaggagatcaagaccatcctggctaacacggtgaaaccccatctctactaaaaatacaaaaattagtgtggcagcggacgcctgtagtcccagctgctggggaggctgaggcaggagaatggcgtgaacccgggaggtggagcttgcagtgagccaagattgcgccaccacactccagcctggacgacagagcgagattccatccaaaaaaaaaaaaaaaaatgaagctggttcctaattctgcagtcaaaaaaaaacggcaaatgtagctaggagcaaaacatcagaatcaatacacacccaaagggtatttttttttttaaaggaagtaaataacttctaatgcgtatttcctctatccttagcaacaatagtatcagctaactcctagtgtttataaaccctaggttctaagaaatgtgtatgtattcactcatgaagtattggtaacgatccyccaagatgggtgacactttttttttttttttttgacatggagtctcactctcgcccaggctggagtgcagtggcgcgatcttggctcactgcaacctccaacctccaacctccaacctccaacctccacctcccaggttcaagtgattctcctgcctcagcctcctgagtagctgggattacaggtgcatgccactgtgcctggctaatttttatatttttagtagagacagggtttcaccatgttagccaggctggtctcgaactcctgatttcaggtgatccgctcacctcggcctcccaaagtgctgggattacaggcatgagccaccgcactcggcctgatgggtggcattatcttccattttacagatgaggaaaggagagcagagagggtcaataacgtgccccggtacaatgcatcagtagacttctaattctccaaccctcatctcagaggggaatggtgtcakgaaacaagactggggggaaaagggagaaggcctgctttctagtcgagaaaagcggagaccgtctgaaactctacttgctccaacaggtsaacgtgattgaaaattcagaattcactctcctaatagcaggaaagtrttacaaaagcccacaggccaaatgataccaccctcccaggaagtctcttgcagaactgtgttttttaatgttatttgtcaagtgaaaacagttacagtggcagaacaggcagcacccagagagtggcactaatcgtgggctaaggatgggcaattgcttctcatcaagaaccacaatgtgtccagtcaatttacaaacataaatcaacacaagttcaaaagcaccagtagcaaagtccaggcctggatgtgaagctggcacccctctttaaacaaactgttcctcttcacttgcatggtaaggactggaaagagccctgccgcgttggccagctcttcagggtagcgggggccacygccctctcccagcctcgggaagcccaaggccactgcatcagcctggcccagcccagaaccagcctcgggcccagccggcccaactcagaaaaaggcaggggtcagtctccagcctggactcctctaaaaatcagaaagcagtgccccagcaaaygaacaacaacagcgctcacctgaaacagtttcaccttcatttttagaggagaggaacacaataggagggcgtattactccacgggttttaaccctagcccttgatgctaccaggtatccatgatgcccctaataaaggtgacagttcctycacttttctaacatccagctattctttaaaaaagttgaacactgcagtttccggagaactttgctatgtgaattgcctcactgcaggtgtgctctcccctagctctctccattccatgccttaaaagtgccaggtgtctcctcgggagctgccctgtgctaccgcccccagtcctgcagccaacctgttttgcgggtcctgcctctccatcaactgggactgctctctcgacaaaccaccccagcccacagctcctctggcaacccagcccctcacaccgaggacccatctcaccagtcacctccctcagstgggccaacctgtccagtccattcctgcttcctggtctcaggtctagagacaagacttccctccctgagcctgtcctcactgcctccctcatctataccatcactggctcacaccggggtgtctatctgtcccccaatcctgactccatcgagagaccagagcagcctccccagaacacccttctcagcgggtccactgcaatggtgcaaaggtttcagcrctcctcattctctagccagcagtcaattccttcccaccacacaaacaccggattctgacaccctctccactccatcagtgcacactgccacccacaccacacatggtcccttcctctcctggggagctgcctccttggatcttgagagtcaaatatttagggcacactaaagtcagacatcctccttaaagcttctcaagccattctgcagttccgtgaccccactgcctgcagcccacatacttctctccggtcagcatcccataacttagcactaaactcatagcatctgttactctccaccagtagttgagttttcccaactagacaacaagctcgagtaaaaaaaaaaaatcatattctttcatatgctttccatggagcagagaccactggaggccctcaaataatctagatatcagaaacagggttccatactctgtcaccactcaccttccactcccactccccttccacagatagggacatgaccttgaaccagtcagcctggttaacctaaaaacccattctcttcaggcacagagaagcaaggtggttacttagtggtttcaacaactgacctgagactcagacgtccgggttcaaacctttcactgtagatgtgcaaaaaaagaccctccttggccagccacagtggctcacatctgtaatcccagcactatgggaggccgaggtcggtggattgcttgaggccaggagtttgagaccagcctgaccaacatgcctaaaccccgtctctactagaaaaaaaaaaaattagccaggcgtggtggcacacgcctgtaatcccagcttcttgggaagctgatccacaagaattgtttgaacctgggaggaagaggttgcagtaaggcagaggttgcagtgagcggagattgcaccactgcactccagcctgggcaacagagcaagactgtctcaaaaaaaaaaaaaaaaaaaaagggccytattcaactggcagcaattccccagtgttgtggggaaggaggactggaggccccagagagagcccaccagggccacccaccatgaggaggagaaaaaaagagaaaagcatccatttattggatgctttctatttgccaggtttgctgggcagcttggatacattatctattgctaattctcattggcatccctgctagagcagtgttattccaatcacaggcagagacactgaggcctggagctccctttccaacatgcctccatgcgtgggagagagggagacagtgaattgtttgaggggacaaggcttcaaaggaagccctgcacatatgcaaaccgcacggagaagagcagagcaaagacaggccaggctgtccagctaagttcacatccagccggttcagcattcacatgagaatttcacaagatgcttttttacaagctactcttgaatattaacattccagcttcaaatgattatgtttacattnnnnnnnnnnnnnnnnnnnnccaccccactcctcggaagaggagactttaaggataatttctaaggtgttcattaagttcaggagtccccttgacaccaacctagacaagtaagctttcttctgtccagaggtcgggagctggcctcaccgtcgccctaccaggacactgtcaaaggccttcaccagcaaccaaaaccggcagggttggrgagggtgcttcaatgatagagagacctgtaagaccttgctactgtccctcccaggagtgaggcaaaagcttactggcctcaccaagaaaacaatgcaaaaaatagaagccaacttccatacgtggtgattctgcttgttccaaccacatctccctcaaatctccatctctctctctgcctagtatcttgagatctgaaggctggaagggcctgtgaaatgacctaggtccaccctgtaactcaaggtcagcaggtgtgcaagyaccctacccacccaactttctgagatgccaccctggccctctgcaccaggccactccggagaccaccaggcagccgagtccagcctgcagatgcttcctcctcaggaacccagctccargagggtttaaaagcacactacagacataaatcggtgccaatgaattattcattacatcttatctatagggaacttatggaacaaagtctccatcyacagggatgaggtgatcttgacacaaggccagactcacaaattacccttccaggagttctaattttttttattcacctcaatgtgcaaaaagcctaatcaaacaatgattttaaagawaattttattgctttcaagttccatgcagcagtaactggtgtgataaaatgttttggctagcagaggtgcaatgatcagatgaaaataaatttgttgtacaaagaagtgcttcaaagtgaatggcgagtatccctttaagaagtcttccgtttcttcagctcctcctatgcaccaggcactgggccacctcctgggaattcaaagataaccaaggtaccattcccctccccaatggtgggggaaagcaatatgggggagatgcccaaataggaggtatagcaagagaccacaggagctcaagtcagtgcaatcattctgcatgcagaatcaaggccagagagagggtgaaattacagctaactcttaaaggagcttgccagagggcaagctgrtagtattgtttgctattccaagcagaggggcttccacctgccaagacaaaragacacgaatgagtacagcctgaactgttcaaaatgtctgggaggaagggaggctgaagttctctctcagacagccaaacaaagatttccgaattaaaaataataaaaggcaatcatggggaaacaggtttaaggcttttgacacgtaaaactgaataaccagctatatattttgtgtaatctcagcaagaaagattctgaaaatatcaataaaacatgaaacaaaatacataaaattagctagcgaaatatagacggtgtgggacctaacacaacactggatgtatttattcttattctctgtgagtatttctggctggcgagcatcttaaccacatagaatagccaaaggggagagagaagagaatgaaagtgttactacctgtttaaatagagcaatggaaggtaaatcttgctgtatttttccaaatgaaatcagtagtgtttttttaatctctaatctcaaatattttggagctttaaatttattaaagtcctgtaaaattatcttaaaactctaactgtaaaagacacactaggtgttaacagctctgccatggagttgcagtrcgcctgtctgcatcacttaggaagaccctaattctctcaggacagctcgcactgacacagtagagtaaccttaatccaaaactgtagcccagtgatttctacagaagtctgtagtatccacattttcttgcaatcagtccccaggaagcaagccagagagtgggttgggatcgctatcttcctccttggggcactattaattcagtcacctaatatgctgaatttcccttctggccactagatggagcctatgcataggcgagatgggcaaagtgcacactggacacctctcaggtgtgagcagaaattgacaaatgacaatattaagggagaaagtgtaataaacagatctctgaaatggaaggcaaactgcagggggatgaccatcgtttactgaaaaaaaaaatcacaactgtttaataagcaacatgccatcttgttaataaacaccttagcaaaataaagttttattatacatttattgagcacctatgtgccaggttctataacatatttaaatggcaaggacaatcaaacatcaagtaagccttatatttctatccaaagaacatctctgttcgaggatgtcacaaccctaagaacagtagcagttgaagtccaagggcttaataccaggtgccaggttctattctaggcacttgacatgtgtacgaatttgatttctatgaatgtttaaagtagattctattaaaattataatttcacagatgaggaaactgaggcacaagaagattaaattatttgcctgagagcttagctastgaagagctgagattcaaaccagccactttggctccatggtcctaataaaattacaagcaaggaacaagacaaatcactgtcaaccagcaaaaccgtgggttatgaactcaaaaggagtaatgggaaagtagatctatacaagttagggaaatcccaaaaaccttcaagaaggaagaggaatttgacttggaaatgtaaagatggcatctctgacctattcaaaccacagaaaaggcatatgggggaaaggaatcacctgacttagcgtgctgccttttgaaagttatgatcttgtccctattttacagatccacctggaacttggaaattatttcaatttaaaaaacctattctatttcctcacaatttttctgactttggttttctaaacctgttagaaaaggttttcattctgttgtttagtgagaaaaggagaaatgtctcccccaaatatttttaagtctccgcatttctatcaagactcagaaaagttaataactttaggaccaaagaactaattggcagctaaggagaaactaaagctatggtgaccttcctgtgttcttaagcggcactttctgctattcagtattgaggatggaaggagaagtagcagagtagtgaagaggaaaaacattctcagctatggaaacagcagaagcaaaaacttgaagacaggcataacacagcttcctttccatcaagctaatgcacagatgctggggagtaccaggaactaacagtggatccctacagcacaggattactaaggacctgtttcattacttgattctaaggaccctggacttgatcctaggaccacaagaggcacgttctgagtatttggagctggcaagtccatcagactaagggaatggtacaggaactggttcagaggccaactcagcatgtagtcagagtcaatgcaggtctgcactggaccaggctggatcccggaataggggtcaatctgagcgatttcaagtgactcagtgagatcgaaaggcaacattcaattaatgagtctccccagaaaaggacaggctgcagaactgaaactgaacaaattccatcctgagccaatctctgttgctgaaaattttactgaggtgcatgtgagaaagaaaatcccaattgtatcacctgacgaagaaaggctaccataacaaaagttctgtacctacgactacacgatatcatgttgtgacctaacatatgcagtgaactcattatccacagaaatcagacaacagaactaagggaagcctcacagcagatctccctctgctgctactggtctctgtgttcatttgttttcgtggcaatctgtgcttctctttaaagtcctgagtctgtaagcttgtgtattatcccactaaaatgagactcagggaaattaggtaaagagaataaatacaggacaacacagataaatgtggacacaactgagagggattttacaatctagacagaattaatagctaatgacttagaaaacactttgtaagctgatgcagtcaattggatcatgggctcctacctggaatttctctccatgcttcctactttttccaggaagttatcaaaggtcactaagacgctttgaatttggggaaaactcctayaaataaattcatctctccctaattaccattagacttctgttctttaaagttctattgactaaactttggctgacttaaattggtgatgtctcatttacgtaatcaagcacatattcccaataaccaactttacagagactaaccacgactatattttttacagcagaggacaagctgaaagcaatcacaatgtatcaggaaaaatttcaagttatgctctataaaatatttatgctctaacaactatcaaaatatatttgttctcccatgtcaagagtaatttttaaagtggtatttatttttaaactgacaaataattccaaagccagtttgagaaagctagtgccatgttaaaaagaaaatggttgaacaaaagtatacaaaacagcaacaacaatgtatttcaaactygcagaatttggacgatggacggatggatggagatacacaattctgaacaaacggcattcgtattatgtaactcttactgaagtagagacctatggtattaagggggctaagactgaggagtgagataaaacaaagtttcaaactcctccccgcaagaactttctggattagcaagactactttctaaagtctttaaaatatgcaaaaaaacaaaaaaaaaatgttttccagactattaccaggtgagcaatttatttttatatatgtattttgtgtgtgtgatggagtctcgctctgtcacccaggctggagtgcagtggcatcatcttggctcactgcaacctctgcctcctgggtttcagcaattctcctgcctcagcctctcacgtagctgggattataggcacgggccaccacgcccggttaattctggtatttttagtagaaagggggtgcaccatgttggccaggctggtcttgaacttctgacctcaagtgatctgcccaccttggcctcccaaagtgctggggttacaggcaggagccgctgtgcccagccaggtgagcagtaaggtaggcccagctatcgctgcagtgtgtgatggccccatccacaggtgtgcacatcttccccatgtgactagccagccgccccactactccaaagaatgtgaatgcttcaagaccaccaaccaccaagtgagctccatggacacaaggcccaacaacttatattgcaatcgtaggtgttcatccctcaccataaaagaaactactttctgttgtggtccagtgaaaacagaagagcaatctatgagtttacaaattcttgtaggctgggggyggtggctcgcacctgtgatcccagccctccgggaggccgaggtgagtggatcgcttgagtccaacctgagcaacatagcaaaacctcgtctgtactaaaaatacaaaaaattagccaggcatggtggtgtgtgcctgtagtcccacctacttgggaggatcactggagcctgggaggtcaaggcagaatcaagccgtgatcacaccactgcattccagcctaggtgaccagagaccctgtctcaaaaaaaaaaaagaaaaaaaaatctgtagtccagggcaggaaaaagaaaaattttaagcttgcttactagtttgtttcgttttatttttttttttaataaacatggcagtaacatctatagtttgacgggtatctttaaaaacttatggtaagacattttacagtatcaaataatttctaaacctaaagaactgcatccagtaagtactcaacatgtatttactgtggaagaaaagagggagggaaaacgactatttctcagttcaagtaaggaaatatcagtttttccttaagatttgaaaataaaacataagtaaagccggcatcagtggaaaaaaagggagagaaatcttcaaaaatggtatctgggactttcaaacgagtaaaattgaccatttaaaaacttagtcttcaaaagtccaaaagtctcaaaatcaaaggtattgttaatactttgagtcaaataaaaccaaagcaatttaacaaaagaaaacatcatgccgaggaagtatgcttctcttgagataacaatctaacttgtttwaaagatcctttgtttactaaccattttatattccaaatatatgttccttcctcagaacaaatcaattcttttccagaccctcggggatgggggtgcaggcatgaggggatgtgtacatatatcaaagttttaatcttttcaaatagtggaactcagttatgcttcccaaatgtcaacaggtctcaatgtccacaaacactggggctgctaccctcccccatccccacttaaagccacatcacatctttacaaataactggaaaacctcctcttgctaagctgatgccaaacaccattttccaggagggatcagagtgcatcactcattaggcactttgttgtctctaaagtgttcagaattttccttcagaacatctcagactggaaatcaagaaactatatccgtaacatgtgtgcaactattatatatttagtacaattgagaagagctcatcccctggactcagcacctgtcctaagctggctaagaaaagcagttcaaatcaagttcgcccacaggcgcaaatacctcttccatgaactaggtctgatttttaaatgagttttgaaaacaaattggggaaaatcacaacctataaagaaatgtatcttgtatgctttacaattaaaaaacaaaaactttcaggatttgtctcctcactcttactccctcacgcttttaaaaacaccaagttatttacaaattataaaatgccctgaaattatgaatgcttcctgatttctagaaagctaactaagcaatatgtaatccagaaaacttctgaaataagttccatctttcttacaactcaaaacatgctatgcaacgttcatgtacacacctgtgactcctaatttttggaaaaaggcaactacaacactgcagtttgtaaatcacaattgccatatccaatgttataaagaagacagtgccgccagtcaagatgggttaacatcacctgtatgtcacagtctacagtgacatcccaatataacggaaagcaccaatgaggcaaaaaaggtatagggtaaaggcttctgatgaacaacactagagtcctaagtctacagaaatatttttaaaagaacctttaaaatgctaactactgtctacttgaaaactgcaccctatactgagtctgaaaaaaaatctgaatttcaagaaaggtggtttcatgcaagactctgcaggttcatgcactgagtagcacaaggtcagctttcatacagtaggtgcacaataagtgcaggctggattcagttgcttcttacagcacattcttacaaaacaaatgaaaccagatttaaaaggaaaccaccgtcccttgagggttcctcttggcaaaaactctaaggcaacaagtgaaaatgatacagttgattttcattactgccctgatcttgcaacaataggaagggcaggaaacatttttattagtaaactaagccttagacaaagaccaaaagcaaatgtaaacaacaattattctctaggtcttttcctattgaaaggccagggtaaatctggataaatgcacacagtttcaaaacaaaaatgcctttgccacattttaaaacctttcgttctgtaaggaattttaattttataaaaatcactgtatacttgaaacagtgtatcctaaaactactgcatcctaaagattctttctcctgctcagaccctggaactatgtaagaaataaaataaaactgcaaagaaaagaaacaacaatactgcattaaaatgaactgttctgttcatcctcagtccttactaccacttgtggtcaatgtggcatatcaaaaaatgagtgtttaaaacatcttaaaacagcaatgtctttctttgttggaaaacataataaaactggaaatacaaacagcccttcagactcagctcctaaactctatcctgaaaaaaaccatcatttcagattcagctgaggtttctattgtcaaaaatctgccctccaccagcatttgtgttttttaaatccagctcctcaatccctaactgaagctacatagaaccaagattctttttctcctgcttgcccatttctactgcgggattgaatccctgttgctaagcttcaattatcagtttgttgtattgctgcaactcacggatctgaaaaactcataaatgaaaagagagagagacatcagcctgtcaaatrtatgtaataattttaacgtaatttaaggtagcataacaagttattttcaacctgatcacatttctttaaaaaaaaaaaaaaagggtttattgagatataattcacataccattaaagtccccgatttaaagtayataatccaatggttttaagtatatttagagctatgcagccatcgccacaaactaattttagaacaattttcatcaccccaaaaagaaaccctgtgcccacyagcagtcactccccattccatccgcccccagcccctggcaaccactcatctaccttctgcctctatggatttgtttattytagacatttcacataaaccggatcatacgatatgtggtcttttgtgactgacttctttcactttttgtgatatttttaagcttcatctattcaaccttagcatatttcttagagttgaacttttctaatctttttcgacaaatcaaacattatgaccttttacatttcaaatcctgacacaaaccccacccttccacaaaacaccatttgcttgctatgtctctccagaggatctaaactataatttgctgtttaggttctttcagaagttctttttctgggttctccttctggtaataaaacactaacttctttaaacaccaacatttcacatacctacatttctgtgacaacaggatgcctggggtagaaagatgactgaatccttttaaggagatgggtacaataaatttaaagtgcatgctgactttttaaaaacaaaatagccctcagattatctggctatcactcagaacctccgaaccgccttcatttagatgctctgttcacattatggtgatacaaaacaaacacatccatatgactgcctctgcttcagaaactaagttttctaagataaacaacactctttctactgccatcacactcaaagaggaaactctaatctctcaatacgccagcaaaatacctgcaactgaaccaacaccctgtctttwtttctycaccagacaacagctgaaagaacgccctccctgatagggctcagcagcttatttctatcagagttaagtggtctagcaccttcccsgctaaaaactgaacgcccgttcacaggcatagcttttaattctccacatttcagagatggagggaggggcaggtactgagtcagtcaagacttcagcaaaccataatcgagatttggggtgccttctgaccacccatcaggtttccaggaactaaccactgtaaagggatcctggggggaagctttggtatcatggagtaaaaacatacattaaaacaccccctccctyctgcctgtgttctcaaaaatcgccgtcttgcacaaasaatatccttcaagaagaacgctccaaaagaaaaacagcctattttaaaatgcccgactcctgcgtcggcgaaggccatccctrctgttttgaatttcagaacattaaaaacacaaaactagagaagctatacagttcaactgcataacataacaaaatggattatttctcccgtgtcttctaaaccgtacttatcttttaaagataaaaaccctyctttgtccccccagccaccacctaaacgacttagtaaagggagccggaaggctttcgcccaatcgagtccgctgaaagtttagaaaacaaagagcaggagagcccagatctgtggaaggtccggccccagtccgcgtcccactcggcagtaaacacgcgaaccacgatmtgctctcgttccgtcgcggactcatttcttaccagacgtttaaggatttgtttatagaaacagcctttctgaattgccccggtgatggggccatacaacctccgctgcctcctccttccccgcctcactcgtgaaggctcagtcgtgattttttcaaagttaatcggcaccacctgcataccctcggcaaccattactcaccaacacgccctcaccgttcccagtcccagttctgcgacatttaaacttttaatcgtgttcaaattaccctaccatcttgaatgtaccagtaagccacactttcaactttttcagaagaataaaacccccacctcctccggccgtagacaccggggggagttctcgctccccgcatccccgcgcttccctactaacccccacccgacaccaccaaaacaaaagctatcagattgcaaaagacagcgaatgtggagcgacactgcttattaactacgtacaaaggaagtgcggggcggcagaagagagggcgacacgacgccgaccacaacaaaaccaaggccagggctccgcgctcgcaaaacacaacaccctccccgcgccgccgcagaccctggcgctgaaaccacagcgtacgacacctctcgccagggacgggcgtctaggtgtccccgtgaggcggcgactacaccccgcgctgcgagcacgtgtgtcggaatgcacgtcggctccgaccacacacccaccaacgcacactcggatgcggccctagtacccctccatcccccggcccgggagaaactgggagaccatcccagagccctctgaactggggacccagtggcgctccccggaagagacaagctgaggaagactcccggcctcgcacttcccggggggctgcccagagagcgcttcccctcaccccaccgcccagcccygggacgccgggggcaggtaacccaacgaggagcgggccaaagtgacgggcaaggccaggaacccgaggagcccgaggggcaaaagcacgttgggcgacgggaggcagcgacgggcgcttggagacgtgtcctggggcttcggggcctctccgcagggcacctsccccctcgagggcaactcgcaccccgcgggccgggcggctgcccgctccccactgcccggtcagccccagcagcggagacgcggtgcggcccagggtgctgtcgctgctgcctgcgcgccgcagggggatcagcgctgtgtgcggagaggctcktgcgcayggaaggggcgaggtgcgggtcgcggggcccgggaaccgcggagcccgccccggcaccaacttccctaccgagtcctcgcgcctagccgggaaacacggctgggctgtcaggacggagaaagagaaaagcccttcccgcgcggggatgcgcggagccagggcccgcggggctccagacgaacgagcccgggtcccgggtccgctgcagcctccctcccggcagagccgccctgcgccccaccccgccgctcccgagcccgggggcccgacagctgcgacggtggcaactcgggtttcgcaaacagggcgcagcccctcggaggaaaagttcccgcagtggccgcgggcggcgggcacatactcactttctccactcgtcggccagagcgagagcgcggcggagagaaacaggagcccccacagcgaggtcggggaccctcctccggagccagacttcattccttttatttgggatgaaattcccctttctcaaaaaaaaaaaaaaaagaaaagaaaagaaaaaaaggaaatgaaaggaaacaagtctcaaactcagtcttcgctccccctccaaaaacaagggcgaaggaaacaatactccgaaggcggcgccgccggggccctccgggtgcgcggacggggcgggcggcgcggggcggcccctcagcgccggcagcagcggcccagggctcggcggagtcgggaacccgaggcgcgccggggcggactgtcggcgtcgtcggcctccattttcaaacccggagaggcaggaagggggraaaactgcaaagaaagggggcaaagcccaaatctgcctaggcgaggaaaaacaagcccggccctggccgcgcgggaggcggccggacgcccgagcttccgccgcgggagggcgcgacgcagttcgcaagatcgccccgaagtccgggtcacaggcgaggccggcgaggggcagaaacgcggagtcaaaatgaatgagcggctccccctcctcctcctcctcctcctggctccgctcgccgccgcctcctccctcagcgccgccgccgccgcggcgagctccttcccaaatccaggacacacacaaagcggcgggccggccgcgccgcgctcagcactcccgccgcgccgcccggctctgcgccgccgcccgccccgcgccggcccccgcccggcccccgcccgccgccgcctgctctgcgcgggggctccggctcgctgaaggtcacagccgaggcgaggcgcgccgtggagctgcccccgcgcgggaggggcgtggagggcgcggggggatccggggagcggggccgagggtctgcgagcgccggccgtgggcaggctcgctggcggcgtccctctcgctctcccgcctctctcgagttcgcctggtgcgctcgctcctcctcgggttttttccctttttttttccgctcagcggagttaatgctggtaaacaagagccccagcctcgccgcgccgccgccgccgctgccacacactgggggctcgcgcgcgcgcgcgcgcgccctggcccgcgcacacgcgcccgctcgcacactcgagcggccaccgccgcagcagcggcgcgccgagggcccggcccaggccggcgcgcgcaaaaaaccggagcccgggttccccaagacgtgcggagcggagcccgggcgtggggcgcgagactgcgaggcgccgccccccatctcccgccccaccgcctcccgcgcgcacacagagacacgcgcgcgtgcccacccgctcccgcccccaccgcactgcgccggccaccccgcacgcgccctcccctcccgcccgactccaaaaacaatgcccccgccgccggtccggtctcggcggggcaggggtgggtagccagggaaaggctaggcaggggaggggtgggcaggagaggggaggggtgggcggggagtgcggggctgggagaggttcattgaaaacaacaacagcgcggctggaaagcgcgtttccccggttcttgaaaagcttcattgtttmttgcagctgttgcaaaataaataaatgcgtgcatgcggcatttttttcgctgcgtactggaaagcccgaacgtggcggaaggggcgcacctgggagaaaggggacccccccccccaggctactacgccgggcactttcacgccaggctggggtgcccgcggcgttgcgaccgtggagcccggagtttgggggctcagggggagcggagggggaagggcgcggcccgtgtggctcggcccagagtggctcgaggagagaggaccccgccgcccctcgcgggccccgcgccccggaaggggggcccagacaggcagcgccgcgtgccccgggcgcgtccccgcggcggccgccagagggcgcggcgggcgctggggagggcagcccgcggagagtcgcctccctccctccgggggaggaaatgtgggggcccgggctgggggccgactcggctgggtcgcgctggcgtggcctcccggaccagccgcccgccctgagcgctctccgcggcctcgcgcagctcagggctccaccacgtgggcggctgcggggagcggccggggcgcgtgcacgctgcgggtctccgaagctcggggggcgtgtccgggtcccggggcgccgaggagggggtggaggctggggccgggaagcctcccttggcygcggtcccgacccgggaacacgccgcatgcactcgggatcagcggctactgcggaaacccacccgcacctgtctcgggtcctcccaggcacgttcctcttgcttcgtttgctacgtaagtgactggaaaccagtaccgaccctaagtctccgcggttgttttcttgaatgtgcaggagsagaggtttccccaaagcgagactcccctaggactgccatctaatgaataaatgctgcggagaccaggtcctcaaagagggaaacagcycagcagtggcaggagagaggagtttgaaatacgtggacttttacaaacagtgattggaccrtgtgtcgcccttaatgtggtccggtttcatgactcaggctaattgatgccagtaataaatttttttaagatagctaataaaagagttgtgaattgtcgagataagaagtggttgtctcaaacaatcgggtaggatggtaagaagggacctgatgtaaaggaaggtagtaggtttcttttactctctaattctaaaatacttctgcattagaacgtgtatccatcgttcgtaaataattttttaagagctgaaaacaagtcaaaagctatcataacggaaacttagccctttttttctaaagttgtttcctagatcattttcctccttggaaatttctagctcaattcagagtcagttgtatagaaagaaaataaaccttgttttacctaagaaagttattcatatgatgggatggttttgtttaactgaaattcagcttgatttttaaataaagagtttcagttttggatgttcctagatttaacagtgaaataaatttattagaatcttaaaatgtattatttaaaaattaggcactacacatgaagaattaaagtccagtctactaatttttaaatatttcttaagttctctgcatgaggttggtcttgattcctgcagatccactctggarttaaatgcaaaggaatattgatatataatttcattatacttgatttcagaatttttaatacatacttgtaagacaaaaatttagagctgatttttaaaaggctagtgctaatataaaatcttcaaatactacccaatgtatttttagtattagtaataaatatgcctgtttatttgtccccaagaacataaagaggtctatagaatttttaaatgtatataggttgttgtaggggttgtaggatttgtttttgtgtgttttttttttactaaaatgatttttatttgtgaattttttaaatgtttgtgttttcctgaagtagtaggaaatcaatcgtattaagttattttaaacagtgaagtgggagatgtatcattatatagcttaatatttagggaaaaaaaaggaacaaaaatttaggttgtctttacgctctaacttgaccacatggacaaaggaggtgatttgtatttcttcaatgattatattttacatacacaagtcaaacttattttttcaaccttgaaataaaatcatgtagacaaaaattaattggagtctttgctttatacccacattgacaatgcaccaaactttttattttataccattttactcaggtatcttataggttctccctcttttggagcagaaactgattgcttgttttcattttttaaaaacgccgtttacttgataacagtttcatctcaaattattctgctaaatgtaccagactccccaaaaaatgtaatgtatatcatatacatcaagtgcaaacgtgagaaacagcacaacaattgacaagtatcaagtaatacagtatattgtgatgtattcgcagaarggaatgttagcagcaaaagtgaataaactacagccccacacaacatgggcagatctttgaaacacactgagtaaaaatatacaaatatcaaaaacgcacacagcgtaacaccattttgataaagctcttaaaaagcaaggaaaactttaaaagttacagaaaattttttttgctttaaataataaaataatatttttcctttgttttgcttttgttttagcaaaagaattaatgaaggatgtgaattcctttggagaggatgagaagcccatagscacatgggtttccattgtaatttggaaatgagttcactcttggattgagtgacggatttacaaatttccattttataagtatgcttaataactaacacatgttctacatatttttgtatgtataaaacattaaagaagataaataaaaatatgggagagatccatgaaagagatcattctggttttccaatgggagtcgttcagatttcgagctgtccgtataaataactcagaagcattaaagatctactaaaataacacagttaatcaaggtctgatccttaagatatttcagaagaatgtccacacatctaatatcgatgcaatttaagacaaaaatcaaaagacaaaaaatttaaaagacctcacttcacaggtaataagcttcattaagagtgcattatgtcaactgtttgacagtttcttataaggtaaaacatacaactaacttacgatccagcaagtctagccctagttatttacccaaaagaaatgaaaattccacaaaaatacttctatgggaatgtcaataggtgctttgttcataatagcaaaaactaaaacaacccaaatgtaaatcaaaaggagaatggataaacaaatcatgatatatccattcaatgcaatactgcttagcagtaaaaaggaatggactactaatccatgcaaaaacataaatgagtctccaaagcataatgtataagccaaaagagtacatactgtattagctcatttatgtaaagctcaaaaacaggcaagattgatctagagctagaaatcagaatcatggctgccctgggtgggtagagagggaaagtttcaaatgactagggagaggcataaagaactttcttgggtgatggcaatgctctatatcttgatggggtgttggctatgctagtatatgcatttagcagaaacacatcagactgtacacttaagatgggtgcacttcattctgcataattgtatctgaatgttaaattgttaagattgtattataatttagatagttgcagctgttctaaaaaaaatgttagcacaatgcttcccgtttttactattaggtgagttagtagagatgctaaactccaacatccttgcccacagctgtctacagatgtgtatactttcagtgtgtatctgcctaaggtctttccttaggggcattagctgtggaaggcatcacatggtctccacagagcaccccaagggcaggaaaaatacaagtgatgctgtagctgattcctatccccacacagccacaagcaacaagagtctcagtcttgttgaggatctgtttatactcaacttg

SEQ ID NO: 13388 - DNA, 19986 bp, Homo sapiens
tgtacctgttacccaagcttagtgattaataacgtgctctttcactctataaacagtccccatctggaggataacgtatatggttcacctgcttacaggtcctatgtgatctggcacagctgactcctccagctccacycagcaatascccacacactggcacatgctcctttctcgcagcatcactgctatcagagatcacaattttcttcactttgcaaatggagagaatgacactccaagaagttcactggttaaggtcatatggcaaattaggatggggagcagaggtttaaatggaagctgtgatgcttactctgctcatttccactcatctgcaaggcttagactggactgcactgggattccagactcacatgctgcagggacattctacaaacactgttcctacctcccagaacccccatctggctcactgccacttccccttcaggtctcagttgagccgtcactgacagctctgcgacaccccaaatctagctgtgcacataataccaagtgtgtcccctactgaaacactwacacaatcattctgcacatatttgttcacaacttggtatgtgtcaggccctgttagagtggctggggacacatgtagggacaaaatgccagccctcatggagtttcatgctagaggaaaaaagagacagaaaggaaactagcaaatataaaacagagttgcatgacattataaactgatacaaaatagtacaaatatctcatgaattcatcacaattcattataatttcctatttgcctgaccacatctccctgtgggttttgcagcacggtgtgtgatctgaggcttgcaacaaaggcctggtgaattcaatagcagtttccctttccattctctccattgtcctgggaacttgtcctgctctgataacatacaaaagataattatatctgtaactaatcttctaaaaagcatctgtcccacacattcagggttattaacactgatgccatgttcactttattctcaacaactactcatttctgaatcataaggttcctcatggaggtggagataaccctacctaccgggacattctgtttatgttttagggacwgtcctttccatggcttccctagtccctcaggtgctgtgtgagttgtatttcctccattaattctacactagaaaaaggtgtatatgctcaagctgggataggaaataaacaatgaactcaggagtagcatcagcccagagatccctgccattgggcattcaatgattgggtaaaaagttaactatcagcaccttacaccaattagaaaggctactataaagaagatttttaaaaaagcccaggtgcggtggctcacgcctgtaatctcagcactttgggaggccaaggtgggtggatcatgaggtcaagagatygagaccatcttggccaacatggtgaaaccccatctctactaaaaatacaaaagttagctgggtgtggcagcgcgtgcctatagtcccagctactcaggaggctgaggcaggagaattgcttgaacctgggaggtagaggttgcagtgagctgagatcatgccactgcactccagcctggcgacacagcgagactccatctcaaaaaacacaaaacaaaagacagcgttgctgagaatgtggaataattgggaccctttctaccactggtgggaatgtaaaacggtccagccactgtggaaaacaatatggcakttcctcaaaaaattaaacatagaattaccctacgaccccacaattctactgctgggtacataccccaaagaattgaaagcaggacctcaaacagatatctgcrtgttcctcttcacggcagcattattcacaataatcaaaagatagaagcaaccatcaacagatacaaggataagcaaaatgtggtatatccataaatggaatagtattcagacttaaaaaggaaggaagtcctgtccaatgctgtcacatggatacagcttgagaacactatgctaagtgaaataagacagttacaaaaggatggatactgtattctgcttctgtgaggtccctagagcagtcagaatcttagagacaggaagtagaagggtggctgccaggggctgagaggaaagacggatgaggaacgaatgttccacgaggacagagtttcagttttaggagatgagaagaatcctgtggatggatgatggcaatggttgcaaaacaatgtgaatatacttaatgtcactgaactgtacgctagaaaatagttaagaagttaaattttaagttatgtgtattttaaccacaataaaaaagttaactggtaggtcacctgggactgcggtttaaagcaaatgcttgatggttagactaatctggatggtccaactaacctgactctaccactgactggttataagacctggacaaggggctctacyccttgagcctcagtttcctcatctgaaaaactggaataataataatatctaatttataaaggcttttggaggttaaatgaagcagtaatgcctcttacatataaataaaattctgagtatgatatacagcacataaattctaaataataaagactcaaaaccatatttcattggttttgttgatgctgattattattattataattaatactattagcttaattcaaaagctaacatcaacctacagcaacctgcagaaagatgtcctgccaaatacttgctaatttaatccaggagcaaaaatctatgattctgggcttgagtgagctttcctaattttaaaactctgatgctcattttgtccccaagaatgtgtttagatgacagagcaatcagaatttgacatgtataaatgcttggcatgttaaaataatgaaagatattttcaccattgtaaggaaacagcttttaatccatctctctggttcaacatcacatttttctatagtttctcatgacttcttccttaacaattggaataggtatgaaaaagctgagctgaacacatagctgcttagaaatgagctgcttaaagtgttaaaacaacagaaacagcaagcatgagtttaatgctatgtatgccgtcacaatactaatttctctattttaaattacagattacacacacacatacacacacacacggaatcacgtctatattgctgggattttcattatataacaatatatcattttaaatgatttgaggcaaattattgaaaaaaattaaagactgaactccataaaaaggaaatcacctgaaatcaaatataaccttgttaacaaaccagcacattagcaacatttttaggggcaamaacataatcagcaactctaagacatcaatcaaatgcattaaaaacaggaagtactaactctaattcctaatttccagaaaggcaaatataccataattaaataacackttataaggagatttgtctgtgtaggtctacttctgaatccccgaagttacatacttgtaccacaagcccatactcttgaaagaaaattctggacccagtccacatggaattttggttaaaacatctaattcattgcagagaagaatttagtcttttccacggaagagacagcatgtgttagaatgagaatactttatagaaatgaccagtgacaagcyggctatgtaagggggcttctgatgcctggcgttaacaagagacagagagtattattgttgaaagggatctttgagattacagaargagctgaggtgtgaataatcgaacrccatccccttgttgcctgaaggagaagtgagacagcaaaacwaatcaaatttccaggagctgcaccgtgtatggtgagcgaagacgcartgaggacatgtctgtaggagaacagaggtagaagttagctcctcaagtaacagttgccatcccgaggcaccacagcacaagacagtagcggaaatgaacatgacaacgcggatggtgggtgacaagagtcttgcctggatattgacatttttaaagtgtagaagaaaatcgcaggtcactgaaacaaaggctgatggtgcccagcaggttactcttgaaatcagaaacagaagttcatgagaggcaagaagacagaaacaacaacwgaaaaacttagagtggatcgctaacttgcaggagctgtgcagctttggctttgcaggttttagaagctctccctacgccacgtctttaaatatatgtatgttcaatcagcaggaggaagggactaacaagagccttctgcggtaagcacctgcatcaaacaatggcactgatctcagagggattttaaacagctgtgcataaacttcaamagtaatttgcaaccatattagtaaatgtcactcttcttcccgctagacacagcacttttaaaagagattaagcatccgcagtaagcctgccattttacaagggttaccaaagataagttagggaaaatatgaagatgatgattcacaaggtcggggtgtggggtggggtgggggacccaggaccttaggaatagggcttgtctatcacacagcctcgggcaagaagggcccagtggggaccatggcttctagggagcaaaccaagggaaaagagcaacggagtggaccctccaggcttcttgcctctctcacggagcctcacgaatcccagtggtttagaattttctttggcaaaagaaaaggtcaaagaggccggagttgacagaaagcatgggcggacttctcagatcttgtaggtggttcttaaaagaattcagcaggcttraggtgtgctctcaaagggcaactggaacgtcaaggacttggacaccaggcacagatggttcatttcccatggacargaagagggcacggagtgctccctcttccctccaccttctccagcctagtccccctcagcctgtgccactcctgaatcatcttttatagcaccacrtccagcccgcacaggggcaggacagcccagggaacaaggcagtcctgtggcgctctccttgcagaaatgaccggagtctcccaatccagccagcccgtggacctctcttcatgcccacgggrgagtgcacacgcctgtagcattcaacagtcactctcccattgataacggtggctctcgaaaatccaataccacaaagatactttattgcacaaactttgcttggttaacctggccctcaaagctggggaataacctcacttgaggctacaggaatgagcacgcagatttttctttttttttttttttggtatctttcaaagacctgcctccccctcccccaggcccttgaccagaaacttggcttgtttagaagcctgagcaatggcacccccgtccgtgctccaatacattcccagaaaaggggttatgctcccctgtggacaggataccayctccagaaaacatgtttcctcacgcatttttttttttttttttaccaagaatacaaaaactttccaccttcttccctccccgcaggccccctttcgttcaggtgagaaggaaaagggagaagaaaggaggaagcgcccccaggccggcggcccccacccggctaaggtcgccagcatcccgcatcccgtgcgacctgcgtcccagaaacccascggggaaattcttcccggtgcgctcttgcgcccgcttggttccatttcctactccgcctgctcacccggcagccctcaccccttcccggaggctctccgaggggccygggtagcccttcycgccacgggtctcggcccctccagcccgctccctcccggcggcggcgcggggcgcggggccctacctggagcgagcacggcgccgctgctgcccggtggcgctgggactgcgcggggactgcgcggggactgcgcggggactggcggtcggggctggcggggctggcggggctggcgggcccggcgcactgcgggtgcgcctagaaggcggtgcccgccagggggcgctcgccagcctccccgccagcccggcctcccgggacccggcacctctagccagggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaaggtaatgttgccgccgtgcgtgtcattttaggactttttatgccttgcgggtaatactaatgatggtcacagggaggataaacggggtggtttctttttctatactccatgtaactaatttctcattcaggttagaaaattatatgtctggttactaatattcttactgaatggtttccttgcaatgatgacaccaaataattaaaacgtacttgattaagacttttgttgctgtagtgtactaagatcagattaatctgagaagtaaaatagtaattttttgtccttttttcttttcttgttttgagagagacattaaaaacgattaaaacaaaacaaaacaggccaggtgcggtggctcatgcctgtaatgccagcactttgggaggctgaggcgggtggatcgcttgaggctgggagtttgagaccagcctggccaacatggcaaaatcgtgtctctcctaaaaatacaaaaattagctgggtgwtgtggcacgtgccagtaatcccagctactcagaaggctgaggcaggagaatcgtttgaacctgggaggaggaggttgcagtgagctgagatctcaccactgcactgcagtctgggtgacagcaaaactctgcctcaaaaaaaaaaaaaaaaaaaaaaggtttaacaaaagccaaaagttgaattagcagccttctgatcatgggaatgtaggatgtcaactaaaaagaacctcagaggttgggaaggcagatgaaaaactgaggccccgaagtgtttcaagacttgattaaatcactcaggtctgcactaggaagcgagttatgatgatgcccctaatctatatgaacccaaataaagccaaaacacacacaccttttaaggataaaactrtattccattaaaattagccccgcatttgtcaatatctaacagcattggactgaccctcaggccagaggctgtagctcttggaagatcctagccaggaggtttgagagtggccagtacctcggaagtgctggctcactctgacatcatcagaacctggcatacagtaggcgctcattgggtatttgctatggaaattaggcaggaaagtgcgtctgtgtctggaaacaaagaggcaaagcttaagcagtgatccccatgcagattctttctgcaaactacaaaacagaagcttccctagttcagactgccatccatctggctctttctccaattgtttttcagcggatcctgttacagtgcaaagaagaaatggcaaacggataacagctactgtgcctagaagatggtagattcctcacgctccatatctgggtttctcattgacaattaggcactgaaaggaagctcatatgtcctgttaatttaatcagtagttagtggctttagaaaaagtttcatatatacaccaggtatgataaggacttttttttttctttttgagacagagtcttgctgtgttgcccaggatggagtgcagcggcgtgatcatagctcactgcagttttgatcccccaggactcaagttatcctctcacctcagcctcccaaatagctgggactacaggcacacatcaccatgaccaagctaatatttaaaaagatttttttgtagagacggggtctcactatgttgcccaggctggtttaaaactcctgggctcaagtgatgctcctacctcagcttcccaaaatgctgggattatcggggtgagccaccatgcccagcctgtgatgactttagacgcactactcatataatattcataatctgatgtgatatgtatcatcatcattatcatctctctttaacagaagagactaacaaggcttagaaaggttatgtacctcgctcaagatcccacaattactaaagtaccagaaccaagattcaaacccaggtcaggctggagccaccatctcaagagctgctgaataattaattctccttttttttttttttttttgagatggagtcttgttctgtcacccaggctggagtgcagtggcacaatcttggctcactgcaacctctgccttctggattcaagtgattcttcctgcctcagcctcctgagtagctgggattacaggcatgtgcctgccaccatgctcagttaatttttgtattgttagtagagacgggtttcaccatgttggccagggtggtctcgaactcctgacatcaggtgatccgcccacctcagcctccgaaagtgctgggattacaggcataagccactgcgcccagccaattctccattcttacatcgtacactcagttttctctttctttctcttttggacaactgatctttgaggactcttggctactcaattgtcctataatcgtatagtcctacaacaggaaacccgttaacctgaagatcagatcttttaaaacaacatccatcatatatctacaaaattgggatttttttatcgtaaaatttcatctaaaacaaaaaattcacatctgttcttggtatccattaggtgtagyggacacctctagatattcttgatgccagcatcctgtagacccgccatctcctttcccaggccatggggtgtttctgttttctattagacactgtctcttagttatataaacgtggctgctctcagaagttctccacacctttgtttcctggaagaggaaatggcatttcctggaggggatgacacgtgggcggtgaggttccactcactacgttaaacacaccctaactttcagctgtgtacttcttttcctctttcaggttctgccctgatgtttcctggaataatgctgaggactgcctttcgggtagccgccctattcmgttcacttcatctcggaaatacctgaccyctgccttggatccagcggccctcctgagagctgaggaaggaggaaatcctatgtgtctgctcccrgagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgtataaagtctagtgtcaatttattcagaaaatatcaaaattattctgggagctatgggtcaaagttgataggcmcaaacaaacaaaaacgaaaggtattttaaattcacagcttggataagtaaaagggagatgttgtcatttctcttcttcaatccaactttagattttcaagccggaaaaagggtaattagaagttagaaattgttattgccagaaaatagctctaaaccctgaaaaaaaaaaaaaaaaaaaaaactgaccctcctcttggggagtgataaacctcaattactgttgatagtaaaactgatatcaactcttcgaaaccagtgaaaggtgaatggaaaccttaccctaggttaaggtttaaaaaatgttcataatatatatttgaaagttccattatttaaaatattcattaracatgctttgtaatgttaagttacttcaaaaaatcttacacaagggaagggaagtatgtattattccttcatttaagagaaagataatgtgtgaatattagttaatatttatcgtacatttactacctgtgtcgaagcgtagtgttacacacttaatttcaattatttaatttgattctaacaatgaatcccctgagatggataatatcctcttcattttacagatgagacaattgagacttaaaggttaaacaaatgatttcctaagctcattcagctaataaacggtaggggactgcttgacaccagtccagttgaccctcaaatccatgatttctgccaccatattcacagaaacaagacaagagctgaaaatatagcctgactcttgaaacagtcaaagaattgtgtatgtttatgaaagttctgattaataagatattctgaggacaaaagacaaggcatgggtagaggggcaatgtgtagattagaatgtatcacaatgcccactaaatagtaaaaccatagaaaatgaaatttaatccttactgtgtagaatatttagagtagattgttttttcctcggtgtcaattactattacaactatcaaagaatgaaattaaacaagaaacggttcctttggtttttttttttaaaggtgggagttataaaaacagtatttgccatctggttttagttatggctgtggaaattctatgggtacaatttgttgtcattgttgttaccactaccaatacagagatgctaattgtaacatcagtttctaaatcagatagtgaataattacattttcaatgttttcttaacatagatacaagttaacaggatatgcttctggcctgtttctggattctaagggtagaaccagcataaaactagtcagtccaagtatttctaaagatccacagacacagttctcctggatttgggaagcctagagatattagcacaataattaaggcccaagtgagtataaaattttatctgaaatygaagagatattgattagataatccacagagactactttttagtgattatcttccaccagggtaaaagcaacagcagcctgaaaatgcaaaagaccatacattttaatggtaagtcctccccaggaaggattaataaatctcaggaggaagatttattatctgtaaatccaggaggaagaaatcaagatgaaaactatcatatttataaatttgattgttgcaattttatagtttgacatagtgcaattgctttagatttgaaggggaacttactttagagtaagtcactcaatctcttttttggaaaggcaaatgccacacctgatcctcatcactcccttctcctttgtccatagcctggctttattctgccattaacacacacacacacacacacacacacacacacacaaattgggaagaggatttctcattttacagaragtatgctgggctacacaggatattctatcaggtttcttccagctataaaattctgagactaaatatcaaattaaagaaagtactaattgtcagcgatgggggatgtactgctatttgcttctagtggtactcactgctcatttcctatattcactggtataaaaaaatttcaaacaccctcaaaaaagcmtatactggtggtaccaggaaaacgctgaaaatcattactttctgtgtggtgtccagctcttttggttacatcatcacttcgaccattcacttttaaagaaaaacttttgtggaacaaaaatataaagatttattttttttcttggtggcttagcacagtggcctaatgtggctgaccatgtgcacctgttgtgtgagtcacttagacgtgctttgtttcttggtcacagttgatccctcaactcaagcatctcaccctcaaaatgtttgtttgggacccaagaggcaaaccttgagatgggttatttctttcrccttggattggctcatctgctgggagtggagccaagctgacatttcctttcctttttgtctgcctatcactacgtagaggcagcacataagagagggaaagccatgcgcgtggagtccagcacatcacccagaaggcagatgttctatctccattttactcattaaaacaaacaaaaccacacctggattgcctggtacttaaataaaatgcactatgatgattgaagaaaaatatcttatatttaaggaatagttttaatagcttacatctgtatttctattagcttccgtttctatttttaatatttgtataatattaaaagtaattttaaaaatgaactaatctttttacatctcttatgagaayttaatggagatatgatgtttgaagatcaaagatacgtggtatttgaaatcagaaaatgtgtttgcttttctacacagattacaaatatcatgcattatttcacaaactcttctcaaagtgttgattttaaaattagtaaaaggagggtatattcatatcacatcctggcatttttataggcaagattgagcagctataacctctaaagtrctttgatccctataagcctcaagaagagaatggtgcaatttgaattaataactacccattatagagcatttgtatcacagtattttccaaatactatcttatttaaccctacagcaatcctatgatatggggattatgtacacattacagatgagaacttgaggctcggagaaagtaaataacttacacaagatcacaaagcaagtgactgccagagccaggatcagaacccagwcaggcttcattaggagctctgctgaactctgtctagagaattctcaccacctgctgcaaaggctaaaagaaagggtcatattccacatgtagattttgagaaatatttgttatttttcttatgataaaggttatgcatacacactcwcacacacacwcacacacacacacacacacacacaactagaaattacagaaaagaaaaaagattagccagaatgtcaccacctaaagacagataatattttggtgttttcaaatattcttttatctatacttttttgaattattttattttaaaaataacttttactggttgcctgattatgaagtaataaatattcaccataaatattttgaaaaatataaaactgtctataaaagaaatttgaaatgattgctaatctcaaaatataaagatacctgtcagtactttggcattttatcctccttgtggctgaggtcacatatcttgagactgaagcacaaaatttctataccatacagtttatagtttaggccacaacatcatttttaaaattgtttctttggtttttacttgatttgctgatgttttattttttagaaaattgcagatgtgatttttaggcagctgattggaatgttctggttgctctgaataggactarctactttgttttttactgaaggacaaatattattcctacacacataaaaaacctcaaagaatgagtaatgatactgtttaaatctgcccttataactccaaagaatgacttcaaattttctttcttccaaagcaacttttaaaagcctttccactgcacagtgaaagaaaaccacaaactccttgtttaataagtgggatcacgtgcttttaacacgaggaaaaggtcaatctgaagcaactgatatggaactgccagagtaggtacgtaaatttaggagttacatcaatttgggagggctgcagaaatgtggatcagattttaatcacactgaggaagtttctttgagcaaaagacgtgatggttgttctctagaacctttctgtcctgtccgttgctttgccaagggagctagaaaagaaataaacatttaagaacttaaaaggcttctggataaaactcagcttggtgcaacacattttagctatcacagctttactcccaagcttccacctttcctaggagcgcagtaaaaacctgagccaaagaaaccaaacaatagaactgaaattctttaaacttgagttcttgaggttatagtctttgtgcactccataaagtcaaagccctaaaaagatttttagaaaacaaaacacttgtatctgtatctatttccccaaacctctctacatttacttaccttttgcagactcatgctttctcttttccttgtgattgcatttggatagaatgaagacctctcctacagttctcaacttaaattctttcttttatttcttagctacgaaagaaaattcaaaaaattcartgctctactttgtaactccctggacatagtgagtccattatgtacatcatgaggagggagtggagaaagtggaattcttatgtaaattcatacagctttggaaaatggtttagcagtacctactaaagctgagcatatgcaaaccagtgacccaggaatgtcatgggtacataacctacaaaaatgtagacagatgcgctaaaagacatgtacaacatgttcactgcagcccagttcatcatcaccccaaagtggaaacatctcaagcgtccaccagctggaggctgcacaataaaastgtggtactttcgtcggtagaaacatgccacagcttgaacacacgctgaaaacataacgtcaagtgaaagaagccaggtcccaaaaaaagacatactgtatgattgtatttacattaagtcccaaaacaggtaaactgaattcatgcaatggaaagtcatgagagtagctactgcatctggggaggcaggtggtggagtgccagggaaggagcaccaggatggctcatggtgctatttttatgacttgatgtaggggataggtaataggtaggtccactttggaaaagttcatctagctgtgtrtttgtgacttgcagtcttttctgcatgtgtcaattccagtaaaaagattacttgaaaatcragtataatattattgtatttacaaagccctttctacgtagccagaaacagggttggtttcccaggtgactgagaggtcgtcaggagcttagtgagtggagggcaggggacaagtgtgttcattctctctccctctctctctgctgttctgtaaggtgacaagttaggcttactgccagtgtgaccttaaataagccatgcatgctttctgaatccttttttcttatttggtgagtgacgtgctagttaaaatggtgtctccagccctttcccgtcctcrctgctgtgattcaagccccctccttctctgtggggcttcctccgacctctcgatttcactgtcacctttctctcttcctctctctcctgcttcctccctgtscacccccatctctgtccccccagggccgagtttgttttatatctcttttggtatctcctctggttttctggcaccatgtcttacgtagagcaaataataatgctttaaaaaattctcgataaaggaaaaagttcagtaaagtgtgaatttcacattgtagtcagtggttaaatgcctcaaacacttaaaaagtagaatttatctcaacctgggcagaaggcagtccatgccaatttctaaatggaatccaatagcaagaatgcacaaagaacaagcaggagtggtgaggatttcctcactctgtccctcagaggtggcgcgtctcatctgtgaggtgaaagtgtcatcacgtcattgacataaagtataagtacagggaacataatcatctgggagattttaatttgagttaataagagatragattttcaggctaaaagtcttggggctkgacaaagaatatttaaaaggagggttggtggataaagaaactgtggtatatttatacgatggaagactacttggccataaaaaggaatgaattaacagcatttgcagtgacctggagattggagactattattctaagtgaagtaattcagaaatggaaaaccaaacatcatatgttctcactgatatgtgggagctaagctatgaggatgcaaaggcaaaagaatgatacaatggactttggggacttggggggaagggtagggggcggcgagacataaagactagaaatatggtgcaaagtatattgcttgggtgatgggtgtaccaaaatctcacaaatcaccactaaagaacttactcctgtaaccaaataccacctgtaccccaaaaacttatggaaaaataaataaaagagggttggatgataagaatttgtcatcttgttttctgaattgttcaattgtacttaattgtacttctttccttaaggagttgaaaatcttcctaaactgctggaggatacacctctgatagcttgagacaaatatcctcttgatcattgtttcaccatatttgtctttgctcatggagaaccattttgatccgtggtttagcctcccaggtgattgaacaataccggtgatctgaggcagaccctctgtgacggataacaggtgagtctcttgcatgtttttgcatcatgtactgattacccagacaaaactgagttggyacagctgctaaatccaggatcaagtgctgggatagtagtcattcaaggaggaggtgtcctgaggggctcatccctcagtagccagctgtgcccagagcagagaggggcacagggtgacagagtgaggcaggcagaggaagccgcacatggccaggtgggaatggacatcaggctcctgactgctctcctcacccagctacaccttcagcttttcactggcagacacctgtggctgctgagataccatcccctccagtgagtcggctggcaattagcttatggtcctaaggatatttctggtgttgctgagaaagtcagagaaatagaggaaaatgtcaagctatgcttttagaaaagagtagatgttaacttgtttggcttctgactctcagccttaaagaaacatgtcaccttcttcctcacctgtaacggcaacaaatcctcgtaacaaacatcttccattgatacttgaagaacatgctcacatagtaggtgctggctagtttgtacaacacgcctctgcttgtatttatctactcacaggtgagaatgagttgaaataaaacgtggaagttcctaggaagcactcagtattgcccctccctgccccttttctgctgttatctgctgtgggagcaggggagcagggcagtgtgctgtggtggcagatggtggacttcagagtcctagaactcccagattcatgatcatgacaggtctgggctccaccactgacaagccatgaggacttggggagtcccatgatctctctgggcctcagtttcctctgctgtaaaacaaagcaatggatgagataacatttctttccacttgataaatccataaagtgcaaaagaacctaactctgacaaatatttgtataatatttttactccagcaggatgcatgatttgtattcagctgagatggattgactaaaaattacaccttctgctcactctaatttattgctgtagaagaaagaataagtgagatatttccatttctagtgacaggtggctggcactttgaaaccttccatttcattactcaccttaatgttttcactaaaacacatgtggttttcaaacacaggaaggaaaacatggtaacctgtggttacaatttccactagaaaatagaaaaggtgtaggtcagaaagaatgtttgtggggtgttccttttttactttaaacatgaaaacccatgtcagaagagttttytcttgagaagaacactgttaattgttgcaattttcaaaagttgatgaaaatggggcccagtggcctctgttgttgcaaccagggcagttgtggttgaagaactctgaaggctttagtgccagggatatttttaatcttccactgtgtcttcaagcagtctctctcttctcttttaattcaaattctgggaagcctaaagaaaatgtcttttcaggcagtccttctcatacccaagtagctcyaagaatcccttttcagatcccatcttgaagcaaattagcttgttcaaatagcatttcctctgtagcaattaccttcacagttattttcagctactggttccgtagtttgctgtgatcagttgaatttacctgatacctaaaattaattaattcttcaataaatatttggagagcaccaactaagtttacgacatgcgcacacatctgagttaattggttaatcagaaagaaatgcaaaacacaaaagaaaaactcttttgaattttctaaattgtaaacatctacaactactagagatatggagtaagttttaagtaaattctattttcacaagagactggtatttgaacttcggaagtcctctttccagatggccggggtacctagcaggagggggtgggaaaccactccaataaatgttatgcrttggttcaagaaaccagctgttcaacctgcaagagaaaaatgtgttaacggagtaatacatacatagtagtttagatttttttcttctaattgctttactgatgacaatcaaataagaatatgcgtagagctcttcagggtatcaataaaaacagatgcaagtcatgttcacgtgcaggttcagttttaaagggaagaaccgcagcatacatagaacaggagagcgggactgagctgttctgtaccaagctcttatctgccagacaagatcttatcttacgtatttatacacaagcacagatgtgcatggtgaaacatgcatttgtatcaatacaggatagcactggggaggactcctgatgggtgggaggactcctccagtacttgttccactgcagcctgccctcggcacaagcagccagaaagattccctaacagcagagtcatacctgccactctgtcccagcccccagggcttccttctccctacaggacctggccagtccctaggccccagatccgcctctgattcatcttccccacccagctccagctgcatcagcccctgtttgcttcttagcatgccggcaggctggagcccagggcacaagtctccatgtttggcttgaacatcaatttctccaggatgatttccctgatgactctgttttaaatttcaggccctctgtaacccctgtccacacatacacactagaccctatgctccctttccctatctccctccccatccctcttcccagttggcttcacctttctggaatagaaactctatgcaagcagggattttccccgtgtatcacttattattgtatcccaacaactagagagtacttggcacatagtagacgttcaaacaacgttcgttcaatgaatgcatgaattaaatgtaactaatcacaatacattcacagatatatgaaataattcacttacttatgcagaagaattgggtagctatggatttaattagtcctttcacgtcttaagaagtatttaattcatttacaaatataaacaaagagcaaattctttacctcacatggaatatcctcttttggacagctggcatcaaattggctccgtgaacattagtcataacacaatggtcatctttctttattcattggtcatcattctaacagtgtagagtcagagtccctatctttcagatagggagctgtattggttttctacaggtgctgtaaaaaacctctacaaactaagtagcttagaaccaaaatgtattgctgcacagttctgtaggtcagaagtccaggctcactcagttgactt

SEQ ID NO: 13389 - DNA, 16176 bp, Homo sapiens
cggaatgtggcaagtgcaaaggccctgaagtaagaaccacctaggtatgtctgaggaacagaaatgaagctagtaaggtttgaacaccatgacagattggaagcccggtaaaagataaggtgggagtttgaattttaagtacagtgggaagccattggagtttaaatcagtggaatacataagcaaatttacgtttttaaagatcagaccagtaggatgcggcggcttacgcctgtaaccacagcactttgggagggtaaggcargcggatcacctgaggtcaggagtttgagactagcctggccaacatggtgaaacgccatctctactacaaatacaaaaattagctgggcatggtggaggacgcctgtaatcccagctattcgggaggctgaggcaggagaatcgcttgaacccaggaggcagaggttacagtgagctgagattatgccactgcactccagcctgggcgacagagcgagactccaactcaaaaaaaaaataataaataaatcacactggctttcaggatggaaaaatggatggtatggaacaagaggaaaaacaaggaaatctattagaagtctggattaggatggtagcagtcaagagtgaaaataccttttctgttaattcagttcaatatgacagtggcttttattttttagttaccaaaatggtgctcagaatgaatatatacattaatgtatataaatatacatgaatttaaatacatacactgaattatttgtatgattttcctttcattagattgttgaaataattatgttctatttctctttgtatctccacaatgctttgtccatagtagttagtaagtgagatagscaacaaaagctttaagtggaggagggagtgtggggggtcttatttgtaagatttctgcactacaggataatcaataaaacacacctgccggcccactcggtcaggaggaggccacaatgcatcatcctctttggtaatttcactgtcgtcaattattctcttcagttcctccatcacgcttttatgtacataagcctgaacgcaagttaaaaaacaaaatgtatgttgtatccttaagcagtgctttgactcagatagtgatggaagataaaaataactgttcctgcagacttatttctggcatctccttaagtgggaagacattcatgctcaacctcggcatgatgcaggtgagggacacggtcagaagtatccagtaactgcacctcagtcccctatctagctgttactacctcctggtacatcctgttcacatggcccttctgcctgcccacatacccaactcacaacgaaacccaaaacaggtctgtgagtgccccctgccatggtttgaatgtttttgtctcctccaaaaaaatcatactgaaattaatccccaaagcaacagtgttaagagatagggcctttaggaggtgatcaggccttgagggcagaggccccagggatagattagtgctttaggagagagcttaagggaactagctggcccctttcttgttctttcaccatatgaggacacagcattcattccttctggaggatgcaaaaacaaggcacagttgtggaagcagagactgggccctcactagacactgaacttgccagcgccttgatcttggactttccagcctccaaaattgtgagaaatatatttttactgcttacaaattacccagtctcaggcattttgttgcagcaaaaaagagactgcgacacccacatgccctggttattcttttttttttttttttttgaaacggagccttgctctgtcgcccaggctggagtgcagtggtgygatctcggctcattgcgaactctgcctcctgggttcatgccattctcctgcctcagcctccyaagtagctgggactacaggcacccgccaccatgcctggctaatttttttgtattttcagtacagacagggcttcaccgtattagccaggatggtctcgatctcctgacctcgtgatccgcccgcctcggcctcccaaagtgctgggattacaggtgtgagtcaccgcgcccggccagttattcttaactaggtaatacactcctgaggagcaaaatgtattttaaaagatatgcctgtgtaaaaaaatagtgaggatattgacatgtgtgaataagcataaaatcaatagctaaaataacaatatgaaaatatatgctaagacattttcaaaggtggcaaagtggtwaaaaggaaagagtagctttgatgaagccttaatgatgtagtagaaatcacagaacggagaatacaaactttactggggcaggattgggaattcctgctgtatctcttactagcaggggtaactcagaacaagcctcataattaatacctgggcctttattttcttatttgtaagggggctataataccctcccccatcacatgggcttacaatcagggttaaataagatgccacgcctgacatctaacatgcattcaatgatgtcaactgctttcccatgctccctttcccactcagatgtaaattaaatagctcttcattgtgtaccatgtacacagggaatatagagcactttaaatagaacatatttaattttatgacagcacttgggagtgggaggtagcttttattattcctgtttttacaggtgaagaaacagagatttatcaagttcagccaggaacttgcccaaggtcacatggggtagtaagcagcagactcagggttcaaaccaaggtatgtcaaaggttaccagtaattgattccacaatgtaaaataaaaaaatcccaactaaaagatgatttgggaaataatccagaagctgtctacagacatgtgtctctctccctgttctttatctttcaatactactagaaacaataaaaacaaygcaagacaaaaagctgaaatgtagcaaatgaaggactctcagaaggcagaagkctcatacctcttttctgatcatgacatcattcttgtaattgctgttgttggcatatcttaacttccctgtgggggcaaaaaacaatttcaacgtataataaaaacatatgaataaagcatcaataccatgccaaggcatcagcagttgcccaaaatgtatctaacttgctaaaagtgtctaacagatttattatttactcttaaggtatttcaacaatactagtcttttcagttcttcacttcaggcttaaacagccaaatatacagctgaaactcaactactgcaaaaagcagctcaggtggggtataaacacaggcaggctcttttctgactttgtcraatcacatttttgcaggtgaatgtcctgaaaacaggcctagtaactgataacttaccgacacataggacctcctgaggctcaaatgagctgtgaaaacattttgaaaactgtaggatgcagtttacatatattatcatgtgactgtgccatactctatttctgtgatggagaagctgctgcttttatcactgagcacatttggtacacaagaccctttgcccatgtgtgcatctgacagattaatggtggggatgaggagaagacagaaggaaatagaagacatgtagactagaagacatacatgtgagatgagcccagtgaatttattccaacagcctctgtgctgtctctctgcctcaagtttcttcacattcagttcactgtccatacagtggacaaggtgatgtggtaacagatctatcagattaggttactctaatactttgataaagtcaatggctttccactgccttcctggtaaaatccaaactcctcaacatggcatacagctaagctaagcccctgcctgcttttccagcctcattcctgccaatattcttctctcacacagctgaagtcaaactacttggtttctgcctgaaacatcccaagcactttttggttttcagcttctttgcatgctgtctaaaatgccttcttgactcttcttcgtctcctaaccaattcctcacatcccctcctcccatcattttatgtaggaagcctcctctgaccctcargcttggttaggtgcacccttctctgctgcgagcctcctctgtttctttttaccacaacacctaatgtgctgttttatcactgcttacaaatctatctccctcacagtcgaggcctgtcagattcatctttgtgccccacttagtggatgtcttctgtcatctttgattgctctttccttcaccacagtgcctctgccaacaaaatcctatcaacgatcaaagtccagttggttctgcctccaacagtttcctaaatctttctctccatttctactatctctgtagtcccaaccagtawctttttttttttttttttttgagacagagtcttgctctgtcacccaggctggggtacagtggcactatctcagcttgctgcaacctccgccccaggttcaagagattctcctgtctcagcctcccgagcagctgggattacaggcgtctgccaccacacccggctaatttttgtatttttagtagaggcggggtttcaccatgttggccaggctggtcttgaactcctgacctcaagtgatccgcatacctcggcctcccaaagggctgagattacaggcttgagccaccgcgcccggcccccaacatctttcgtgtcttgacaactgcaacagtctcctaatcaatagccctgtttccactcttgcccattccgcacccaataaccagaatgctttttcaagaagagatmacatttcttctctgcttaaaaccttccaagcccggccgggcgcggtggctcacacctgtaatcccagcactttgggacgccgaggcgggcgtatcacctgaggtcaggagttcgagaccagcctggccaacatggtgaaactccgtctctactaaaaatacaaaattagccgggcgtggtggtgggcgcctataattccagctactcgggaggctgaggcaggagaatcacttgaacccgggaggcggaggttgcaataagccgagatcgcgccattgcactccagcctgggcaaaaagagcgaaagccgtctcaaaaaaaaaaaaaaaaaaaaggccttccaagtccaaactttttaccgtggtctataaagacctaaraggtgccgctcctacctacctatccgacatcatctcctgctatctcccagctcaccactcttcaaccacactgaccacctgagacacgcctagctcattcccgccctgcagccttgacatctggkattccctttgtgtagaatggtcttccttatgagcttcacaaggctgagcccttcttgttaattaggactcggctgcaatataccctttacagagagctctctaatggccaacctatctaaaagcagcccatccagcaattattctaccatgttattttttgaccactcactgctatctggaatcatctttttgtttatgatctctctcccggcagtaaaacacaagttccacgagaggggaagtttgtctaccttcgctgccgtattcccaaagagtggaacagagcctggcacacagtgggcgttcagtcaacgtttgctgaatggatagaaagaccccgtggagcagacacagtggcgttcctttaagatctgcactgcacaggtctcagtccctccctcctctagttccccacagatttccgaccctcggcctccccactcgccggcccccaggcctggtccccgctcccggcgggcggcaggctgcttttaccgtccggtcgaaactcaaactccaggaactcgtggccgaacttgcccttgtgccccacgtagtaacgcagataaaagtcactctccatggctcccaaaagacaaccgagcctgaacttccaagagcaagccgcactgccgccgtctgcgcccgacactgacgtttgcggcggcgcgcggaagtgacgtcaggtcccgtcgtcgctgcgtggaggggttccttctcgctaacctcttcgcccggaagtggcaacaagactgcaacatcccctcacgcctagtctgtaaagaactttgtttaacccggaggcggggccagccagctccgcccctccagctggacgcgggagcgaggttgaggttcatacccctgggttctctccaggcctgaggcggagagccagccgcctgcctacctctgggctttgaaccccgggtctggtgacttcgcttaaagacctcgggccgaaggcccgccaggctcaacctcggttcacaggacccccgacttgtgtgagtcgtacaccgctctttaccgtctctggacctaggtcatctcggcagtaaaatggggtgaaatgacccgacctccccggaggatgccgcgcacgatgtgtgcctcaagttggcttccactgacctgaactgttaagaaagccctcctcagtgacgccttccctgaatccacagtggagattgccgttttcctggaactaattcacccacacttacccatttcatccctttccaccttttatttctacctttctgccccactgatctctagaataggtgctgggagacgttagagtatttgatctcccactccccagtcatcccacttaccgagcagtaattctctgcctggctgcacattgcaatcacttgggaagcctctaaaaatactgatgccagggctctaccccaagccagttaaaatctccagcgctggacctgggcattggtactttttgtaaagctttcaggtgagtcagagttgaggaccactgaccaaagaggtcctttcttttcagggtaaagttgtcctctgtgaagcctttctggctctggaaaaaatttacagttgagtaggcccagggcaatcaagatcataattatgtaataggaacctgctttcactcatctaagttccaggcttagaaagaatgaatggttctagagacagtgccgagatgacatcattcttgggtcctggcggctagaactgtatacgattctgtaagttgggacagcagtctctgattcctattcccagtcttttctttttgagacggagtttcgctcttgttgcccaggctggagtgcaatggagtgatctcagttcaccgcaacctcgcctacctaatttttaaactttttgtagaggcaaagtctccctatgttgcccacgctggtctcaaactcctgggttcaagtgattctcctgccttagcctcccaagtagctgggattacaggcatgcgccaccatgtccagctaatttttgtaattttctgtttttagtagagacggggtttcaccatgttggccaggctggtctcgaactcccgacctcaggcgatccgtctgcctcggcctcccaaagtgctgggattacaggcatgagccaccgcgcccggccctcagtcttaacacggagtccttttctccctgcaaaagcattagcagcagagtgtagagtaggtgtggtgggggaaaaatcactggacacaggttaaaataatccctgtgtaacaatgactcattgtaaccaaaggtgaaccgactcaactttttagacttcagtttccttctctttaaaatgagcataataatgtacacctagcagaactgttgtaagaaacaatgtctcggaaactaaattgctgtaaaaccataagacatttttattacaaaacactggatatgggtggtaacaagggaattgtataaacgagaagggggctagacacagtggctcatacctgtagtcccagcactttgggaggctgaggcaggaggatcacttgagcccaggagtttgagaccagcctgggcaacataggagactgtctctacaaaaaatttaaaaaataggtaggtgtggtggtgcacacctgtagtcctagctacttgggaggctgaggtaggaggataatttgagcctgggaggtcgaggctgtagggaaccatgatcacaccattacactccagcctgggtgacaaagcaagaccctgtctcaaaaaaaaaaaaaaagagaaaaaaagaaaagggaccaggtatcaagcacctaataaatgtcagcccctagggtcaatgggattacctgtgcttgttctttgaatcatcacaacaatcttgaggtggtaattagagttaagtatgtagagggattaagcaattgctacaaggttattttccaggagtaaaattataaaaatcataagtgaatctggggatcttcagatgtggcaaataacaaaagtgttgagaaatttaaaggacacacaactccagtcaggctgtgaagtaatccaggtttctggatatgagacatggtgtaactgaaagagcatggtctgtgtgtctgcagtgcctgcattcagcatcatttatttgagcatccactgagtgtcatgtgcagagaggatacaatgttgagcaagacagttgttcacagagcttgcagaggaggcagttaaggagcatacaagcaattacaatgtaaggataagattaccaataaaggaagcacagaggactatggaagcacatgaggtgactcctaatccagtgyagggtccttagggaaatgttcctgaaggaaatgttccagacggaggcccagaactgtgtgattagaatatagagtagtgagtgatgaagctggagacagggcagaagccaaatcatgaagggttttataagccatattaaaagagtttgggcaaacccaagaatattggatttttgtgccagcaaagcagttgaagagctttaagcaggaaagtggaaagaagtggtggtgatacatctatggtactttagaaagacactttggctgcagtcttgtaggttagattggaaaatgaaaagactagaagtatgacattcagataagtagtttaagtaatctattagctgggcagggtggcgtgcacctgtagccccagctactcgggaggctgagacaggagaattgcttgagcccaggaggcggaggttgcaatgagctatgatcctaccactgtactccagcctgggtaacagagtacgaccctgtctcttaaaaaaaaaaaaaaaaaaaagtaatggagatagaaaagtggatggatttgagatggaataccataatttaaggggtaggcaaaggatactaagatgtggccagagagataggagaaaaaacatgaaatgttatcatggaagccaaaataagaatrtgccaagaaaagagyggctaacagtgttaactactgcttccaggtcaaggaagagcaagactgaaaatgtttaccagatttataatcgaggaggtcctggatgaccttggcaaaagcaaccccaatggcatgggaatgaatggtaaggcagaagtwttgggatgcaagtaggcaaaaattgttatcgaagtacagaggtgagttatctaacctagtcttagagaaaagggaaggcttcctggaggaggcattacctaagtggagtactcaaggacaaataggagttagtcatgtggaggcagagaaggaaaatttaggcagagaatgctacatgtacaattgctctttgggggcactaaaaataaccttgtgactttgggcagttactttgcccattttctcatctataaaatgggagtggatagtattgatagtatttatctcaccgaattgttgacaaagattgggataatttatrtagaatactggtacacattagggactcagtaatagttcactccccctcattaaagtattacaatgaaacaaaacttaaaagattttttttaaatgaatttaatctctctctagaaacagtgcactgattttacaaatgtccacatttggttttcagtttaccaagatgatgccagtatagctagtgagatgcagcaccccatcctcagccccctcgcctctggaagagacaccagactgcaaagggcaccgcgtacagaagctaacggaacttgaatgacaagacaaaaagagcagaatcagttagtgtgacacaacattctaacatgcctgattcttacatcaaatatggtaactttggggttggtagggggagacaaacaaggagaatccacttgggaacaatttgatgaagtttgcaaatcagcactttacccccaaattaacaacagcttgtatggaaaaaaaaatgctcttttaaaagtatatggtttggacaggtatatttgttttctcttgtagtttttgtaaaaaagtatcaaaaccttggctttawatatatatatatatatatatatmcacacacacacacgtggctttttaaaaattacttttttatagcacaaagtgtttgtaaatgcagagggtttctgctaattcttgactgtgcacatggtgcatagcctgaatgaacagagcttcctgatttttttttaactgaaaaattgaagcagtaattctttaaccttctaaattctccataccctaaaaatacagtgtgagaagtctgttactctatcttcatgcatttcgggaaaaggaattatttactctgaaacatttaatgctaactcatttatattttgtgaaacgatgagtgtatggctggagttmgggkggtagggtggagaggcttgcattcctgtgccatttccccattcccaccagtgcccaactggacagtgattagtatcccctctccagactcaacgtcttcaacattttcgtttttctttctcacagttgagaaaatctaagaggctctcgacaacatggcatgcatctgtgaaaatcccactgcccttatattagtcttcattgaccatataaaaaatctttgactcaaatatatgaaaagcagtcagcatttccctttggccactggaaagcttgaggctgaataatatcagttctgcaaagtgctggcaatgcatcctaatgaattttccatgatgcatgtagtgccttgtacacaatgatcaagaaatgcttcattgaatcagaaattaatctattttataaagtgcttacattgaatctctttccatacagcctcatttcttgccccccttgagccttttgttcctgttagaatgaactgtgcaattcctaaagtccctgtgctctttcatacctctgtgttttagctcgatgtgtctctgtctgaagcagcttggaatccccttcttaatttttaagacttaaggtcacttctatgatgaccctattcctcatttcttaggtggaaagacccctctctcctttgagccctaacagtgctctgaatagaatcaatgccttttttgtttccacatatatcatcctccactgctactgtgaactctgtaaagtcagaacatgtgtgactgacctttacatctgcagtgccaggtgtgtagttggtatctagtgagtggttttagtgaatgaatatactgcagtcatactgagataactggagggatcaataggacttactgccatacatttaaatccgatctcattctctttttgccagttaacaggttacttcaatctgttttataaataatctgtgtatcaagagtaaataagtacagtttcgttttctctgtttctagaaggcatttcagttagtgcctttgtaattccactggaggaaaggtagaccatagtataggtagcaggtttgatacaatgttcaggcagcccaaaatagtcttcctgcagaaggaaatggaggaaacgcactgggactggcttctgataaattttctgcccccttggcattgtctctgagcttccttccagctctatagtccagtgactctgtgatctgtgattggctgtagatagctatgcacgggggcaaaaggcaaaagatatgtaactgtacctcaaaatgaggctgaaaagcctctatgaatgggggaaggtggatctgactcctcaggtttcatcttatttactgccgtccaacacatgaatatatcacaatttgtttcttgtaaagggttgctcccattgctgcctctttcaaactgcagttgtagcatatgcaggaaacatgaatgtctctgagaaaaagttgtgaatttcattgtcattttgagatctcaggctgtatgtccagaccccattcatcatttttttctgtgaatgccaggatcttactgaaagtttagaaactatgccttagccactgttatcatttaattccttggaaaattcagtttctttggaaggttacagaaaaagtcacttgttttgagtacatttccatgtttttcactgtcatcatttttcttcagtcaaaaataattttactttccgttcttaaaagaatagtaatatgtgagtaagctccataggagttggccacctgttcttaaaattctgtttggtattggtcattctaggtcaactgcatttaccctctcaatgaatgtttcaggactatcaacacatgcatgtcatgaggagattgctggattatgcaaaacacactgcccaagctccagaatatagttattttcttagagtttaggaggccaagagtgacacagaggaaggtcctaggtacaggatgctagaactccagaatgtctgactgaaaattcaaagggtatcaagctggtgagacatccaacttcattgagttgggggcatctggcaggtagggatgggaaggcatttgcttaagtgtgtcaagttccaggtatgatgagattagatgcagctcctctgctcctacttaagtcaaacacttccatgttgcaccttgtccctggttgtctagtgggagtaagtggcagaacagcagagttaagaaactcaaactctttctctttggatgggaaagccactggggactgaatccttctgggactataggattatgtttccaatgggagaccccacaagtagaaaagagcacttctcccttcctcccccaaggccaagaaaagcaaagaagatgtctataatgaagaacatctatacatatacccggagttttyccttttatttacaaagcagtaaaccaaattcctgtgtgaacataaatatccaatataatataatattgcgtatgccatttccccccwcaaatatgacttcaattktggccagttgttctgacttaagccaaaaattagtttcatctatatgaacatatgatggtaagtaacctatttattaccttaaaatgtttccccacataaaggaaatggtagagagtaaggggaaaagagaaataagagatgtgataaaacctattccaccatctttatcttcatccacagcatgtcctagacattcagtgcctgggccagtctctatagtaaacttgggctgatctggaaacgtctccacttagcwctgtaaggatggcacccttcagggtgcttcagaggaaacttactgaattcaacccaagtgtcctgaaagaaattgaagaagttactcaragagctgaactttaaaacaaggagtagctgagggtgaggcatatcctatcttgastttctgagcactctggtaccatggaatgtctgtacactgaccttcgccaaagccaagaaagccctggtaggagkcacagcagccatgggtgagctgaaaggcttttcctgacttcctggggtctcaggaatagccagaggtgaaaagatttgccttttttactacataattgcacaaaccatggtatctatttyctgatccagatttccaaaggcttttctgaaaactacaagatataccccttgtggactgtgtgaaaataaatttatctttatgtatttgaacagtagccatagatgtgcctcttctctacagatttttctgtcacacacatacacatataaacacacacatacacacacagagtctgtgtggtgggccaaacatgccaaaaataaatacyctcacttctctaaattatttatagaactcatctgatttttaaaatatgttaataaataatctaaatgggggagggagttgaagtgttttttttttttttttacttatgttgatggatagccacaaagcataatcatcttatttacaaaaaacaaatgccccaaaaccyaaaaaagcccccccagcaaccaaacatcttctgtaaatatagtttttaaatgatgagtaaggtactgtgccattggcccccatttrgttatgtgcatcatgttagtcagcagtagccattccacgaattcctcatgggtagtgcaaccagttaaaaagtgtataaaacattatacatagaaaaactctcacatcctttggatgtttgcagttcatcataactttgtggttacctttccgcaacataaatttaaaaaaaaaatcacacacacacatacactcacacagacccatatatagaaacccattcatccagtcatacaccatccagagtgtagtgcatgggactgaattccatgaggcacgaagggggtgatcccatcctcagggtagtccatcatcttcaaggcttaatgccactygctggggagacaaaccaaagaattcatcattagatccataagagttactatttatttagtattgacaaatcacagacttacgttactttaacaggtattagctcacataatgttcaaactatcctaagagacaggatttatcctatttattttacagatgagaaacaaaactcaatgagcttaagtagggtttgttctggatcacatagcaagtggctgaactaaaatttgatcccaggtctgtatgaatccaaagctgtagattttttcatcattctgttttgtatctttgtaaagaagagttgcacagatctaaattttcttaatcctcccttataggattttaggtttggtcaatttcagtgggttagctttggcaaatgttaaatttcaggctatggggttacttgtctctagcatgctaatcacatttagaaaggtaatatactgcaccttcccaacagattaaacacagttgggaggcaatgcaggttaattaaattccatccctctctccctcacccctgctttccagtcattaggtagatgctagactcctgtctgccaaaaatggctgaccatgggaaggtgagcccactaacccctgarccagtctattccattgtggacaacagatttaaattctttcctatattaatgtgaaatttgtttgtttatatcttctgacattccctgattccatctcagactcagagacagttctacataggacaacccttgaaatttatagatggtgtttgaattcccttccgttcattctgagtgttttcttctccagggtacacatctaactttccccarctagtcctgatgtaatcttgtttgcctcttttccatttcccagataccctcctttggaaagaccctccccagcttcagtacttttcctcatagttatgtgaatttgggccagccactttacttctctgagacttagttttatcatctatcaaatgggaatagtaacaggacctacctcacagggttgttgaggaatcaaatgagataatgcacagagagtgtttaacatagtacctaacaacacatagggcccagaatatcctaggtcaacgtaaccaacataaaatagaatcagactagtatctcccatctctggacattctacatatgataaaaagtaactctactgcctttcaagtcatctttgggttatctgtagtttttttatgaatgcaatggccatcctccaccagtgtagatatttaagactatcttattctagtctagctaccctcccactctctctaagacagatctctaggccaaagataggccccagtagtgatggtacagttatccgagaaatggacagaggagagacaggttgttgagaatattgatttccagagcttcaaggctatttacctcaygatataaaggaaagagcatgggcttttgtgtatatacagactggagtttgaattctggttctgccacttcctggctatgaccttaggcaagttattcaatttctatgagtctcagtttcctcatctgcaaaatggggcgaataatatcagcttgataaggttattatgaagattaaatgagaaaatatatgtaaaacactgggaacagtgtctgacacacagtaggtgctcactaaatgttgatttccttatttctctgcaactggcagaagcttattacttggtccttaacactcatcgggagtaactccccctga

SEQ ID NO: 13390 - DNA, 25458 bp, Homo sapiens
ctagccacatttcaagtgctccatagccacatgtggctagcggctcctgtactggacagggcatccacagaacagtccatcatggtggaaacttccactggacggtgctagactagatggaagaacggaactgtgagccttgggtatttacatttatttttaaagacgtaggctgggcgtggtggctcacgcctgtaatcccagcactttggaaagccgaggtgggtggatcacttgaggtcaggagttcaagaccagcccggccaacatggcaaaaccccgtctctactgaaaatacaaaaattagccgggtgtggtggcacatgcctgtaatctcagatactcaggaagctgaggcagaagaattgctcgaacctgggaggtggaggttgcaatgagccgagatcgcaccactgcactccagcttgggcgaaagggtgagactctgtctcaattaaaaaataaataaataaataaataaagatgtacacaaaacagtttaattgtggggtcactttatagaagcttctttaaagcatcagctttccaactgcacacaactgtttcccctaagcaacttccaaggcacaaacccagtatacattctctcctaagcattatctcagttgtacattcgattgtagaatatctttcttccttaaaaaaaaaaaatctctcacccaaaacttaagagaaaggggtcatttacaggagaaagggcaaatcattatttttagatggaaagacctccctaagtcaacatttaaatattaaaacatgtagcaggtagtaccaaagggtttctccttcatcacacttgtatttctttactgtcgaaattctctgcccaggagtcagctctgtgtgagctgaaagcaagtgttctgtttgctattgcacatccattacaagcacagtgcctgcctgggacaaaacagatgcttaaatttttgtggaatgattgaatgaaacttaagaagaatggtattttgctaaagaacagcaaacatccttttagagcctggttccaattctttatatttggatagcaatccaccctttattttcaaatgcaaacttaaaataacttagcagactgattcatgcaagtatgcatgctacagctcagtatctttaatactcagcaaaaggcatacagcatctatgtcacagtaaaatatgagctaacatttattgcagttaaacaccaggcccaacgctaagtgttttacatatgctattgcatctgcccctcactctgatagtctctctgctaccaggaggaggaaaccaaagctcaggggaaattaagtgactggctcaagccacagggctagagatgtatagtcagaaaagctcccctggtgaagactatggacgatgcccgtcatatagcctgattggacaattcctgctttaatcaggaaggctacgattgtcctcgtctrcaaggacctgcctccaaggaggggcatggctctggatctttgcagccccagagcttagttgagcacctgccctgcaggcctcccacatatttttgtggagaaagactcagcagtcctaawggcttaaggctactcagacttggagaaggccccttctacagaagcaggcacagctcagcacaccccgtctccctctaaaccgaggctgyggggaaatcactgtgaccttgccactatacagcagcttcatgctttggccaccgtgttgcagcctctacggccactctgctctagtaactggcctccttctgcaaactgaccagctgcaccagcatcacggggctggcagcacttccattattctttttcttgctattcagaatttcaacctaataactccactgttttaaaaacacagtgctttagcaagaacctgttgtgctccaagtactggtcagacaactgcctttaaggggctcactttcctatttggcccaattccctcagattagggtttccagaagtctgacctataagcattcattttcataaaaaccactactgacaaagcaacaggttctaaacgtatacattaaagagctaattttttgttggatcaatatttgtcaagggcttgccaagcgggggtacaaaagtataataaaggacatcaatccatgtgggggaaaggtaaacaaatattaatcaagtccctagtgattctacataattctctgtaattctttctgcagtcctatagcrtagataacatctccatctatggatgataaaaagcactgcttgtaataactcacttcctaagtacctgcaaggcacgaattcagggccaggcacagttaatcctcataactccctcaaggaaaaggtattactacttccttctccagaaagacaggctcggggcgtctgtctgggtccgaggtgcccacgctggctgagagcgctgaagtggagtcagacacacaggcctgcctggctccacagaccatggtgccattaaatgagactgtcctcactctcatggggggacacagagaaagctccccaccccaaccacaggaggaraagatgactgtgggagaacacatcaccatacagcatcagtgtcccattagcgcggaaggcaagattgacaggaaaaacaaacaaggaaatagtacagtgggatgcgcaggggctgtatgaaggtggttctagaaaatggggtggcctggcacaggggcagccattccagaactaggaaggcagggtaaggtactccacatgtgtkggggggggcaggggtggagggagtgagaggggaacaaagaccaaggcaggctaaagtcagaccgtgtagaacccaaagccaggccagggtactcgtactgcctcatgcaggaaagggggaaccagaacactggggcagggattaaagtagtgatgggagattcactgggtgtcactcaaagcttgtctcaagtcacagggctcttctattcccccgacttatctgaacaggagaaatcctcttggctcccagacccgcctgccctggcattctcccgcagggaaacatgctttggttgttcagacgtgacttactggcacttagaggctgttggcatggaaaaaatgaacaggctgacctggccagaaaggagcaggtgatgcagaaacccagcaaaagatgaattcaccctgccaccctgagtaaattacaaagctcatatgaagggccgcagaagaaagaatgggagagatgatttaccagacagagaaggggaagtctcagccctaggcacctcakgagcccaggagagtgccaggcaaaatccctaaggcacttcactgagtcctacaacctcgcatagacatcactgtgctcatctcaggcaggggacacccaggctcactgtggcgaaagcacctggcccagatgagtaagggagagaagccggagcacacatcactggagcacactttattacagtgtctttctgccttcaatcacttgcccmgttttgtaacttcataagagagtcatgatgcccagaacctcatggccccggggcaaaactctgcaccagctctgacactctccttaacctgctgtcaccacacgatacacaagaaccattcctctcaaatcacgaaacaaaggttaaacatattccaccaataataccacgatatgcattaattccatcagtgtggaaaactattccttgtgggagagggcgcacagacagacaactggaagagaaaaaaacagagagaaatccaagtcagatgttgtgcctaacttgaggcaggacttttcctgggatttaagtaggtctggaggctgctctggcacatcctggccacccaggccacgccttacatttctatttgcaatgcaccttcccctcctcctccactccccgcacttctccccaagtgccccatcactgaaaaagttcaggggccgcaggggctgagacggggcgcagggcaccgaccctttcaagcggccacggctttgcaacatgttcctgaaattcctacaaaccaaaaagcaattcagaatcgcaggagggaggcttatcctccactccgcaaaccagaccctcaagatcatcttttttatgctgaaaaggcttttcacaaaatattccaaaccatcttcatagattatttttcctttctcttaaaaaactaagcaagactggatgtcatttagaataccgacttctaaaaaagggcatttttgaactgaatgccacatgctgtrttttgcyattttgcctgcgcttcctgcttggagcctgtgacacagagaagcctcagacactggagctgctccgggccacgcaaactccgctccgcatcttccaggcagccctgtcgcaaataattcatgtccactacgcccctatcacactgaatacaaccacattgtactgctggaaatgggaaacctgattcagatcacaggagaaggtagaaaaacatttggttcaacacaatactgccccccttcttttttttaaagggaggaaacatatttcaaacctaggaatagggaaaggattcaagacccatcgtggaataaaacacagaatttaaaatagcatccgatgtgacccaaaccagcaacaataacgagaaaaccacccagtccttccagagatgcamcttgtttctgctgcagtgttgctaatcaaaatcgatctgcccatccaagcaatttaaagaggaagggcggcatttgtagaaaatggtacatgttgataaagcatgacctgtcccacatggagagcaataaaaggaaaacaagcctgagaacagtatgctgtgctcaccaggagatggaagagaaraaagccagaataagggcagggatgccgggggaagggaggacggggtgtcaaaggcctgcaggatttttgtaaacagcagcccgtaatggccacggtgagagagaagggaaaacagacatggagggaaacgtgtttacaactgcagcgacggcgggaggcggagggagggattccccgactctgcactctgcgctcggcccgcttcgctccggtggggccccggggctgggatgtgttttggctcctccaccctccacccgctttcttagtsgggggaacacatcttgtttatggggaaggttactcctcctctgctctggtgatcgcctccctaatactcctgctgcatccttgcgggatgcccacttgactgacagacactccagccagtcgctgcccgggccccgcggaaaggtggaatttcccaacgcagcgattggccggcggggagggtgggccctggtgattggcgtgttattcggagtggaaagtagtaaacaaccttggtccacggcggcggcgcgggcgcggggtgcccgctccctcttccctcrcccggggcggggtggggcgcgcgcgccagacaaaaggagcctcagcccctcggaggggagagcaggaagggcgcacaccacagccggcggagcgggcgtcccccggagcccctgcgccagaactgctgacttgcagcttcacatcatttttgttctgtggaaaaccgcaaaggttttgtttccataattcggctcctcttcttcgtcttaggttttagaaagtctccaaagagaatggcaatttagttcctcctctttcctgccctccaccccaaccctccaccttttaagattaatttttagttctgtctttgcagaagttgttttaaatccctgtrctaaaaattgttgctttattcacacaatacgccattaagggcacacgggtgaatcagatgccccgttagtccctttccttgcaagttcctggagctgtgatctcactgggaggggctgagtttgggagcaggcataaaaagaaacatgatgatattaggctcacttgacaagaaataagcagttacaccttgccttttccacacaggatgtagttcacccaggctatcatctgacattgctaagtccccttctggttggtcttgactcacaacccattcctcattctggcctctccatcctcacaggacccccagccaggggaaacttcccagcttccagcgggaagtgcygcttccccaaattgggcagcacctggggatgcctctagatgcataatcacctcagaggtcctgagccagagtccagagattctttctgagattctggcaaggccccggggtactgatggaggactgggaaggtaggagaaggccacggggagggggaggctggacacaggagggatctccacttcatttatgtgctctttggtgcttcgctctgatggtaagtcacgttgtcactcttggccagacagccagactgtccaagctgaaaacgtaaacaaaagctccttgcaggaagcaacagggtgcaaacttgccacctggggggcctctctgccaccccttggccarccctctcctccagcatctggccccaccccggccctgcccgcctggcatgtaaagcaccccctcctctccaagcatccgttcctcagccgctgtgttcctgtcgcaggtccctggatgggccacacacaaaccttcactcagcttattctttctaggccttaccctgcctgcccgggagaggccactgttctccacggcttcccttgccctggccagcccacttcctgcaggagtgctccgaaatcggttttggtagcactgtgttaaggttgcagatggtgttttcaacactgtactccgactctacttgcaggtttctccacctcagtagaccctgagcataccagggcaaggtgttatattctaatttgtgtctccagtggagacacaggtccacaatatgcactcaatcaagtcttgccaaacatttgcagcactcagttctcgtcttgtccaacactcacacctgcttctgctgcccccaagtcaagtacccctacctagtttcttgctaacatgttaacatggtacccccccccaccaagtgccaagcccttgtccatcactcagtgattccctgtacacatgcagttacttgtaacgtatgctgcttcctctgccagttatgcttttctgacttctcttcttggcaaattcctattctgtctaaaaatcacttcttcccttggcaacatgccacaagttccacctgactcctctgtgctcccagagcacctcagagaggcctcgttgcaacctctgccatcttccgaggacatggctacagagccacagctggcatggtttgctggaagaaccaagagctgaaaggcagatttaccaggtggtgccccccccaggtgtctgcagaacccacatattccagtctccagaccatggaagcagtgctgtttccagcttgtctctgccacagggtccttctctgctctctcagcctgaaggcctcctctgtgtctgtgagtggctggctccttctcaaccttcattcaggtctccgctcaaacaccaccctcaccaccatgcccacctgccagctactatcmcacagaccttcattttcttcatgaggtgattctgaagagaaaataagcttgggagctatcaccctaacttacttattccctcagtgatggaatttgggggacattttcatcttttgccatttgaaacactacaatgaacaactgcacaactgtcatttcacatgtgtgcaagtctatggggtaaatgccccctctaagattggtgggtcaaagaatacgtgtttataacctgagagatattgccaaattctcctctatagatgtgctattctgccgtcctcccagccatgtggggttgttttccaaagagtgtgttatcaaatattttggattttttccaatatgagaagtgaaaaaatggtatcttggtgtagttttaatttgcatttctcgtatgagtgaaatcaaactttttttctatgcttagctatttgtgtttcttcttctgtgagctatctgttcaatacttcatcccaaatcctattgaactgttagcctcttccttaacaatttctaggagctctgttttactttgtttttttaaacaagggagattagctctttgtgatagaagtttcagatatttttctcagtttggcatctgtctttgcttatggtttttggccatgcagaaagtttttttgtaatttaaattcaatttttatgaatgttttcttttctggcttctggattttgagttgaaactagaaaggctttctctgctccaaggttataaaaaggaactcgctatgtgttcttccaggactttcatagttttgtttacacttttaccttggattcacttggagtctagcctggtacatggtataatgtatgaacctaatttactttcttttccagagaaaagaaacatggcatgattgggccataatttacatgccccaatccagtaaatcaagagtttatcttagtcccaatgatttgtgaagctacctttatcgaataactaaatttccacaggtacttgcatctacatttggactttctattctgttccattggtctgtctcttcatctattggtatctcactattttaattatttaggcactatggaagtttttaatacctggtaaggactccttgctcttgttcagttttttgtttgtttgtttttgttttaatgataacctcagaatctaactaaaagaaaaaaatctgttgtatttggatttatattaaattgaaaaacttacggagaactgacatcttgccatcttgctaatgatgattattcctgtctaataaatgtggtatgtctttccatttattccagttgtcttctgtatcttttaatagtatggttatcttaaggtgttttctctytttattttaattggatgtagaatcttcagtaatatcatctagcaagttatttgcatattgtacagttgtatgatgataaatttgtatgttatttctggcagaagatgttctattctgtgcctttagaaggacacaatgggatgggggggaatcaaagggtgatagtcttaacaataaatagaggttgagatcctaatcaagaatcaaagcaatacattytgagttggcattcacaaatgagtaagtcaaatggtgtggggcataatgctggggtggccatggaagaattctgcccaacagaggatgatgttccttaagcttccaacacagcaggttcagagaggttaggaaaaataagcaaggsaaagaaacaagtactgatctaacaatgacggaagctgactccatgccttadtggatgcttgcggaggatggcactatcttggctgggctgactgtattagcaatgcatgtatctaaatcagctctaaaacccatagagagactggcactttagtgtgaacacgtaaactgtgggtgatggtctgtatttcacataagttgtgatcactgcaaggctctgctggtattttacaagtcaaaaacaagtttcctcttccacagccatatgtttgaaagatatgtccctttaagaataatcaaactctcacccaaaacatgtatttttcaaacctagaggttccaacttgaaatactggaccacagggatactcagctcagatcctctttcagaaaggacttgctgtccagctccagagtgtcactagcagatgccctccagctgctagctcttctagggtccacttcaacttttggcctaggtcacactcttcctaggcagctcctggccagtaactgagcccagcaatggtcccagggcccggttatatccatctaacagggggctctgcaaatgagctcccggagggctggcagagtgtctgtcctatcagagtcctggtcaaaccgctccccacacccatcatcttcctcctctcttcctttcattggtgttatcctcagtaaacctttcacatccctaacttcatctcagtatgtctcctaaaaaactcaaatagcaatgaaaatgtttagcaaattttgggaaagtaaaggggggaataaacattcccacataatgtagatccagacgattctggaactagaagtagaaaggcctcatcacacaagccaactaaaatgcacctcaaaggttaatgtcatcgaatttcaaaagtcctcgaaacttccatggttataaacgagcatttcctgcatgctggactcttcatcgttggtctggattaatcctcacttccattctaggtggtgggtacaaggacttccattttatagacaaggaaaacctgatgtaagtaagtggtagaaagcagattcaaatgcaggcaggactacctggctccaaagccttttcctttccagatggtacactgcccacatctcttagtttatcggcacagggtcaagaaggtggtgagggtatggactgacayggcatctacggagctttccatacttataccaagacgcccccctgtaaagagtggactgtccggtagccgggcaaggtggctcataccttaatcccagcactttgggagtccaaggcagaaggatcacttgaggtcaggagttcgagaccagcctagccaacatggtaaaaccctgtctttactaaaaatgcaaataatagccaggcatggtggtacgygcctgaaatcccagctacttgggaaactgagggatgagaatcacttgaacccaggaggtagaggttgcagtgagccgagatcatgctactgcactctgacctgggtgagggagtgagaatttgtgtccaaaaaaaagaaaaagagtgaactgttccgcctttgtctgatgaaggaatataataattggcagccatacactatattcccgggtcaaggaattcctgggtcattttcagcaagcctaaaacaaggtgttcacacatttatttaaaaatatcccaacaaagtgttgcaaaatttcccttgattgcaatgattctttaagctgttaacattaatcttgggtggatgcaggagytgtccactggctttccaaaaggcatccaatgcctttaaggcagcataagagaaacactgcccctctcgatgaactgggtccctgagtctggcagtactgccctgttctccactgtgtcacctatacagggacccctgagaagaccagtgtgcatgaaccagagactggacagtgcctctgttaccatcaccgtgtggtatcatgaagaggtaaccatcccgaagtcacccaacttgtcagcagaactactgggaaaagagcttaacttttcctgtacttaaattcttccatatgtagttggagttacaggccccaaagtaaagacctattaagcttgcctatattgctcctaaattctctactcgtctgttcattatttccaaatttaataaggccatactgttgtgtcttcatcctggtcaatgcatccaatgataccttgataactttatcagagcagtagctagcagaagcacagaggcacggaggatgttaaaactgctcaacaccacggtacaaatgcattgtcagcttatgtaggagtctgctttttatgcaggcttatgcaactggtgtaattttaaaattttataagccatttgaaagagcaactttgatattaatgaaatggggagaaatgtatatacagtcaaagaaaagtgtctttcctttagctgatgtcagagactccctagaaatgaaaaattattactgtcttttagaaaaacaaaggttaaatggaaatagcactggcaggagtcatatcacaacagcaaaatataacagggccaggcaaaccaaggatattgttgcaaatgcagagccttgatcaggctcatatctcgaaccttttattttgtaaagctgccaattttatagcacaaaaattttagttagggcacctttaagattcactgcatctactatgagaagagagaatgtcttagaagagtttttaaaaatactactttgaaacacttatgggcaaacaagaattggaacactaatcactgtaatttccccaccaggatcactaggtaagacattcagagaactggtggaagcaagtgatgattcagatgcagtagtagaacagaagattgccaatcaactgcaaacaaagtgccgcacaggcccatctcaactgacagcaatggtagagagagaagagagaaagaagagagagaagagaaacgagagaagaggagagaggagggggaggaggaggaaggagggggaggaggaaggaggaggagggaggaggagaaggaaggaggaggagggaggaggagggggcaggagaaggaaggaggggaggaggaggagggaggggaggaagagggagggggaggaggagggaggcgaggaggagggaggggaggaggaggagagagaagaatatgagaagggaagttgggagagacacagcccgactgactcagattccaaattacatatgcacaaagcccctcaaaggttatcatgccctatctgatccagggtaaatgaaaactaaatactgaggcgcaattcacaaggaaagtcagagtgtctacactgttaacaacatacattgaataaagtattagaaacatatttactcttctccctactctcggtgctactgaccgtctactgaatacaaggtacaagaagagtttgctaagttttgggtactgcccaggtcgttccacggctaacaaggcaaaaacactcatgtaaactccttggtgggcctggtatgttgtgtgtggagagggtgcctgatgatgtctttgaacttcactttttggtttctcagctatctcagaggtctggctgtagaattactaatattttaaacaatgcaaatgtaattatagttgaagcatactctttaacagaaggagggaaagattggcatttagaagcttcattcaacttttggccttttcaaggctaaatgaatcttagggaagaaataaaaagttcccattgattcacttaaaaaaagattkcttgcaattaacagatctaaatctatgaaaaagggagcatttatggtaatttccataatctctcactttctctagacatttcaaatcaaattgtaataattataaaatccctccttctctctaaatacacacacacacacacacacacaaatatagttaatcagcaaaactttttctgatctcaaggaaatgtcagttacatttacacaagcctaactagtttaagcaatttatttgtaagtagacatgcctcctagattaggaaaaaagtgtatttagctgtatggcatgacacgccccctaccccaaaccgtaaatagtttttttggcagggagtcagcagaagagctataaaaacatcttcagggtatagaaagatgttcaggacttagaatataccttttctcatggttctcttatcccaacgtataaattgtgacaatttgtttaaaagattgaactaaaytatgatattctctttgtcttccaaatttatttagacttggtatcctgttctttctctggaatttcctttgcttttctttttgtcagtaagctaaattacttctcctcccacatgcataaaagcattaatttataaaacacatagccatatgtcatatctcatgtaattctattttacattccactgccgcccagacttatctaacatgaacaaatagatattatttactgtagtcagaatgagaattatctaatgccacttacatagccataaattgatttttgattaatgtttaagcaaaaagcaaacaagcccatctgctctgaaaacaaacaaacaaaaggaagcagcaaacgcatagttcacaggaatttctgcagtattactatgtttcagcggctggtgaggatggaattttttcattgctatcgtgaaaatatactgcttgacaagaagagaactgcatatatagatgcagcttcttctctagcaactgttaatttaatagactactacttatggtgaaacaaaaaacaatcccactctgaagaaagcactgaagacctataaccagyggtgaatttcttccgtattgctcagtggaaacaaaagaaagctcaaatgggtgagtttttcttctttcagggttgctttctctatggatcaaggtaagaaggaagaaaagctaggtctcctatctatctcacacagcagattttaaaatattttwaaaatattttaaatactttcaattttttaatattttaaaaacttttaaaactaactactgtatcgtgtacctatgaaatttcgttttcagtgcaattcaaaattgctaagacaaaccaataagagaagtagaaacacgaccagaaggccctgtcctgtttattggtatcatctctgaggcttcctcagtatctcgcacagtatctgtcagttgacagctctaatccgtttagagttaatttgttctgcgtctattatgcaggtaagagaaaaaaactgctgcattaggtgggaatttcactaataccaatgaattcccaatattctaactttctggggaaaaaagatgccaaaaagagtgaatgcattttcaacaaaaacagcatgttaggattgtagcacagcaggttgaaggatgaaagaatggtaagagcaatttcacagcaaccaaaatgacacaaggacacacatgccggtgagcaaacaagaggcacaacttaatgacgcaagaggaagcagtttgacttgcaactttcaaaattaaattctaaccgtggtaatataaagacagctttacatcccattcaccacgttacacatattgccatttatttgctaacagcaaaaattcaaatgagtgtacttgagtctctaaatattttctacaaacgctcacccccagactaagatagacactgccaaagtgaacgagtcactgcatggctagatttccatgttgaaaatcttaggctcatagcagaatacttgcacaaatcctactgcatctccttaaaaatcactctacaagttgcatcctaagagttcttgtcaaaattgttctttaaagcattacacacatatgcacactggcctagagaacaaggatctttgtctttctttgccaaaagacagtgtttccccaggcctgttttagccttcgactgatggttctgattttggttcagaaaaataattgcatgactgtcctaaagtggaaagagaaaaacctcaaaaattgttaacacatcaattacatcaaccttttctaattacaactctgcatttcattattctgcaggcaaaatgagtaccttaagtctagagccccaggtaaacaaagcctttccctgtcctcatttcaaaactttgtttttataaacattccccgtcccctaaactgaactacagcagcacaatgatcctgttgtgagcactgccttgacctctataggacaacagattgttgttcacttagcccctcagagttaaatcagttttaatacagaagtttctgtcttatcaaaggaagtaaagaagtaaaaacaaaaaatgaacgtatacaagcacagatttttgagcttcgattgtagagaaatggtagttatgtggcttgccaagaaagtgcatcacctacttctgcttctggggacagaggtgaaggggtctgttctggaactttctaaggaggccatcttcgttattacatcagggaagtttctagtcaaaatgttattcctgtctacagggaaaaacaaaagcaaaacacaaaagaacactgcttctaatggcatcatagcaagsagtttatctagaaagatgatgccagcagtcacctcttttccaggaagacagaaacaaaaaccgttctcctcgagaggccaacagtgtagaagccccttttccagaactttccaaggagtaggtgaacttctttgtaagtgtatcagcacaggggagagtggtgctccatgttccaaggaagaaaagcaacccacagctcctcctgcccgtgcagcagatgaccagaaagacgagaaagggaaacaaactcccaytcatggtgaggctgcttgtttctcaaacacacttttccaatgcctccacaagttgyttgtttctgtattttgaaagcactcaacatgcagagtatttgctaaccacaggcagagtacccagtcaggatgtaccaactcaaactcctccctggggcaggcaaggataaacagggaacaggtaagagaggcctaaaaagccaggtggacagagaccacatgtgaccccaaacagaaacaggctgctggaaactaactctctctctctctagctgatacttattcarcacttactgtatgtcaggtactatyctaaaaactttacgtatagtaactcagttttcacacagatgcaattattttccatactttagagatgagaacattgaggcatagagaggttaagtaatttgaccaaggaagcacagccagtaaatggcaggccaaggatttgaacccaatcagtatttttttttgtagctcatctccatggagttagttggagtctcatcagcacttcctcgtacagggctccattttactgatttctatcaaccacaggacatacttttcttttttcttcgtaccctgaagaagaaatgcactaggtaacttcaatatgatggcagtaagattgtttttcaacacatacacacacactttcaaaaaaaacttagagaccagatgcggtggctcacgcctgtaattccagcacttcgggaggctacaagcgaaaggaagtcaagaccagcctggacggccaggcgcagtgtctcacgcctgtaatcccagcactttgggaggccgaggcgggcggatcacctgaggtcaggagtttgagaccagcctggccaacatggtgaaaccccgtctctactaaaaatacaaaagttagccaggcgtggtggcacgcagctgtaatcccagctagtctactcgggaggttgaggcaggagaattgctggaacctgggagggagaggctgcagtgagctgagattgcaccactgcactccaacctcggtgacagagcaagactccacctcaaaaaaaaaaaaaaaacaaaacaaaaaacaaaaaccccgcctggacaacaaaatgagaccccatctctataaataattagccagttgtggtggcatacacctgtagtccccagccacttgggaggctgaggcaggaggactgcatgaacccaggagttggaggttgcagtgagccacgactgcactactgcgctccagccggggtgacagagtgagactccatcttaacaacttaatggtaaagcaggcctccagtacactttctcctccctgtcttttcttcttttctgaagattactacttactcaccgttccccattggtttagatgataacagaagaaacaggacactataaaaaccttattttgcaccacagaaagcaagatgtgaaggcagtcaggtttgataacagtgcgcactgtttttgcagtatctttcatcacgaggctctcacatcatgtgctctgagctcatgtaacacactctgctggaatgcccccattcaagaggggagagagtccgtgacagtcctccctgcactcactgtgctagcaaagatgtccgggaaggacagaaaagaatgtaatgtgcaattaaaacaagggagagtgattaatgtaggcaaaaattaatcacaagggcagtgtcaaagtttggtgggacaactgcgtgttcagaagacacctgaaaaaagtaatcccatgataaataacatggtaaaaagcttagattgtgccattaagttttcttaatattatggataaaatgacaacaggcaaattattttctttcccaggtgaaatgaagaaccaaggatcatctgagcaaagactcaaggaccatttgaacaaagacatccacatctataccacagatgacttggcatctatggaggagtggaggtgagcaccactctaccatgtagrggaagcagccactgtggaggctgggcttgtggagattccttctggatgccctcagatctgtcattaatggggacaaagcagaatcaagggactgctctatctcatctaccactaccagctccaccatccagggtactgttcttgccactgcatctagaaagaagaggaatgcaatcttgcagttagaaaaggctgtctcgctgaatatttattctcattcctctacccaaaactaatgaaaatgtgaagtctgagtggtgtctgaacctaatattttcgtgtccgaggcacacaaggttgagctgccacttctagccatctgaaccacccagtgtgagcatatatgtggctgggagggtgggtggtgatggtggtggtagggaggtgggggagacttctaatgagaggcagtagagagtagggtctaagagtaggtactctagagtcacactgatttcggttcaaaccccaggtctgccatttactagctgcacttccttggccaaattacttaacctttctgtgcctcaattttttgtctctaaagtggggataaatagttgtatctgtgggacaactgagtatatggcaagtgtttagaatagtacctggcatagagtaagggctgaatgagtgtcagctccagctgtcatctaggtgtaagctcactggcagcaggtgcaagattcttttggatggctaacaagctacagctttggctgacagtgctgtttgtgaaacccagtggcctcttcactccatagtcagccttccagtgctcctgcccttggtggccttggcaggagcctggggttgagtggggactcagacaactgaagctctcccagcaaaagcaggatccccacgtctcccactgacactaaaaaacaaattcttgaatttttcccgggtctgctgagtgatcacaagaggacagctggggctggatgacagagcctcagcagtgacagggaagcctgcttacttccctcatgctcagagtgccttttggccacgggcttatttcagctgtcttktgttccatttctgaggctctaaagggatgctctgggaactgggatctaggaataaatcaagatgagtggggcaaggttaataccctgattagatcagcctggcccaacgccctttgaccttagagtactggaaaagtcttgacaggcaagggcatgaaaaggtcatgtgctccaggggcactgtcttcaaagaggagccttcctggggtaaacaggcgcatctaccttctcaataacaggttcaaaattcaagaaagcaaacagcattccctaactatcaatattccactaagtcctagaatagttttagtttttaacatcccagatagcattttcaattgtaatgcctggaatgagaggcagaggatcttcagggtcacgtgctattttttatgggtttacatgaaggatgcagatgtcattttaatttttatctttctaaacatagtttggccaccatccctgctgaagaccacagtgagtccaaagaacatggttaactgaaatacacagataatcacagaaattacttttaggcaatgatgtcaactttgtcccactgatggaagaaaataaaaaagctgaaattagaaaatctaagttttttctcataaaggtgaaccccaaacctgtccaataatactctactaaataaagtctgttagtaaagaagggatgaaaaaaatcagtacctaaaagactctcaggccgtgaaaatgattttgtaaattctcaaatgggctttgcaagccaacagatccaaatcacaactgtggtcaaggcattctgcagagtctcaatgctaggtgaagaaggcatcttgggaaccagcagactgccactctctcaacattgaaaagatatctccattctttgaaagtcactttcagccacccagaaagttacctggagaaaagtatggtgaatgaaactgtttagagtttgagaaggagcaggtctttcctatgtaaaaattccaatgaataaatgacaataagatagaaaattgccattaaagcatggcagtaataattattgtagataagctccaccaaagcatgacaagatcagtgagtgacaatgtgatgagaaacaggacctyggccagttgtggttgggaggctgaggtgggaggccaggagttcgagaccagactgggcaacatagtgagtttctacaaaaaatttaaaaattggtgaaggccaggcatggtagctcatgcctgtaatcccagcactctgggaggccgaggtgggcggtcaggagatcaagaccaacctggccaacatgtgaaaccccgtctctactaaaaatacaaaaattagctgggtgtggtggtgcctgcctgtaatcccagctacttgggaggaggctgaggcaggagaactgcttgaaccagggagttggaggttgcagtgagccgagattgcgccactgcactccagtctggcgactgagcgagattctgcccaaacaaaaaaacaaacaaacaaaactggtggggcactaattagtgatggtgcacactagctacttgggaaactgagatgggaggattgctcaaacccagaagtctgaggctgcactcccctgcctgggcaacagagcaagactgtctcaaaaaaagaaaaaagaaaagaaatatgaaaaaagagaaacgagacatctrcatactgtgagtatcagccctaagatatcagtaacaatgcgaaaagcagaaaatttacactggagaaacctggcaggcaccacctcaatcaagtgttcaaggctaagagatcatcagtggtaagatgctgacatcacacagatgtgacgcactgagatgcaatgtcaatcttgtagtagtcttccccaaaatgtataaaaatgagtttaatgatgagaaacattagaaccaatttggagcattctatgcaacaacctgtccatactmttcaaaaatatcaaggtcatgaaaaacaagcaaagatagacacatttttacagactggagaagactagatatagtaagtaaacacaatgaaggatgttgggactgaaaaaggatattagtgggaaaactggtgaaattcaaatagtccatggttaacagtattgtgtcattgttaatttcttggctgtgagaattggtgtatagattatgtaaaatgctaacgttagggaaaactgggtgatattttacaaactttttttttttttttttttaaagagacagggtcttaatctgtctccaagactgttgtgcagtggcatgatcatagttcactgcagcctggaactcctggctcatgcgatcctcccacctcagcctcccaagtagctgagactacagccacgtgccaccactgctggctacttaatttctttttttttgtagagatagtctcacagcttggtctcaaactcctggctttaagagatttgtcttggtttcccagagcactgggattataggtataagccaccatgcctggatgctttttcaacttttttgtaagtctaaaattatttcaaaataaaaagctgagagagagagaaaaaaaaaaatcagttcagtttctccccggccagtggggtcatcctcactacaaagttgctggtttgggctctagctctgcggattttcctcactggacgaatttcataattgtcgctaccactgatattacacaattgagattctaactgaatggagagtgatggaagaacatgaatgaagaagtcatgctgacattggggaaagagaacttactgaaaatttttaaaatgttaaatattttacattatcttcacaatccctgtacccccaacmccttccacagcaaatctccctcaacaatacttcagtaatctggctagagyccaaaacaaatacttcttattcagaacttggctttgaagaaaatgcagccctaacaaaattttaagtaagttactgaaggatgcagaggcttcattttacaggagttagttccagaggtgattttgggaccagcattattcccagaccccaaccacatctaaagctgccaggagggtctggcttttgattcctctgtgactcctttccagactaaatcaatgtcacttggttccaacaactgcagctcttccctactctttgacctgctgtgcctaaaatttaactttcccaaattgaggagggttcatcctccttgcctgggtcaatccttggggtggacaaaaggtattaagacaactatggaagcctatccactctgtcgagagaaacaattactcctaaagaaaatctctacttaaagccacgattaaagtcactctcctcttcatccctcaacaacttgctttgaaarggtaagaagggaaagaagatgagtgcttccacttcgctggtaggggtgaatggtaggtagtcctatctgcactctttccatctagtcccctacacataatagcaacaagtgtgctagttgtatgctacagttgttgtagcctcttagcagagccttcaaatcctggtgtgtgggtgtaggtctgtgtgggaaggtgtgtgggtgtaggtttgtgtgggaaggtgtgtgggtgtaggggtgggtgtgtgtgggtgtaggggtgggtgtgtgtgggtgtaggggtgtgtgtgtgtgtgtgtgtgtgtgtgtgtagggggggtgttctcttgccctggccacctaaaaagcctaagttactactgacaaaggatcctattccttttcactcaatataagcctataagacatctcaacactcgccatcttacaaacatagagaagcatctgggtgtctgggcgtgccctggacccacaaaaatccctaaccaaaactgttagctctgacaacggtttaagcagaagtaatagcatatacctctgaaggcagaggtttggtttttattgctaggtttactcctgctcgtttataaggatgccctaaatgccatctcccaatgaaaacccttccatgtccaggggcaaaggatgctctggaccctcaatgcttgagcctactgaaccatccaggaccacttcgcttggctcgtctagtgatgcagagctgttacatggttctgcaaaggattctcagagagattcccacctcacagtcactgctttgctttcagatatttctggtaacccccagagttcagtgtctttctagcttgatttgtcccaacagaatggagccttattgaacctatggatcaattctggtgaaatgtcaaataaggcaaaataaaacagaagtaagtgtgaaggcaagagtttttaccagaatctgaccctttkgtgagataactcacgtgacggaaagctctgatgatattgctgaagctggagtgtttaatgacctccattttctcaagagcattttccctgtaaacaaagatgacaactgttacagccagagaaagtgacagcttctgaggtttccaccataaacacttgctgaggctccactgatgccaggcaccatggtgatgctggtgatctaaagacaagagtcaggcttaaaagctttgcaaactctttcccaaaaaaggtacagtctaggcaaagttcaagctgtaaacttgtaacttcaacatcagctgttacatgctccagcaatagaatggattaatttcttggggacagaggagaggatattaagggtaaagaaggattttaattaggagatgacatctggcaagtcctcataaacccagcagcacagagctggccacataaatcaaacccttgtattcagggtccatactattactcaacaagggtaattcgagtaattaccagagttatcatgatccaacacataagttcatttgaggaccctgactatgcaagcatgaatatttttttggctgcctctagatagcatgtttatgaaaaacaggttaagttactggctccaaattactttttaataaaaaaagcaaacaataaaagcttaagcttttaagatttttcttttttgtttttaacctggaaaataaatctccctgtcaaaaacatgcaaaatgaatgatttatgtgatataagcttgggtatctgtgttattattacatgacatttcctaacagcttataattgccttaaagattgttttggaaaggttataccttctccctattcccattccctttaaataaacccttgtgtaatctctggaaatttttagactacaactatcaatgggccattcaaaaatggagccattgtcaagtcacccacatgaaatagtgaaggtttacaaccaaaagagaatcgctcacttcyacaaaatagctgatggaaatactgtgctccgggggcttacgtggaacaaacattaggaaggtgtctacctgcaaacccgctctaaggctggaccaaaccagggggtccaggtcaatcacaagtactgaatcaaccaggaaagtccacagaatactgagagccatcaatgacaccactttagaatttaactgttccaaaccctttgtttggcagatggggaaaggagaggtagagggagatcagaagagtcaatacaagaatctyggctgattggctggtttttctaatatggttcattcaccacatcatgttattctattgaagttcaggagagggtaccaggggatacctcaacccaaaatgacttcttcacagttttaagtctagggggaaaggcccataatgtagtcctcaccactttttcctaggaatggctagcatcagacatgacctaaatctgtagagctagttcaacattcaggttaccaaacaaagtcatgaaagaatgtaattactatcacagacatagactgtctaggttctaaagcaattaagctggtaacgtactatttacaataaaaaaattggtttcacaaacctgtaacagagaccaggtaaatgtgccagaaattgtataaaccatggcataccttgtatcaatttttatgtagacacagcaagcaaacacagttttggaagataattcctatattccaacttagcataaggtaattaactgtgtcttaaaagaggaaaagaaaggagcctagagctttattaggtgtcccacctaacttaaatttgtttttctagaaaaaaaccatgcactcaagaaaggcaatcaagatctacatacttaattcacattcacagaaacttgtgaatatatctgtaaaaggattatcattaatccttcaagctcctagagtaggaatacaatacccgggcagtggttcaagaaatctaactcgtgagaaggttacacatctcaggggtaatctaataatgtaaacttttacaaactttccttcctggtctcttgccttcagtaggtcattcatttaaaaacataatgagctcctggaatatgctggggaccctgtggggaataaggcacttgtgattcctgcacccaagagtgtagctggggctacaggaatgttttaagacacctcttaactgtttaaccgctagtgttttaagacataattcctgccct

SEQ ID NO: 13391 - DNA, 15042 bp, Homo sapiens
ccagatgtggtaagaagctctttcagccggacttggtaaaatgccttgtttgaatcgaagtctgaattggcggttatttttaaattaataaagtttttctatttggaaggacttctaataacatagagcagtatcctaagaagcccttggggacttttttaatgaattagaataatgtgcaattagaccgacagttgtaactgagtgcttcggagggcttgaaagtagttgttctcaagtagttcacgtagcatcaagttcacagaaaggattctaaggcactgaattgctcgattttacaatgcactgggatataaatgaacaaatgcactccacagtacatattaggcattccctaggcttaaaaaacccaaaaactccaaaataggaaaaaaaaaaaaaaaaaaaccatgctcagcaaatatattaggataaatatgtatcagaaaaatattcgtttcaggattcctttaaatagtaagtccgcctcatgtctgtgtgtcttcacagatcattaatttcttggcaaagaagttggggtgcagacaccctgtggccacagcactggaactgaaggtcagtgggaacgtgatgagaggggttttgaaaagtctgcgctcctctgaaaacattctgactatgccttttctctctccacggtttcccaaggccactactctatcttcctctgtttgaatccaaacagaagtacaaggagtcagatccacaaatgagtcgttttatcttgccctacctctctgtgcagtcaatggccaaccatcctatggatggacagtcacaggggcccaaccaaggtgtcttatacgagcaggcagagggcttgcagtggctttttgtaggtttttggctggagctgaactaactgcaaactaaaaaaaaagttcccaacagcagcccttcctgaagctgacggtctgactgtggaagtttagcccgagtatttagggtgctgggaagacatgagaactamcttatgtcctttgttttcttcctaagcaaactgggcagtcttgttcatgcaaaaccactatggagtgatcactgtaacaggcacgctggaccagagggtgaatgcccccagcgggaatctctccctaaagccttgctttttcacatcacgccacctcccctcttccaaattttggaggcktactaccaataggaactcactatctgactgattaatcagctttcagtagacaggagcgggacaggtgtgggagaaaacatttctttccaactcccattctccactgcagaataccacaataagaaatcttaggccgggcgcggtggctcatgcctgtaatcccagcactttgggaggccgaggcaggtggatcatgacgtcaggagtttgagaccagcctaaccaacatggtgaaaccccatctctactaaaaatacaaaaattagccgggtgtggtggygtgcgcatgtaatcccagctactcaggaggctgaggcaggagaatcgcttgaacccggaaggcagaggttgcagtgagctgagattgcgccactgcacttccgattgttaactagcagtttaaatgaccacatttaatcagctaagtgagagttggtttaaaaggccaattacaaaagaagtggtaaatggccttttaaaccaattcatagtatctccaaatgccttggtttaccaagtctgagggtttcctagaactctccttataagcattagaatgaaatctagtcctggctcttttcccatraccacttcctctttggttcattaagaatataaacattacttaaatagagcaaagctccctgagctaaggggtcttcatggtatacattcaaacggcatgtgracgaggttacagggcatagtgcagaatccctcctcggattccaaggtggctaaaaatgcctatgtcagtggatttgcctgttttccaagtcatttgctctgaaactcctaaatacaaatatgaaaacaacagcatgagacttcattgtcatgtttatttgttattcattctctgattcggagttggggggcaggggaaggattagacacaattttaagccaaccagcctctaaacagaaatatggtttattctcggtactcaaattcaaatcttagtaacatagcaattacattttaaaataaactatctccttgtgcttgcttctaaggagagtgtttagtrggatatgaaaagagtctaatcctaggcagccgtatggccagaccaattataaaccccgtagacttttcacacgtcacagagagcaaactgctccaggagcagctcttaatactttaytgcctattcaggtgcacctgcacttttaagatatacttgtcagcaacaaaatacagcacttycctctgtctttatcacattggttgccagacaactgcacagagctaaagtaggtaatgttacagtaaacagctccctaaaacatttacatatgtcactgataaacaatagaaaatttaaaagagatacaaatgtactcttrgaaccttaaatcttcttcccactgaggcctaagaacttaaaatcttcatacacctggctgagaaaaaggaaacaaattccaaaggaagtctagatttatagcctaaatatgtcttcctctagaatatttaatacacttaagctttagtcattctatacactttgaaaatgcccttcaaygataaattacagtcgttgcatttttcattgcagttcacttaaatatcattttgctttcaggaaaacaattataggacagtaaatcacttttacattgcattccaaaaatatttaagttgcaacatggrcaatgtgtagaatcacaagaaaaatacagcttatatattctatcattcagtcttctacagcaaacgttaaatccctgaggaaagtcctaccgttagtttggtttttaaatatttagattatttcarcgtatgcacataagtattagtgcaacaaatatttactgaactcccgcaatatgcagtcatccagatttggggtagaaatttgggaatccccctgatttcaagatatcaaccactactaccataattacctgcttcatgggcatttaacatggcaggccccagcctaacaactctacacacacagactataccatttcatccccacaactttcctgagaggtggagatcatcattctgattgaaaagtatggaaaggtcaccaaggccacatggctggtgacactggaggatctgcccaacattcacacccataggggtgatcagtatagcatgccctccatatctgagggctccacacccatggattcaaccaactgcagatcaaaaatattcaggaaaaaaaataggatgcttgtgtattaaacatgtatggacttttctccttgtcattattccctaataatacatgataacaactatttacattgtattaggtgttataagtaatctacagatggtctaacgtagtggtccccaacctttttggcaccagggatcggttccgtagaagacaatttttccacagatgggtgggggagagggatggttttgggatgaaactgttccacctcagatcatcaggcattactgagattccctgcatgttcagttcacaatagggttctcactcctatgagaatctaggacctctgctgatctgacaggaggcggagctcatgcagttaatgctagttggcctgccactcacctcctgctgtgcagcctggttcctaacaggccatggaccgggactggtctgtggcccaggggttggggatccctggtttaaagtatacggaaagatgagcatgggctatacacaaatatcacaccattttataaaagggacttgagcatctgtggattttggtatctgttggggtggtcccagattttggtatctgttgggaggtaccagttttctcagggaaaactgtatatggtgccactaatatggtgccactgtatatggtgccactgtatatggtcttctaagctatgccaagtttgtaaaattaaagaacaaaacaaccgggcatggtggctcatgcctgtaatcccagcactttgggaggtcaaggcaggtggatcacttgaggtcaggagttcgacctgacctcctggccaacatggtgaaactccgattctactaaaaatacaaaaattagccaggtgtgatggcgcgtgcctgtaatcccagctactagggaggctgaggcaggagaatcgcttgaacccggaaggcagaggttgcagtgagccgagattgtgccagtacactccagcatgggtgacagagcgagaatccgtttcaaaaaaaaaaaagaagaagaaaagttaaaaaataaagaacgaaacagcgtaatagrtgatcaagtcttagragagtgactgcagactacaactgcaacagagtgtttaggaaaaaatagatgttagctagtragtgatgatcaaggaaaaagcatgggaaagaatgccgagcaagtgggagaacacatgagtaacagcagtggggtgggagacaagggcccagccttttggcagaaccttcagaaaaccagcctaatggcccatgcctctggaaagcagcaagaagataagccaaggtgtcctgggggaaagctgagtctaatggttaggacttcacatcacagagaacagggagccaccatggtattttgaacatatgagtaccttacctaaacgagttatttagataaraagaagtctgacaataatttacaggatgtattggagggaaggaaaagctgaaggtgagaccgaaccatgaggctgcaccagagaaaaggcactgggactgaaagagcagaggaaaacataaagggcatttcagaagagtgaaagagatagggaggaaagttcctgagttctgcctaattatgtgagccgttcaatactcaccagcaagtgaggagaggaaccaggtggccgtgcacacagggatgtgcatttgctctcttcracctggggagaacgggcagccctgtcaatattctccactcctgtataggctgctgtcaaccagtcagccccgagaatgacaatacttccatgttaccctccctagttcygagtgctggctatgcgacaaacatatttttaatgagaaaaactatttttgtttcagttttgtttgaaccacatcattcacaaatgactgagtataagaaacaacacaattccaaaaataatgttgcttaattttaggatgtctagtctttttttccccctctttctctctcagaatatgcctgaaaatagtggttagccaagtttttgtttgtttttgtggtggctgttttgtttatttaaaccagggtgagaaatattttctgggagttttaactactggatcacaaacagaaaatgggggtggcagctatgcaaaaacccctatgatcatgaaaccaagaagttatggttactaagcactgtgaatttaacaggagcttaaaatcatggctctgacacctggaaagatgccactgggctcagaccagccctgtgcagctcacaacttcaactggaatcaaacctgaccatatccccacttctcacttaaaaagaaatggttttggccrtactggtagagcaaaaccagaaaatagactttgaattagtcttcatgctttgcaaaaaggtactaacttgttaagatgcatcctccatgtctaactaagcctggtctaataactgttttgcatctgtcctctagcagtctgctgctgattggtggtgggaggggaagagggaaacagcttaaaccaktactcctgttttgtgggcatttgaagtagctgccaggcacatgacaccactgctccaattggttcagagtgacatcacytcatgattcaactktgtttgcatttcggcttcctcctttccaaggggttctcaacttcaccctgccaagtcactttcaaacagaaagagagaggaacagcacatcttatgtagtcatgaagtgtcaaatgtcctttgtgtttcttagcccagtttatgagaggagacctggagaaataaaggtttcaatcaacaccacaatggtgtatgactttcttcacagcatgaggtggggggaacgggaagaaaagcaaaaggtggctgctaagctttgagtaagttaaaactgatggacttcaataaaaatcctcaaagtttgttttcaagtgggaaaactctaaaatagaaaccacatgcaatactatgctggaacctcatttaaatcattcacgcttctaagactcagagaatgtttctaatttagtcaaacactaccctctctttctccaaaataattattcttaatttatttcacctaacttctgttttttacatcttagcaatgtgaccaccaraagctggagcaactgctttctgattcagaaaataaaagtttattctgatttttatttctgtcttccatacagtcagttaccagggaactcacaaaatttggagagttcgagcacgattaattttgtgtgttcagctcaaaggaaaaagcttcctcataggagaaatgcatkaatggatgagcgaatgaataasargctttataacccaaccaaccagaagccgaggggctcactatattaaattataccagctctcaatacaatgggtcaaaatgtattttattttaaattctaagttaggctccaaactttacatcgggaccttgtaagacgagatcttttatcatgctagacttttaytatcccctaggaaatgtagtgacattaaccaaacacacaaagccatctcaagcctaaaaatgcctattactccaatcctgtactcacttgctccctgccagagayaacayaaagagatgagtatacacactcaggaaaacttygcccgggccttcsaggtagggcsaggactgtgcaccacacgagatgacttgaaaacctgtaggaaggytgtatctcagtgccacttgctttgaggagactcactgggtaactgtttgagggtggctctaatgctctgcaacagtccctgcagggacaaagagaaatttccatctttctgaaggcctaacatctcttttcttgtaatctcattgacttgccttgcctagactcaccagtcaattattatttatcatttacagagtagctcatattgacaacatacctacaagtattttagcacttcatataccttttatggtataagtacctgtggaagggaaagggaaatgagttggcctggagtgggaattaagaagccatcatgaatatacatgtgcctgtgtgtgtgtgtgcacacatacacccgtgtgtctctccacgtctgaggccagcagctaattcctgctcacctttcaacacttctagtcttggctcctgagccccaggtactctattcctgaagatccttgcagatatcaatcatcccaagaatgggctagtggtttccgggtttcatraataaagctgtcccattctcatcactaatcaaggtaagagagttacatcttatttctctgccttggtttcatcatctatggaagagcagtcatactggatctcgaaacatgcattttagtgcatcatgcacatttaacgcctccctcacgcatcactcaactgactggcaagccaccccttccccttcgactctcttccaaaaatgcttacgaacttgaaatccagcaraaaaggggccacagtgactacgtactcatgattctgttttactcttctaaattcacggtctacttactattaacttatatacacgttaatatttaagttccagatccaagggaggtaagaagcagctaattctagggaggcagggctagagagagtgatggtaaaatcagtttaaaaaggggggggggaggcgtgtttaaaataaaagacaactataaaaaatcaacagaggaagggaaaaaccagaagcgcacaggccatttagcgcaatgtagcgcgtctcacaccagaagttgtttacacactcttggacgcctgagttctccttgayttttgtttttcttcattttatctatcttcgtttatccatcttctagttcatctacttaaccttcttgtaactcagtgctgccaagtggattcggcatcagcatttacataaaaaacacattgcaagcaaactgcattactctagctgttgtacaccaaaaagaaaagacacatttaacatataaatatgtgttcacataccaagtgaagaccaatttatgttgtggtacttccgtgaactggggccttgcgatacttaaagaaaaaattcaattgtgatgtcaaagagaggtgttccgtaattcaaacgtactcaggccttcgaggtcagtttattcacattctgagcagtggtttacttttagcaaaatattacccatgtcattaaattaatatttgggtttgaatctttttgttttakatgcacttaatgtgtaaaatcatttaacttacagttgtaaaagatctgcaagcgtaaaaaattgacacctaggccttataaggctgtaggtatttaagtatctttataccaagtaatttataatgacactgagggtctgtgaatttatcttttgcttttaaaaggtgtctcaattaccttagatgaaaaactgccttgcccacctgggagcatcattatcttatcatagaatgaagttactttcacagtgatgaccctgagtattgasaaaaagttggattatgttcattatattctttttaatgcaagcaatgtaaaacgtcctttakaaatgtttcctttaaaaattatttaaattgtattgcttaaaaaatatgactctttcaactcagttatcacttaaggtttcctggaatattctgctgtttagaacatatttgtaggatatgaaattacctacgtatgtgactcttataagaccagagaaaaaggctagaattatatatatatatatatgaaaatagcrtcagcaattccacaaggccatcaacttggggtatgaactatccgtgaaggactagtgatggctgaacttcaaccacactctgaacagcataaaaatgagaaaactgtactccttgatctttagttctcaaagtgtggtttgtgaacgcgtaaggattctgcagctttttcagggggtctatgagattaaactattttcatacactactaagacactgtttacctttttaactcttattgtctcatgaatgtgtgccgtggaagtttccagaagctgtgtgatattggcagcagaataaacatagaagcaggtatgatcatccaattgccttctgttaagccagagattaaacacataaaacaatgccactctattcatatactggggtgggatatagtttttatccaacataaaagtacgttaacgcatattaagttttgttactgtttctgaatcaataaatctttttaaagttattaattttaattcttcatacagcaagtatcaatggatacaacccacataaacgaaagcttattggcgtttgtcctagcctgtctgggcacctataacaaaacaccttaaactaggtagcttttaaacaacagaaacttattccttacagttctagagtctgggaagtccaagatcaaggcactggcagattcagtgtcttgtgagggctccactttctggttcacggagggcaccttctagcagaagaggcaaagcagctctcttttataaaggcacaatctcattcataaaggtcccccaccctcacgatttaatcccttcctaaaggccccagctcctaatatcatcacatggtgattaggtttcaatgcatagattactggggcaacataaacatgtagacagtggcagggttttccatttttaacagtgtgaaggggtccagagaccactgaatttgaaaacccctggatgatttcatttttctcgacagggaagctacaagtagatgagtgccaaatgtttctctccattcctggcctgtcccctgagccctacactgctgtgttcaactccatcttagcttgccccccctggatgtctgaggcatttctgacctgagagatgcaagacagagctcctgycccatctgccttctccaccacacacttcccaaactacrctgctcctccctccccactcctttgcagctcaggaatggaagcctccaccccctgttctgtccaagccaaaatgtctcagaggtatctttcactctcccagtctccattcccttcaggctatattttacaagtcttcaaatattcctaaatctatccactrcaaattgctatgactctggtccagtggttctcaacagggtacaattttggtctccccaccccctaatcccaggttaacatctgtcaatgtctagatacatttttgattgtcatgactagggggcggggtgggtgggcttctggcatctagcaggtagagactagtgaagctgctgaacattttgcaatacacaggacagccccccacaactaattwtctcacccaaaatgccaacagtgccaatgctgagaaacctggcactggttcaggactgcacccctaccccccgccctgccactccccaactaattatytcacccaaaaygtcaatactgccaatgctgagaaacccagcactggttcaagccaccaacatctctcatatgcacggtcccagcagcttcctaagcggtctccctgctttttccactattcctccttctccccttctccacccagcagctagactgactgttgtagaaatcagtgtgccactcttgtgcttctcactcatccccaacttccactgtgtattgagtaaattctcactcttgccatggcctacagaccctctctgctctggtcccatctaatactgtgacccatcttataactcgacgctatgaaatcaattgtgtctcayccccggccacctcccacctccaccctgccaattcatatgtaggaaccctaacccctcatgtgactctgttgaaggtagggctgttaaggagacaattaagatcaaatgaggtcataagggtgagaccctgatacaattggattaatgtccttaatcagtgaagagacaccacagcttgctctctcccaccactatrtgaggatacagtgagaaggtagctgtttgcaaaccaggaagagagccctcactagaaccagaccttgttgacacctgaccttggactttcagcatccagaaccatgagaatatgcttctccaaccatgacgctggagagaagaggtgaagtaggcagaggcaagactgggaaagtagggctggggtggtcagaaagggcaaatcacgaaatgtctggtgtgaaaggagaaagggatctccccagagcttgagtatggaagactattcaacttcagaaatgaacacagagagggagagggaatgctgcaatgtctattgtttaagccacccaggctacagtaatttgtcaaagcagcctgagctgacaatcactctcagtttccctcatcttccaagttccagccttgctggtcatcagtctgtgcccatgtgacagctttttcttcttatcctttctcctgaacttcccatggctggaccttccaatctcccttagtctaaatgccaccttttcacagaggcctcaatgactacccagcgtaatacagcacccctcaaccacacctggcccccaacccagcactcctgcattgtgatgacagtactgttttgtgttttcttcttagatgctcatcactagcttattattctctttactgtgcatcctaccatccccaccccagtattcttactattattattattattattattattattattattatttttgagacagattctcgctctgctgcccagtctggagtgcagtggcatgatctccactcactgcaacctctgcctcccgggttcaagccattctcctgcttcagactcccgagtagctgggattacaagcatgggccaccacacccagctaattttgtatttttagtagagacggggtttcaccatgttggccaggctgttcttgaactcctgacctcaggtgatccgcctgtcttggcctcccaaagtgctgggattacaggtgtgagccaccacacgcagcattgaagaaatcttttctgtcttgatcactgctggagcagacagagcaccacagctgcctaatgtttgttaaattaataaataagtgaatgaacctggctttgaggatctcagatccatacaaccgggcatttatagccattctctgagtcaggcagctttctggagccacatggttatgagaatgtgccttgccccaagattcatctccctctcccacctccccaaagaaagctgccatgtttgtggcaatctcatattcctctggggaccacatgggacaggaaggagtaattaactgcaatatccacagcgagtagctattcatattcttacactccagggagcatcaagtcttaaggttacattaaaacacaggcacaagggaagtccccagtgtttattatctgcagctacagagtgggtaaggatgagatctggtcacttcaattgaatttacaggcaacttctcaagagcccaactttgaactgcccaaagaaaacacaggcaagtcctactggcacaagagaatggggtgggccgatggggagtgatggccggctagggttgacatttgttttttccaccatattcaacacaggcaagtgctttcgaattactggctccctgaaaagggggatctggacacatatggcaatgcgatgaatgatgattcctggaaagaaaaatgyttaatgaaacaagaaactcacaatttcctgagacctgatatgcacaaggtactgggcagatcttgtagttattgatgggaatttcagagaaaggcctgatgaggcaaagctggctgctggaacctcaaagagacaggaaaacaaggatgagacccatgattagggccactgtgaagactccagaagcttctgaggttcgagagaagaggtgaagtaggcagaggcaagactgggaaagtagggtggctggggtggcctgaaagggcagatcacaaaatggctggtgtcaaaggagaaagggacctccccacagcttgagtatggaagactgttgagcttcagaaatgaacacagggaaggagaaggaatgctrcaaatattttaccatattgacttttaattagttgagaatcaatgtaacaggtctagacctcatccagggtggaggcagcatgtgggcaatggtaccaagaaagcatcagaaagaagaagggcttggaaggcaactacagaacaggctgccccacaycaaacttaggtagaataagactcacttccattgttccttctctagccaaagctagagaagctctgaatttctctgcatttcgaaaacactccaacacrcagagtcacacaaaactctcctttggaccagatggaccctatcctacgcactgagagatttggagtgaatgggacaagaggtaagcccagtctctttcctccctccctcatcaccccccacacctaacctcttccaaaaacatcaaatattttcttccataaataattgcaataggatgccatagcttttcccaaacaaacaatagcctgattgtgccctgtttgcatgggcccagcccggcatacacaaaggcctgctttcatgcgccaggcctctccccactgtagaaggatgggcatatttcgccctcctcacttcttcaacaacttcactgaggcaattccattcggaaaggagcaacaggaagaggttgttaccaccaggaataggagcaactcccattaaaaagacagccattgttccccaggttttctgttgcctttcgacctcatccagaaagttctttcaccagaagagagctggtttgccccaagagccaaatgacaacatcttatgctggtgatttcttttaaactttttattaaatttcgaatatgattttaaattgtaatcactgactgaaaatattcctgtttttatgtcatgtatcttcttaacagtatcagaatagagctaaaacaaacgcataaatttttgtactactaattatttttctggtaagaaaaaaagctgaactaaaagattaaactaacaactttataactgctactctgaaaaaatatccttttgtgtttaaaaacatgaagtattaagtttcctttcagaatgtaagtttgattttcccccacagatataaggaagcatcatagcaagtcttcttcctgtttccagtaattcggaatggccattctcccaggtagagccacgcttatatcagatacartttcttctccccatttttggtcttccattcatttctctttcactcttctaatttaagtgaaatggaattccaaatggccaagacactaataagctctctgaaagccatcttgagagcatatacatttttgtttttaaaaccatataaacaggctgggcacagtggctcacacgtgtaatcccagcactttggaaggccaaggtgggaggatcacttgaggccagaagtctgagactaaccccggcaacacggtgagacccccatctctacaaaaaatttaaaaattagctgggcatagtggcacatacctgtagtagtcccagctactcaggaggttgaggatcgcttaagcccaggagtttgaggttgcagtgagctatgatggtgccactgcactccagcctgggcaacagagcaagaccctgtggctatatccatccatccatccatccatccaaatcatataagggcaccgaaagcagtgctacacagggcattaaaaaaagctttcactgcctggtaagtgttgctccaaagtgatgtatcattcatgccagaaagagtaacttaaattaaaatgtattttaaagttgaatcttggttttgcaacaggatctagtgacgcaagcaacccacgatgatgtgctccatttgctatg

SEQ ID NO: 13392 - DNA, 20026 bp, Homo sapiens
atgccaggctatcccacgtacctttcccaaacaattcccaaacaacatggatgtggtatctgtgtgtcctcacaacttcattactgcacagaaatagtacctcaccaccaaaaaatcatgttcattggaactgttctcagaaaaaactccaatcataaggcaatgttttataatgagagtttatggatcagatattctgactaaattcaccaaaatgatttcagaaggaaaattactattatcttacagctgctattgtttcctctaaacttatactatgtcagacagaaaatccgactgcttgaaagaaggacccataaacggcaaggagacagggtatacactaatgacaacaaagctatgacaaaagtgaagtggcttccacatacacagtgtttcactatggcccaggccctgctgtaaactcctcacagggattagctcatttaaacctcacagcacaacaatccctcactattaatgccatcttacagagagtgaaacagaggcatgagtctcaaaaatggcagcacaaggataaaatcccatctggctgctgagtggatgttttggtccttatcctatctcagagaatgcattcaaacctaaaactatgccaggagtctaaatttaactcaaacaagctgaagaaaaccaaaacgtctcagatatcacaaagcagtgcatttattgcataatgttgcacaacaaggaaagtttctagaaagctgcccgaacttacatggttactaccaacatccaagcaaaagaaagtcccaaaggacaaagaacgtgtcccacatgtacacgatctggttcatctattcatatatccaggatgcagcctgtgctcagcgccctacttacaggaatctgagctttacgattagtatgattttagctgctaaaaatgtgacacctacctctaagtcatttggatttataaaaatcccaccatgctacaatcaagaaagcatttcactgagcaactgtaagccaggtacagggcrtgagctgaagaatgtcccaggtgagtgaggccgttctaatttcaacacctaaagaacaggtcacatcagacgttataaattctccaattttcttttcttttttttcttttgagacggggtttcaccatgttgcccaggttggtcttgaactcctgacctcaagtgatctatccacctcggcctcccaacgtgctgggattacaggtgtgagccaccgcgcctgaccaattctccaattttcatgacattaatgatcacgttaggcttagggtcagctgtgccctaaagctctcacatcaatgttttatggatgtatgggcctaacactggtatacagatacccttggctatatccctcttactaatgccagagaacgggtgtttcttgccacagtgccactcctggctgtccagcacatgttcacaaggactaggaaaaagggatctctccctggcagtcagcttctcttttcacagtgttgaaaactctgtgagataatttccttaggcgtcctggtaacacctattagaaagtgtttatttaatatttattcccacaaataccaatgagagagagagtctcctactattcaacagttttttgttttttttttttaatcaagaaatagttgaaaaggatgggagtgaaggcactttaagcccacagatgccagcagaggtgggacatgacaagkgaggctggggggctggccccaaactkgtccctcccaagtcagcttggacaccacacagcacttcgtgcgccctcggctggcttagcacatggacaaggcattgccgctggagtcccaccttcttagagactcctgaaaaggagctccacgccaccccccacacctcgccctgtgccactcttccacttgtcctgtccactctggacatagagccttcacggtaaaccagtaataggacgtcaactactttctggaattttgtgagcccaggtgagtgaggccgttctaatttcaacatctacagaagttatcaagtttcaggtttaataacctagcaagttatcagacctgaaagcaaggggcctggcaacaaactctcaacctttcaggcaagtcagacagaagtgtgggcaccccatacctgctactcgcatctgcagcaagggcagactcgtgggactgaaccctcatccctgtggagtctgtgctaactccaggtggtgagtgtcagaactgcactgaattgtaaggcccccagttggtgtctggagagttagasaactggttgttggtatggcaaaaccccacacatttggcgtcagaaatgttatgagtagcaacagttcagagtcctttatgtgcgtttacaaaagcaataatttatggcaaggacttatcagaactactttacgattttattttagtttcttttaaggaccaagattaaagatttaattagttaaacaagacaaccaaaacaaatacttcctcctgaccttgagttatcacagactgccacccaaggggcaactgaaacagaaagggtggcctgcatttcagaagggctggaggggacaacgggcagtgtgctctcaggtgctctgaatcacacacacacacacacaccatacacacacaggcacccttttggaacagacaattatgaaagcacattaaaacgcagcatgccatttggaagtctggtcttgctgctctgcccaaacacagggtacacacttcagggaaaacaatcctagagaaacagtagctctgtgaaaaatgagaaatgtaaaatgtttcggccaaacacaaagaaaaaaaaaatcagcgtgtgggatggggaggagaataagacctatcagaattctttttgcttagctggccaactctggcagcataaagtttaaatggaagtatcttcaaattaaatcgcacctgcatgtatataagactcccctgtaatgctccgataacacctcaagattgaggtcatctaaattcaaaccttaaatataaaaccactcccaaaagagaatgcctttgaatataatggcagtttcaaactttggcaaataattatcctgtwcttcttatctgtgagaatctatcatttattttaaaaattctctgcagcggccgggagtggcggctcatgcctgtaatcccagcactttgggaggccaaggcaggaggatcacctgaggtcaggagttcaagaccagcctggccaacatggtgaaaccctgtctctactaaaaattcaaaaaattagccaggcgtggtggtgcacgcctgcagttccagctactcgggaggctgaggcagaattgcttgaactggggatgtggaggttgcagtgagccgagattgcacaattgcactccagcgaaactccatcttaaaaaacaataattatctgcagctccctgtatcttccagtaaacggattagcaggtattttctgagtgtccatgatgacggtcttagcactctccttcctgcctaaggagtcacaatcgcattcacaatcaaatgcaggtgctgtgtgtgcgctgctctcttcctcccatagccccgtttcactttctctggagtgcatccccatcctctcaaagcagaatcaacaagcaaaccactgtccttctttcaaaaaacaaaaacaaaaacaaaaacaaaagtcatgtgtttatttcttcccctctacttgtgcctcctaaattccttgccttagtcccaaatcagtcctccaaacgcgggttacttgtaacgttattcagaagtggaagattaccttgcaaaatggcagataatgccccaactagatatttcatggcattctaaaactacataaaagcaagatttcttaacattcctctaaataaataatagtgtaataaatatatgaaacaggctatgcatttcctcagtgttcttccattccctccagtgaccacacatgtgtactgcatggtgagcccatgactgaggaatagaaatacagtcatgaggcagctaacagcgtttcaaagatgaagtgcatatacgatagtggtcctgtaaggatagaatatagctagaaaattcctattgcctagtgacattgcaaccgtggtaagatgtacatgttcctcatatgtttgtggggatgctggtgcaaacaaacccgtgctgccagctgtataaaagtacagcacgtacaacagtgcacagtacataatatgtgataatgataataagtgactatgttattggtttatgtatttactatactttttatagttatttaagagtgtacaccttctacttattaaaaaagttaactgtggccaggcgccgtggctcatgcctgtaatcccagtgctttgggaggccgaggcgggtggatcacttaaggtcaggagtttgagatcagcctgggcaacatggtgaaacctcatccctactacaaacacaaaaattagtcagscatggtggtgtgtgcgtctagtcccggctactcaggaggctgaggtaagaggatcgcttgagccttggcggtcgaggctgcagtgagctgtgattgcaccactgcactccagcctgggggacagagcaagaccctatctcataaataaataaataaataaataaataaataaataaataaataaaatgtaatattcactaagtgtagcctaagtgtacagtatttatccaggccttcacaattactcaccactgactcactgactcacccagagcaacttctggtcctgcaagcctgactcctagtaagtgccctatacaggtgtaccatttttttatcttttacactatattttttactgcaccttatctatgcttagattcagaaatacttaccactgtgttaccattgcctacagcgttcagaacagcaacatgctccacgggtttgcagcctacgagcaacaggctataccatggaccctaggtgtgtagtaggctgtatcaactaagtttgtgaaagtacgctgtatgatgctggcataatgataaaatccaattacctaacaatgcatttctcagaacatatccctgtcattaagcaacatatgactgtctattactgagatctgtacatttttaattaccttcatgttactgaatccagctttaaaaaaacagcaggaaaccattttttcactgtgtttcaagtcagctacaatttaaatatcattagttcggtgtcaacctaaaatggaaacaattaccagtagaacattacatattacgtttacttttcatttttggtagcacaattcctatctaggaaaacataataagtttcctgtaggaaaagtaagataaaggaattaagaattcttaggggtctcactcacttaagaccgytaatatatgagaaaaaatatcttgtgctttgagaagtaagcttcaattacctgggaaatcaactcaagcaaaaaactctttcaatgatgctagacaaataaaatgcacaggtagatgtttgcacgtccacagaaattgcagccacaatcagatgcattcttcagatgtgaattcgtgcatacaagcaacccctgtctttcgcagagttaagttcaaatcctgtacacactttgttccacaaaattgctgttggcttgcatctcttttgtcacctttctccatccttaagtcctccaaggttctctcagggccaagactgtagggttcaatgaccttccctggtcagctgtaaaactagggctagcaccttcagaatccgccagccacaccctgctccagctcaccaccatgagttttctctcatcagcctccaaagtccaagccatcgctacatctcagagatgacgtacaacatgtgcctttattttatactctcaakatgctggatatagtagttattatccagaaagaatgacttcacaatcaggatccgagactggctataaacagtgatcgaatcctcaactcattccctctcgcacctacaggaaggtattaacaactgatcctccctttcatttttagagtaacaaacccagcttgtactacccatgcctacaacagcccagatgtggcactcaaggttgaaaaggggccayaacttggtaacgggacacacatgaccccatgcaggagaacagccagggccatgaggaaagggactttggtgcacaatggcaggtacctatgcccttgctgggacatggggcatcagggtcattaccagatgggtttacaaaacaccaaaacacggacagcaaaagtaagatgctcagtccattggcttgcagtgtttcagagtccctgcttgctgctagccacggggatgggggctgggagtcatcctgtttaaaagctgcagkgaaaacccagtgtggtcgtctctgttctcaatgtctaccttggaagagggagttcttaacctctgtggcagagcaacctgaaaacagaattatactccatayacatagctacaatgcctcatgcagaatgctcttcccaaaacygtgctcaaggatacaaacccaggctgtccaatttggggaaatcattktttgagggtggcacagacaagcagtcggcttggggtttgctccctgtgcacagctcgatcatcaaggaaaggcctcttccgggcctcaaagctccctttgtgaggaatgaggcccactgtcgaggctcacacaggcagctgtaaycaggctgcccctctctctgggtgtttgttttgatagaggttcatttatgccagagacaatgcccgctctctttgttctgcccccagcaggaagcagtgcagggagggggaccagcattgtcacacagcttccaattcaggttttggtggccacaacaatggggcctcaagggccacaaataaagagccgctcacggggagcagggcagagagactggcacatgtggaccccagcacaccccaggtagaagtcacctcctaacaagtgctcaggctcactatcaagggctttgagggctctgaggttggggagagggaggccacctcctcttctcttaagtggtgctgggagggagaagtaagcaaggtccccggggatgacaaagccttcctacctctcctaccatttatcccaactaaaggagcaaacactcaaaaaagcaagcaaaaagaatgcacacacatgcttcgtgttctaacttaccaacagttgcacaaggaagaaaaaaagtctaatctgaattgccaaaaatgaacaatatcctttaaaatgaagcctgggctagatggctgcaagtgaatgaaatgtattacccaactgctgctgtaacacaagccctctcctcccccttctgggcctcattcataaaaagcctgcttcgccccagcagctgcaggaactgggactggatttgtgttttgtgccggtgttttccaagacagagggaaacaattgaaacagacaatcgctcagataccaacaccaagttcgcctccccttgagaagtttgctgcagtctcctggtctaatccaaataggyggagggagggctgggagggcatcctgcagagctgttcagtggcggttctaacgctaacacccagcgtgttattaaaggaattcccatctgctgagtcacactccgtatctttcactccctgacattttatttttttttaatcaaaggttgttctttgttggtaaaacgggggttgccaagttaattaaagattgccaaattggggtagagatagcaacacaactcccaaagaggtaattttttcattgtccacttttaaatggatattaccatctacagactttatgcagcctgctagaaatcttatgagataaggaacaacttcaattcttaatatatttttctaatttatgaataaaccaacaaccaacatgcttcatccaggcaggatgaagcactgtctccctcgcccacacccttttccacagctgccctcccagcccagcatcttttatcacctagaagggccaaggaggctggtttgtgcaactcaacaagctctgtaaaacaccaagtccctagaaatctcagaaatcaccatgagaaacgagaggctaccaaactttttagactcagcagccttcttcaaagcagggcccaaatacaagagcatgttctaatttaccaggaatggttttaatacaagaattacataagaacagagtgcaggaaaggaagggagaaataaaaccattcttgttgccctaataccagagcagtcttccggtgaattgatacataaattctctccagagacaagataatccaagctattaactgttcccctctcaactcttgcaaaacacaaggcttcgaaaccttgaaggggggcaggtggaggggaaagcctgctatatatttctagaaaataccaaatttaacaccacgatcccagcctgctcatcactgctggggatcagccattctgggaaggtaacagcagccctcagcactcccctccgctaagtaaacactcctttctaccacactcggtcccccatgccggccgcctcccacctctgcctgtggactgacagccgaggaaacaagaaaacaagctggagataccaaatgaatcttgcgaaatacatggtctgtgattaaatcacaataactctaacctcctcaaaggcaaacatatcaagatagcaagctgagagcaaaataagcaagtcttaacagaaattatgccaagctttataaagggattacccacacctcctagaggctgtgcagcctggaatccagggtggtttgggttttttttttttaaacttactgcagcccttctagctatccaatgaaagctcttacaaagaaaccttcaggtctgcagttctctgtgggttttctatgaatatgaacgtactttacgggtggagaaaacatatccatgatcatgtttgaggggctcacgaaagggggaggcacatgaattataccatgaatacagatataatgaatacagatttagtgagattttaatacctcaatattctctggtcccactcttaaacatcgcccttcaaccatcaaaacatcttaaatcctggggtaggggcatagttacccaaagttgtggtaccttccctaaagaaaactgaaatacataccaggacacacataattctgtcaagtttgtccctaactgtgtgatcttggacaagttagctaacctctctgtgcctcagtttcttcatttataacatggctctaatagcagaacgaacccttgagaggctgttgcaacagctggtacacagtaagtgctcaataaatattcgttgctgttattaacattgtccctatgccatctcaccccccatataagctctctgctaactttccaacacagagaacaaaatccaaattcttcaccatggctccagggccmatgtgatctaatagccctctctgcctgtcactcaccaggctccagccacccaacctcatctcatcctcctcactggacatcccacgtgcatcctgtgtgcaccagacagtcttgctggtgcttccagactctgactacttctctccactgaccatctccaccatcctggtctaaggttcatcttctctgccctacactggggcaacagcctactcctactggtctctctacttctgtccttgcccttacagtctctcttaacgcagctgccagcatggtcctgttaacgtacacaccagctccaaactctgccatctcctttcagagtcaaagccgaagtcctcaccgtggcctccagggccctacataactgactcagtttaccccatcccccaccaagatgcaccaagctctccaagctcctcgcctttcccytccctttcctttaggtcttcgtccaaatgtcacctctctagagaccttctctgaataccctacgtaaaaaggtacccggatacctgcctggcaccacgtaccctgtaccccacacctaacatgtgacccagccctcccatccccttccctactttaataaaagctccacagaggcagaggcctcattttgtccacttctataaccctgacaccaggaacagtgcctggcacacagcaggtgctcaataatatttgtggagcgaataatcgatgccatcatggagatctttccctcgctggggcctaccacctcatgttcctctccacgtcttctcatggctgattcacagtggcagggcaaatgtcccctcttcagaaaggccttctatgagaatccaacttaaaagtctccatcacaatcagtgagtctgtatttttttcatagcacttaccactgtctgacattattttctgtctacttgtttgttgtctgtttctaccactagaatgtttccatttgttttccatttggagaatggagttggctttgtctctgtaaccccaagtagctacgtcagcacaacagaatgctcagtccgtatttgttgaataaatggcaatgtatatactgacattctttaaaaactaaaagcacacatccagaagaggaaccgggagggctctgtcttaccccagatgacacataccctgcaggtgcatgtgcatggaatgccttgggcacctgaaaacaccaccccgctcccccaaccccaaatgaagagctctccatctgacctgggagaagcactcagaacctagacatggctccgacgcaaagaaaaacaatttgaagttactaaataacagcccaacatctgtcaccacatatgaacaactctatgcacaggtaacggtccactcgccatgctcactgtccaaacacccgggcatcaggtttaccttccccctgagtgggctttcgagcagtcatcacagctgcctgggagacacagctctaaaacggggctcgggctgcagcccaggggccaacactgagctcccaaagctttggatgcatttcctactcagcatggacatcaggtgacttccttaagaggaaaaatcaccccgcaagactgctgagaaagcaggtgtggcatttatcagtgctgctgtcatccatagagaagccaggaacaacgaaatgtaactctgtgtacacagaactctgccaccccacacagrgcagatggggcagccatcagaaatgcggggcatggacccaaacgccagcatagcaccacacccccaaatgaggggggaacaggctcagcaccccaagacatccaagcaccatggcttttacagctagatgcactctccacaagccaacaggagtcgcgagtgagagccttcgaacacatccagtgtgaacatgcattcagcaaacatttcctgagccctgctttgtgccaggctgttctcagtgctcaggatacacaaggaagaaataaataaaarataaggtttctgtccttgtaaagcttatattcgtgtccgtgtgtgcatgcctgtgtgtatgtataagaatacattcaatagacacaattattaagtaaattaagtcatatgttagaaaataagtgctgtggcaaaatccagattaaaatcaccaatcactagtcaggagaccccatcagctacgsaaagaccatacaggtagtgtgcagagacaccagagaggtcaccctgtttgatcgacaaaagtatgctcattagaaggtaaaccacaggactatggggtctttatctcttttytccctgcaggattctcagctcaagaagagcacctggcacaggtcagggactcagaagcatttgttgaagaaatggaagtgctcacccactgagttcttgcttctgcagcattcctggcaggtmaccctctcgagttggctgaaatctttccaagaatgaaaagctgggcttttacaacaaactaacaagcaaaccccaaccaaccacccccacacacccccaggcgcctttactgtattactttctggaccctctgagacacacacagtctactactaacgccagcacatgctgtgatgggattcccccagcagtgcccacacgatgctgggcccacacagcctgtgacacctgctggccacttcgctcccayggagaagcctctttcacgttcatatgtgctggggatctgtgtctgctgagagctgagctgcctgcctgggatcagccagatggagcaggcagagayggcacggaccacactccagaggaacacgccatggatggctrtaytgttgatgtttcagatatccaaaaagtaaattataaatcttagcggtgatttagctatcctatttgccaaaggtagtttacacgggtgtttcaaattacttggtaagaaggcacaggtgacacgaagggaccacccacaaatatctggcatgttccagtcgcatgcatggcatgtcgcatgtggtgcgacagttctcaggaaacagcatttgtaaaaacatgcttattaaaaaattagagagattttctataagaaacacataataggcgcagtggctcatgactgtaatcccagcacgttgggaggccgagacaggtggatcacgaggtcaggagatcaagaccatcctggctaacacagtgaaaccctgtctctactaaaaatacaaaaaaaattarccaggggtggttgcgggtgcctgcagtcccagctgctcgggaggctgaggcaggagaatggcatgaacccaggaggcggagcttgcagtgagccgagatcatgccactgcactccagcctgggcaacagagtgagactccatctcaaaacaaaacaaaacaaaacaaaacaaaaaacaagaaagaaacacataataatgctaatctaatcatttgtgtatttttaagtttttaacttactgatacatgtcaatgtgttaagaccaaaaaaatacatgaatttaatttaagtctagacggcaaagtcaaattaatgtagtatacaattttcttaataaacttttcctttcctaccctctttcgccccattttgaactttaaagaaaaatttgcctttttgctgcttcctaaacaatctatgactgctacaatagtcaatctttattttcccacttagtttgcttatggatgtgagggttaaatgttatgaacataatttagtgcttacaacatcagcaaatctggcttcttccttgagctgatacacagtgaggttaaggtcagggaaacatccgtgccttctggtccaagctgagagcattgctaaggtaagcaatcaaagctgggaaggctggggttggggaggtgtcaaggatgacacaatacaaatgctaaagtctacaaaacaaggttgaagactcaagtccacagcagcagtggttaaggggcgggggattcttgcttgaagacgacaccaggcacattttccagttggagagcttgtagtgaattcagatcacttggtatttcaagtgtttcccaaactactgtagatgaagggctctgaaattattccattttgaaactcattactgattttgttacaaccaaatagcagcaaacatttgtacagcagtttccagtagttgtacataaaaatgctttggaacacattacttgggaaatggaactttacacagacaaatcagaatgccacttacctaatggagacagtttgcttactaattaattctcaagtccattttgtaaataaaaacagaaatggggccatcctggagaatcatgatgctgttaactgagctacatggaaggcgcagttttcctcctcttatcactggtcttttccttctcacactmagcaatctgagcaccacggggggcaacacctgctctctaatacagaagagatgggtgtatacctccattctaatacagaatgtctccatatacccagccatttctagggaaaatcatctctgacagctggcatgaaatcaatgtccacctgaaaagtacctttgagggccatctaataaaggccaaaactatgsccacgaatccaaaactgcggaagtctagactggcgtttctaaataagctagagaaaaatactcaatgtgcgacatcttgtaaactcacagctgctgaagaacagtgtctttcagtcacatagctgaactgaatgcagaggacactgccatttgtgaccaacatttcctttctagggaggaatacccaggacacttgttacggctgctacctaagtgctaagatagggcgcttcgccactgtgccccctgcttcatctcaaaaactaaaattttccatcaaaaattgccctcattttgtgcctttttgcaaaagtgaagctatctaaattctagcaaaggaacgaacacaggtatttcagaataccccacctttaagggtctcaaagattccagggtgttccctcttaggatggagttttatcttggctgaaataaaagggtcttaataaagtctttttcctgcagacctctgggtataaattatagattcatgtcaaaacagtgaaagggatttgaggcaaaagatatttctttcataaaatattatgcatcagagtatacgttctatgctataaatatttagcaagggataatgtgacatatttactaatatttctgtcaaaataacaacatctaaactgtcacttcaacaaggaagcttctcttcctgttttagtatagagaagcactrggatatcgtctcttttccttttaaagaaaaatgtattctgactgctggtaaaatcaggagtaacttgagtctgtgacttaaagggcagaactaagccctatactacagtgataacagtaacaggaacatctgattacakataagctggctcctcataaaccctgatacaacctaaggcctccattttcattacacaccttcaaagatgcttttaaaatggacttgtttattgacaacacaagattttttttaagtacttgttttccttttctaaaggggagacttcttgctatttgctaattttcacatctgtcaatgctgacaacaactggatctgttgaataaacatttattccttttgacaaagaaccttcacataaaattgaactcaatggaactttatgatcggggcaagagaatttggagcaacttcacagattagtaatatctaacagtggccaggccctggaggttctcttgcagtgaccctggggaatggaccagtctttgtatcagcagaggacagaccagagcttttcaggaggaagaaaaaaaacaacccaacaaatcaatacagcaatatacaatggtagacaaagctacacgcgtttacagagtttcagcgcatagaaacatccagttcagaagcctgttaaacttacatctgtatttggaatctcatgggaggcaacccctggcaaaatatcaactcttattgaaccaaaacaaaatctgtgtaggcacagagtatcagtacaaaatatccaaaaacaaaagctcacttttccaaaagaaaaacgctaagttcaaggaagcagccaataagtaagagaagtttgggcttttgaccttcccaccctcccatgccacctaggaatattcatttttaaaagactgaagttaaaatatataatacatatatgaaaagatcccctaatttgggccagccataatcatcttaaaatggtaacctgggtaacaacyacctaycataatttatcctttgaagataaccacagattcatggttttgattttaaaagcttctttccaaacaaataaataggtatcaaatcaaaaggcacactttaaaaataggaagattttgctaatttgtcttcatttgcaaagatkaatcttactctgaaacctcatttgagagtgctctagtctctcaggatgcatagaaatgccttataaatgctaagtyatataataatggttatgtatttgggtgttagtcatctgctcttcttgctgagataaatagctaccatctgaaggtgaacacttcaccttccctacatttacaatactctaccatcaaactttcatttagattagcaaataaatgggagttgataagagagctgtcaggcatacctaacaaacctgaaacctaagtgttaggaaagttattctgactcaagtattctacatacaatgaatttggggaccttatagggtaatagggaaggaaaaaagatttttctcttaactagctgctgggccccacaaacagggagaattgtctaaacctgagccaccattctgatcctcaaaccctgccaggtgaggacctatagctagattgtgtactggaggatattagagcagattgctcctctgccaacttctctccttccttcttctatttcttccctttcaaaccagaccactgaaactctcagtctgtatttatgtgaaataacaggracgttaaacatgctaccttcyatttgtacagaattgccatgcaacacaaagaatgattatgcattagctacgtcacatttacctgtgaaatttatctcattgtagcactataactctatttactaaaatatgttcatccttcgatcacatagtattttcaccaacttaaaattttaaacggaatcagaaaatatacagcctttcctaatggcctccttaggttttcaagcttctccccaccttctactttttttcagatggtataaggacttttcatctgtgataccaatgggtacttttggttggaaaatcttcctctgacacagtccacaagtcacacattacacacctaagtggtcacaaacaggattttaatctatgtgaacagatcaccaatcttggtttcatccttttatgagtaaaatgtcatawaaaaataaactccttaatacatgtaataagttacaagtgaagtaaaaactaaatattagaggaaaagatacaaataagttagttgttgcttttttaagtttttcaagatacagaatatcattacagctgttgcatttgaaagatgatgcaacagacaagggcaaccacacccccaagatctttgcagctccacaagaataggatttagacccttaaagaatatgtcttaacatttatcagtcaataatgtattaggcatttttaagtaatttctaaccaacaacccatcatcatcactgaatcatctgagcatgaactaagctatgcaaacttctttaaagaaagtctgggacaagcttcaatctaatgaaggcttaggaacagctttactttgtgaacaactacagcttgctggagaagaggcatctcacaatagcacaaaagaacacaaaaaagaaagtgatctttttgattaaccaacgtcactttctgctttgttttaggcattataaggtaaatgaactaaaggtaatcaaatgatgaagttcttcctgccctaaatgaatgtgtgtttagtccatttacctactgagtcaacatggaaagaaaaataagaaagaaaactaaattttgtaagacagtagaagttttaatacatactcagttctaatgccgttaattttgttttccttccgatttccttaagggaagactctggttgagtctttctctgctttccacatagcccctcgaggcacagagacagaagggtctgctgtgggaagagaccatggagcaggtgcagtggcccctctgaggataaaaacaacacgcccagaggctacaaagccagctagtgacccagccttcaccgctcccagactccatctcccctgctcccccgctataccacaggacctttgcaagtgcaaactgcatttgagataagcttccccagacatgctttcatgaggagcttatggcgttttctgtgctcacaagcagggtctggcactgccctaccaagggaatgatcacttgtaagaagagggaggacaaaactatccctgatggctctttcacatgtttcttttaaataaaaagagtgatgatctttctaggcaaggacacaagttgcccaggccaccccctttcccttcaaacacccatacccacctcatatggcacatatagtaccccaaaatgccagataagctgggccacctcacacactgcaatgaccaagcccatctcctccattgtcctcatccttccttcgaaatcacctgtcccggcctctttccaaacccaagtggaacagagccacttgaacagagcttccttcacagaaatcctccggaggcaaaatcctagagcacaaactacatagaaactgaacagttaatgtacatttcctttggctaagtcacagacactaaatgttggcagacagagtacatctgaagcaaatcagggccattttcagggcagagacttgcttttattctctgagctccagcaacccgcctctctgacttcttcctcccatggtgcttttccacccagataactcgcccccaaagctgaggaccctcccaaggccatgaaagggscctgggttcacctccactgtcacagagtttaagaacacatgccctgtatagcctattttgtttgcttgtttctttattaaactataagagcatcatccaatttgaaatgcccctcctccaaagaaaaagctgcgtggcccaatgttaaaggtctacatcagaagtcactgttgcacatcattataattaagaaatggcatatcaccttctttgtaaggtataacattttcaatgttgcaatataagctgaccacctcctctaaggcgaggactcggcgtcaggggcagggargtggtgagcaaagaaagggcaaaaacaagaccttgatcacagaagcaagaatctgacattggattatttttgaaacatactacatacataaggaaaatgatgatgctataaattaaagttgtggttttctacattttaaaaaaaggctagccagccgaccttatcatccctgtcattccaatgggaaaaagcgtcatcagcacaattgtagaagcctaraacaatgtgtccctgtcaactcagtgagggttttcttctttcaaagataaatcaagatgccataacctaggaataatataactacttacacacagagaacaaagttggcaatcacgatctgagttaagtttaaggtatgtttgtctttccattttacaagaaggtaaatgaacaggaaagtgagctggaacaagtaaactgagccataagcctacgtgtgcttttttgtagaagcacagtctaaatacacacacgcaagccactgcaaaatgactttctaagttaaaagtcagagaaatcaatgtttgactgactatggagcatamaaattcttcatttgctttcatcagctgaaaaaaaaatgctagaaataactacggagaaatggtaaagaaaaaaatgtaatgtacacagttttgctgaaaaccatgaagataccagcagaagaaaaaagaaaatgaagacgacaaatgtatttcacacaaagatgaccggggctgtttctgcacagcctccacctggagctgaatcaccggccagaacagggattaggacaggcctcactggcctcccagagctgtcagacctcagcagggcgggcgcatccttgggtagcccaatcaaggctgagcagtatagaccgtttgcaaacttgcgcaaactgtgaagttatttacatgcattcagggaaaagactcccccaaacagggaagcttctaccaaacaaatgccttaaaaattattttatgaaagagatgtctgttatgtgtaaacagacactaattgttgctgcaccttgggtaagtgacagggctcagagaacaggaaggaagcctgtgacttagcagacaacaggacagttcttccctttgaccttccactggtcccagattatgactcagagactgtctcccactctttacccaaggggagatccctgcacctcctcctcyaacatcctacatctttaaaatgctcctctgaatcccagaactacagaaaccacagcactcgtgctggtgagcagattcctaattgcagaagatgcatacaacttgatgctttcagattagagtctacccattcctaccatgcatttgttcctacacaatagcatacgggcatgtgtaggaggtcaccccacattctttattaactt

SEQ ID NO: 13393 - DNA, 31919 bp, Homo sapiens
ttttttaacaatcttgtttataaactttatctgcataatccaaaataaaatattaaagcaccttaataggctcctagaagtaccattttggcaagcgcttctgaacatgtttactgcatcttgggtttgtagttacagtaagtcaatatgtacttttagatataatttgaagtttacactttaatattagatacataaaagaacctcagaaaatgacatattcagataatgctccatcagcatttgatattaactaccatcaattgggagtaacataagcatttaggtgttacaaaaatatcttgcattttatgagctgaggaacactgagggcaaggagcagagcaggaaggggagaaggggaccgtgggaaatgtcagctgaagcctgaggaaggagtcaggacaggaaaagacactgaggactgtgggtcgttgtaatataaggtatgcataacagatcttatggtctaaagaatagaacaggtgcaagcatctgaacacacatataaatacaaaattgagtaggtaatttgatttttgctggctctctggcaataaccatatttccctgcctcttgcctctgctctcttcccctggtataagttaggggcatctcatatacatctcatctcacatgttcttacaatgtatccttaacatgcctcaaaagagctagggtttatgctccctgtcattgagccagggagaatgtagcagaagtgactccagttgacttccaaggctaggtcataaaaggcaatatggcttccacctggctctctctcaggacaactgcccttggaaccatgttgtgaggaagctcrggccacatggtgagacttcatgtggatgttccagttgacagctccagctgggccccgccgagtcagcagcaccaatcacctgattgtgaatgaatgaccttttagaggattcctgccccctgcctttgattctttcagccaatgtctgagatattgagtagagccaagcaagccttgttrtgcctgtttgaacccctgactcataggaactgtgggaaataataaatgatttttgttgttttaaaagcctctaagttttggggtgatttactacacagccatagtaatccagagcaaattcttttcccagttatttctgagaacccctgggggcatcacaaatgcatctcatgaatgaccttctcatgctgttcagctttgtttcctatgggatggacactgctcaagaagccatgcaaagtgcaatgcatgcaagggtgactgggatgattagaactaggtcaggcttgtttggaaaacttcacatgtagctggagtattttgattagttatttgaaataagctggagagaagctgaaagaccattacctgaaagagaaataacatatggcactatatggaggtttaagtatgtgtacaaaagtatgtgtacatattgcatacatagtcagttgcctgctgggtatgaagttctgggattcagctccaggaggagagtgctggagttccatttaggggtacaaacagcaggcaaagtgaccctttcaagtggtgcccattcggtcacagactctcagccttcatacccacagtcaccatcttttcagggactctagagaatgtggtttgggatgcaggaggartcagaagatctcgtatacactttggccactgggaaatgtctgcttctgtactggactggttcaaaggaagaacacttaacattgtgtttggctgcaagtaacagaaaacctgaagaaatggtggcttaaacaaataagaactttwatttttttctcatgtaaaagaagtccagagggaggcagcagggagctggtatgtggttcggtgatgtcatcttgttgcctcatggttacaatatatcaactccctttccagacatcacatttgagctctaggcaggaggaagaaggaaaggcaaaatataaaaaggtacatgccaatttttttaaaaaagtgtattctcactgtgtccaccattgccttaaggagctttcctagaagctctacctaaacaattctatctgtaccatactggctaggatgagtcatgtacccttccctagttgcaaggcatctgggatatgtagtttagtaggtgggcacattctgtctaaaccaaacagtggatcttctgttaaaaaagaagtcatggagtttggagtggtttctgagagtggtttctgattttagcaaggggggctgatttttagcaaggatacatggtatgctattaatagaaagaacacaggctttggaatcacaaagaaaagtatcaattactgttgggtgatattgggtcaaagactcacttcctttgtgcctcatttcccccagttttaaaggttacattacattacattttaaaaaaagacacaaaatgaccagcacagcacttggacatgggacacttgcaagacaattagttcctcttttttacaaaggattttagctaggacctgcagagtcaagaccaattagactctcccaagtcccctagaccctttgcacaagcaggaggtaaactccctatccctgtcctcagccagaacaaaggccccgaggaatctaaaccccttaatgccaggagagacaaatgcaattcctgcagcaggtttgtggactttgtgggcactgacccttctgaaacccttctcctgaagaagtctaggcactgcataggagtagtggaggtgcctaataaacagctctgtatgaagaggtgattaacttagatggatggcatctctccatagtcataagatgtgggttttatgaaatacggggtaagatatttggattggtgacagtcttaaaggccttgatgacttaatatgaaaatgaaagaagttgacattatgatatgattagatgggtgcttaaggatgaggagagagagggagagaggaacaaagaccatcacagatggcatttccccaggctaggcacatgagggctcagagctgtggctgtagaattatttagttaaggtaattctaattcctagaacagatagactctccaaaatctcagtggatttgtacaacagaagtttagttctcactcttgcaaagttcaaaaaaggtccagattggggcagttctcctccaagtgatttggaaacccaagcacctttcatctcctgcatcatcaatttatctatgaatctgcctaaagccagtggcagggaaagaacatggatgatcctgcatgggtcgttttggggggccagtcctggaagtaaatgctcattcattgtattgactagaaatcagtcacatggttacatctctttctgcaagaaaggctgggaaatgcaatccagctgtgtacccaggaaggctggagaaatgggtttcatgaacatctagctggtgtctaccatggagatgagaaaaaagtccaggtcaaaattgtagcctttgaataacaaaaccttagggccaaaatagaattttaaagtcatttagttcatcctccttattttgaatttagttcaatttcaaataaaggcaacaaagtttgaagacactgtggtagggtttgtgggcaacccagagaggagcttcatcctgctgcatccctgccttccctctgaggaagacaatgccacgttggagggggcagaacaggggccagatgtgtgtgatgaaatgtgaagcgcaacagaggatttctaaatgacaggggaccttttagaggtgtttcacttaaatgttagtggaatatgtaagagtgaagatggtactataaagctggtaacaatcagtaaacattagctttaaccaagtggttcttgaagtgtgatccctggaccagccacatcaggctcatttggcaacttgttggaattgcagattctcaggcccaccccagatctactgaatgagaaactccagggtagagcctagcaatttgtgttttagtaagccctccgggtgttttaatctatgaagtttggaaaactctgcctcagagtacatcasctctgcagatatatataaatatatatatatatataattatttttttagatcttcgggcctttgagacatcctaaactgtaaaggtttccactgttcttccatgtttattccaatgttgtaagattattttaccatcaaatatcaataatatctgaaacctaaagaaactatataaagttatatagattgtattttcaacagttatccaaactattatttattattagtttaatattctttggagtcataagggcattttgatctaaaggccagttagtgcttaattgccttgttggtcattaatggtgttgtacactggaacttttataagtcatggctcatagattcctcactttactcaatagcagtgatacaggggaaacaaccaaccatccatcaccttccaatcactgaagtcagaagggcccatttcttcactggttgcatatcacaccctgacccatattcattgccacagcggtatcggagggtggtgacatgaggggcgatgaggcttcaggagccggtgctaacagtgatamaggattaggggacgtggcagctcttctgagaggcaagaaggtggtgagaagtgtgatgaccttgcttctaaatctcaattctgccaccactgactctatgagacccttttgattttcatttttgtaacatgaaagacctgggtttggcctgtgggttttaacttctttggagccatggtccccttcagaatgtctggaagctgggactactctcccygaatatgtacatgtgcatatatacccccagtccacagccctggaatagatggtctttatgagccattccagccctgacctaattgaaagttctcatgcttctgtgaaacattatggaaaggaaaagttcattacttacattctggaaataaatgttgccatcatccttcatgaccctgtgggtgcataagtctcatgctgtaaaaagcatctttaatctagtttaatctaattaatctagttaatgaagcaactctgatttgtaatgctggtcttaaggtagggaagtgggcaattcattcccggtcttcaggtaggaaaaaaggcaaagagttcacacttttttttacaaagtagaaataacagttttacattttctttaagtttgcattttttattttcaacagggttaggaagcagccaatcataactcaagctattgggtagtaattatccttcatccgctaatttctaggcaggaaaaatatgattaaaatgagtttccgcacagctgttgattaggcataatgggaaagtcatcatcataaaactaataatcagagcagagctaacatttggaaagttattgttgagtaaccggaaggctctaaaagccaaaaacaatgtccaactaactagaaaattaccaccacccccacatactttcctgtctacacttcaacatcaattaaacacagcaaactaaaaccagttaattacatcaattttaaggtcaactttcaacaactcaaacctctgtgataaacaaaccacaatatcgaaagcttttttgaaaagtcaataaataaacagccatcattctaggaaaagctgcaacacagttaacaacacatcaataaattctaaacaagctttgtgctttgattagctcaaacctcctgttgcctccccatgccccaaatatgcattcccattccaatcaggccagtgtgcctgtggcccagggatgctgcagttggacagctgttggaggtcaccgctgagcagctctttgcaattgcaaagctcccactggaaaacagagattaatgagctcacaaatggaacagcacataatttcagawcttggtgatgataacaaggagctctttaggatcctccttgcttgataacagaatcactttctttcttacgtttgtcatccagaagtctaaagtcagtagcagtaatggaaagttgggctaatgtggagatattccaaacagagcaagagcaaatgggattcttggcttgtctctcatcgtgatcctgattgaagaccactggacacatctgtcaagactctaaccgcaatccattggaaatcactggagagccaaaggtgagtgaagatgaatgtatgaatgtatactagggaggtgtggtaagatagccaatggtaaagacaattgcaactctagggtttggaatattaccatcctttgttgttttctctctacttttgccccctcttacttttttttttctttttatgcatttaaatttcttagaactctctttcattgtcctggctggaagyactggattcctcctttcaaatgaactaaaatattttccaagatgtcaagtcaatctgggcaaactttctcaacataaccatccctacattccaatatccctctttttcatttttcctttaaaaataaacgtgcatttttttctcaaaagtgactgagctccatactccacrcaaccactgtttttagaccatccagatgctttgacacatgattttatattttaatagaagaaggctgaatatgaattgcaaaatcatctgtctccttttccatcataagaatgtgacaactcattaatctcaattccttaacaaatagcagtcttctcacgtgggtaaaactccataatgttaaagtcattgctttgcaaagacattctcataagattctatttccaggaaaactccaaatttctagtgctctgagtgtcggtcactttgacagaagatggatggtcaaatatttgaaatttgcattgagaattaaggagttatctaccttttcctgggattactttgaggaaaaggaaagaaacgtagagactctaactgtgaggagttggaggacaaagactccactgggagaagcatgaacaaaagggaaaagatgatgagaatgatggcacagcactgaattagcgaggaaggagttctcttgaatgatattggtcagtgtttgtcctcaactctgcacacaaagctgtaggccttgttgcctactttctgggttacaattgaagccaacaactctagttccccaggaccagaatggtcccacaagaccctcctactcgtggttctaggaggatgatgcaaaattcctactcacgccctgtttggagagggcttggcttccctgcttgggacaggattccaggcagtgtgccaggaggtattcctcaagaatttcacgaggtctaaactagggaaacgtttcactttccatccccttgtagtttcttctcaaccccctatgctctcattctcatattttaggacatgtctattaatggcatgatatagaatggattgaggtagattaagaaaaagttgcaataatcttgaaatgttaagattggtgtttctgctataagtcttgtagaatcactggaagctttgaagtgccaaaggatgtccagagacttcagaaccggttactaaatctttgcttttcttaatctttatatttcaggatctgggtggtctcattttgacttcattaaatttctcaaattttacctgctgtagcccaaattagactctgcttctccttctcttgccatcaccaggaaaagggtggaaatgggtgatgctgaagtttaggtgtattagttcattctcacattgatataaaggactacctgcaaggcgggctgatccctcgaggtcaggagtttgagaccagtctggccaacatggtgaaatcccatctctactaaaaatacaaaaaaaaaaaaaaaaaaattagctggatgtggtggtgggcacctgtaatctcagctacttgggaggctgagacatgagaattgcttgaactgggggctcggcagaggttgcagtgagccaagatcatgctactacactccggcctaagcaacagagtaagacttcatctcaaaaaattaaaaaatttttaaaaaaaagaaagaaaaaaaggactacctgagactgggtaatttataaagaaaaaagatttaattgactcagtttcacaggctatacaggaagcatggctggggaggcctcaggaaacttataatcatggcagaaggcaaagaggaagtaggcacatcttatgtggaaggagcaagaggaagagagctaaggggggaagtgctgcacacttttaagcaagcggatctcgtgagaactcactcattatcatgagaacagcaagggggaagtactccccggatatgttttggctgtgtccccacccaaatctcatcttgaattgtagctctcataattcccatgtgttgtaggagggacctggtgggagataaytgaatcatgggggcggtttcccctatgctgctcttgtggtagtgaataactctcacaagatctgatgatcttataaggggaaattcctttcgcttggctctcattctctctctggcctgctgccatggaagatgtttctttcaccttccaccatggttgtaaggcctccccagccacatggaattgtgaatccattagaccactttttctttataatttacccagtcttgggtatgtctttatcagcagtgtgaaaatggactaatacagccaccatgattcagtcacctcctagcaggaccctcctccaacattgaggattacaatttgacacgagacttgggtgggacacagagccgaaccatatcattagcggagaaattgcaggaacttactttgattgagtgtgagaagatgactccacaccattctctgcatgagttggcatacaattaagatagtctgacagactgattggatcttataacctaggccaaggaggccattatatcattcatcacaagcctgcaggcaggccctggtcaaggctagcctagggaggagaagaggaagcaagtcatgatgggtcaataccaccttctctttctcagccttccacatcctaacctctgctgttattctcagctgatgatctcactttccacctttttaggaaaacagaatctagatgtacaagtctactgaggtagggcctctcttctctgttgtttgagcctctcctgccaccaaaggccaaccctccacttcaccttctcaaggaccttttccctttgtttctcctctcacttctgaatcttcagcatctctcccctcccttttttttttagacagagtctcactctgtcccccaggctggagtacaatggcaccatctcggctcactgcaacctccaccttctaggttcaagtgattctcttgcctcagcctcccaagtagctggaactacaggtgcgtgccaccacacccagctaatttttgtatttttagtagagatggggtttcagtatgttggccacgctggtatcaaactcctgacctcgtgatccgcctgcctcagtccccaaaagtgctgggattacaggggtgagcccccgygcccagccagcatctcccgctttattcaattactatcatgactagatagacatgtccttaaaaacacagaataacccccctcctcccatatgtctctcctgatgctttcccatttctcttttgttaaatgccagcatcaggatatgggcaggaatggcagtagggtgatccagagaaagtaacaagggaagaaaacataactctattatgagaacaggttagacttctccctgcacaggaagggggagtggtggtgggtacttgtaggtaagtgtgagcagagtgtgaggatgagtgtttattctaacaagcatttagtgagcacttactctctgacagatactctgccaagtgcagggaatgtaaggatggctagcattttgtctcttccctgtgaatacagaagtgtgagcctagaaaagagaggaagaaaggaagaaggaaagaagaaggagagaagaaggaaggaagtcaaggcagcaagagaagctaactgcccccacccccaatctcacctccatcccagtaacacagactcctgggactagctgaaagtgatggctaggatcatggcctccaatataacatctttagaaagcccctgaatggcttgaacttaggaggtcgaggctgcagtgagctgtgattgtgccactgcactccagcatgggcaacagagcaaaaccctgtctcaaaaataaaaataaaatagaaagcccctgagatttattgagcccttgttctgcacaactctgctttcagcttcctatccttgtactcttgagcacactaggccttttacccagcccaggagcagtagcagcagggctggggtcaagatggcagttgagtattagtacaattttccaagagccataaccttaacctagtagctaggctccagatgtttctgtcaatgcacaggccttttggggagcctcctgtagactcaaaaacataactcttctggtttaagtgtcagtatgctttagtcttttttgtttgtttgttttttgagacagagcctcactgtgtcgcccaggctggagtgcagtggtgtgatctcggttcactgcaacctccacttcccaggttcaagcgattctcctgtttcagcctcctgagtagctgggactacaggcacatgccaccatacccggctaatttttgtatttttagtagagacggggtttcaccatatttttcaggctggtctcgaactcctgatctcaggtgatctgcccaccttggcctcccaaagtgctgggattacaggcgtgagccatcatgcccggccaatatgcttagttataatggtcatttacaaattaagaaaattgtttctcactctgtgttcatgctgtaagattgaggtgaccttgagaaggcgaagcatttcctcttaacacctttcatgttctgtatcatttaaagatagtgctgggctgcatgcaagaggaaggggcactggcagtgactgaaataagtagggaggttatttatctcatgcatcaaagaattccaagataggcaatagggcagatattgcaggtcacggtgaccccaaagatccaggtcccttctctcttcctgctctaccatctttagacaagtgcttggcacttgtaatacagcagctgaagatccaggcatggcttctatattacagacaggaagaaaaaaagggggcacagggcaagggctaaagtgcccaccagccaagtcagtctcctctaaaaagctttcctgggatctctacccagtgaattccacttatatctcactggtcagaactggggcacataagcctcttactgtaagggaatctagggaggtattttagttttctagtctttttatgtgatgaagacaagggaaaattgagcactggatggcttttgagtagctcacagtgtgtgccacacaccccatggagctttctccctgaagcaggagttttcagcctgaatgtccatttgtatccctgtgggcttttaaaattaaagcccaggagccctcagaccaatgaaattagaatctgcaggtggaacataatgtcagtaattttatttttttagaggcagagtgttactctgttgctcagaatggagggcagtggtgtaatcatagctcactgtaatgtgagcctcctggctcaagtggtcctcctgcctcagccttacaggtacctggaactacaagtgcatgccaccatgcctggctaattttaaagttctctgtagagatggaggacttgctatattgcctaggctggtcttgaactcctggtctcacacaatcctgcctcaccctcccaaagtgctgggattacaggcgtgagccactgtgcctgagcaacatcagtaaagttttaagatcctcaggtgattccaaagtgcagtcaagatytgaagccgttattctgcaggctgccctgagtgttaattttaatgattctcattaggaacaagtgatagactataaaatgttagaggctgggcaggactttcatgatcatagaacaagatttgctcaaggttaaatttgtagtcaatgaagagtttggggtggcatagccagatcctccaccccacccctgcaaataataatagcccctgctcaagtttcctattatatccagtcaaatgcaatgtgaaatatgtggctgtttggaagaattaaaccttgatccagttagtactgaaggttgaggagagcaggtagccttggactgtagctgtctctcctacactccagtaatgatgctcagcttgaaatccaatttgggatgagtgtgtaatttacatgtttatttaattcagagccacttctcagtaaataggatgytcaggggcttgaattaccaaagctctctctacccaaggctcccttactaatctactcctgacatttattcactgtgtgtgcagctgccaaaaagcccaatgctaaatgccctcattcagctggaggttttgtcttctgaagccaaacagctggtctgtctgagtccctggtggtgttgattaacatggggttttccagactgttagcactgatgacagtctacagattacccatccaaactaaagcttggggaggttaggtggagtgacttgtccaaggtcaccgagactatttgttgcagcaccaggataataacatcagcctttaggttaactcagctggaggttgtgtgtgtgtgtctgtgatatggttaggctttgtgttcctacccaaatctcatcttgaattgtagacccaataatccctataatccccatgtgtcaagggagagagcaggtggaggtgattgaatcatggggcgatttcccccatgtcgttctcatgatagtgagtgaattctcatgagatatgatagttttataaggggttcttcccctttgctcagttcttctccttcctgccaccttgtgaaggtgccttcttcccctttgccttctcccacaattgtaagtttcctgaggcctccccagccatatggaactgtgagtcaattaaacctttcctttataaattacccagtcttgggtagttctttatagcagtatgaaaatggcctaatacagtgtgtgtgttttgtgtttttttagacagagtcttgctctgttgcctaggctggagtgcagtggcacaataatagttcacagcaacctcaaactcctgggctcaagccatccttgtgcctcagcctctggattggcgaggatgataggcatgcaccaccatgcctggctaatkttttaattttaatagagayaaaattttgctgtgttgcccaggctggtcttgaattcctggactcaagccatcctcccgcctcggcctcctaaagtgctggaattacagatatgagccactgtgcccagccttgatgggatgtttctacaaagcagaaacataacaactttgactaaagatacactggtgcatagttatygccctccaaattttcagcataaacctttaaataattcggaaccctgaacacacccatcttgcaggaataactcagctagcagagggaaaagcaaataattctatgcttttcctgaattggcttcctgcctgcactgctcaattacaccaaaaggccctgtcagcacctagcacatgcctggcctacatgggttcactctagatggttgttggtctgaattgatccctgcaagggctttgctttgctatccattatttaraacrcctctgcaggaccacattattaccagctattacatctagagcaaagcagcaagaaatcaactatctttgggatttatgtgaaaaagactcgtggtagctggaagtcatacatagaccgatgagtgttttacggtaatgtgctctcaaagttcaatttcttaagttctctaggtgatgcaaaatgattgattttgaaaatgaatgctgaagaaataaattgattcctttgaagtaagtggaccattaattcttgaccttaaaatctctaaaatgttttaaaaggagttgacttagcagttactgcattttatagaattaactctttttcttttcttttgttatattatcttgctggggcccatccactagcttcatagttcttagaaaaataggatagagcctgctattggccatatgtttcttaatgccttactttaaacacacatgtagtcaatgcttgaaggtatagtgggggaaattaaatccatggaaaagctcaaagccacattctacgctactttaggaaatggctggttattttggctgtggctctaatttgatcgcattactgaggctgactgtcttacagcaatccctggagcagtgtgatttggcccaccagggtgcaagctcctcacttggttgtgtctatccagactgagtgagaggctccactttactctgtgtggaaacttcccccaagctgccactgtggaagctctggtgaatgggcttaaacttcattcatttgttcatttcttcattcacttatacctttatttagtcaatatttagtggttatctactatatgttaacaggcctgcccctaacatttggagagcaattggaggcccacatactatatgtctaaattttaagttataaatcaaactaatgaactgttccatcatatactgtcataaagacctggagggccgggttcaaatgcataatcctagagctccctggagttctgcattggaactcaatggtgtgtggagacctcccccataccctcccttggcccccatatgggaacggccctcccttttcttctctcccccaactctccctgtctgcccagcattctgagggacctcacctgcatgtactgctccgtggccacccattgggtcttggggtctcacaatggtgtgtattctaccctagggaagataagaggcccacaattcctccctggaagtgggtttagggccatttggtcagggacttactgattcctgggtacccataatgccatctagaagaggagataatgggctctgggtgggtacttcctttggtcctgtagaccccttatcctatggggagggcacagctgcaaaggcccagagcagaccctctgggcattggttcagggcccagggcaggggcttggctgcccctcgtctgaggatggtgctgtttgccaagtgctgcaaggcgacagtgagcaagactcctgagattctaacctcactgagagagataaaaataaatggataggtgggcgcagtgcctcaggcctgtaatcccagcacgttgggaggccgaggcaggcagattgcttgagcccaggagtttgagaccaggctgggcaacacggtgaacccctgtctctaccaaacaatacaaaaaaattagcccagcatggtggtaattgcctgtagtcccagmtgctctggaggctgaggtgagaggatttcttgagcccgggaggtcaagattgcaccactgccctccagcctggatgatagagtgagactctgtctcaaaaaaaaaaaaaaaaaaaaaaaaaaagaagaataaagatgagtaggataagggtttggaggcattcaatgatgagatacagagtgattgatgaatgctactttagggtgactagggaaaggcctcttggaggtgatgatgtcttcactgagacctaactatatggaggcactgtccaagcacagggagcgcaggggctgcaatggcccagaggcagacttgaggaaccaggtggtagggagcccctggtactgggttgtggcttgagggcagtgaaaaatgggctgtgtttgtagtggccagtaggagctaagtgatacagggcccagaggaaagagaaatggcctgagacttcccaactggctgtctctgagcaaaggacatcccttggccttagcagcctcacctgtaaaattgagatgcctcatctctctcagagggctgcagaggaacagatgagatgctgctgcttctgatattggacatgaactaactaagcawtgatgtgcagcaatgagctgccttggactgtgccagggactgctgctgggaatggctcaggagcgtctttttgcagctctaagggaggattctttctagggcatactcactccccaacccccactctcagatgggctttgaagcctttctcatggcctctgtctgtccagggagatagctctctgccgacagagcagaaaatgtctgggaggctgtggagccaacacagtctggacaaagcagctcctctgcagcccttcctcgcctgtcaataaggaaagcccaacctaccccagactgtgccctggccaggagctggaacgatgactaagagtcaatcccaggggctccaaaccaagacgtcaatggcccacttggcacagaagcaacgttagctcatcaaacaccaacttgccgggaccagcagtgggacttttcacccaacctctctcggttaaggctgctgtttagtgagaggaaccagaggccacattgcgtggtgtttcttttttaggtcactgtctacactgtaccttgtgagttatctgttatcctcagtatagactgtgagctcaaacattcccaaaagatctttttgacatcgatacaaggtcccaagttaaggaatctcttcagagattgtgtaagaatcttccacaatggcggtagctaccagctgttacccactttctatttgtcaggacccacactgagcacttgaatctcacaaccaccctatgaagggagcaccattattatytcattttccagatgaggaaaacatatattaaagggattgagtagcttccttaggggcatacatttgagatttgaacctaggcttgtttgactccaaagcgacactctttttttttttcaacttttatttttggttcaagggtatatatgcagctttgttacacaggtaaactcatgtcgcaggggtttattgtacaaattatttcttcacccaggtaccaagccytgtagtatcaatagttatttttcctgatcctctctctcttcccaccctccatcctcaagtaggccccagtgtctcttgttcccctctatatgtccatgtgttcccatcttttagctctcatttataagtgagagcatgcgatatttggtcttctcttcctgagttagtttgctaaggataatggcctccagctccacccgtgttcctgcaaaggacatgatctcattattttttatggctgtgtagtattccatggtgtatatgtaccatgttttctttatccagtctgccattgatagccatttaggttaattctgtgttttcrctattgtgaatagtgctgccatgaacattcgcgtgcatgtgtctttacggcagaacaatttatattcctttgggtatatacccagtaatgggattactgggtgaaatggtagttctatttttagctcaaagtgacactcttaatcacagtgctgtaacatyatcatcakcagcagcagcagcatcstaatacatttttagcagagttttgtacacattaaatcatttaatcctcataaccttaaagagagttattattatcccattttacagatgaggaaatgggtacagggatttttaaataactgaagtctcattgctcataggtagatagttttgtaaataaacaccyatcacccagaggggtcagctgaggcttagtgagatgaagcatcttatctaagatcacatgaccagtcagtggcaaggcagggactgaacctgaagtttgcctggctctcaatgcaagmcycttagaaatctgcactgagtctccaacatgaggactccctgccccatatttcagtgcctggagcagaaaaatctgggtgggggtgcragaattattttcacaggggtccttcctgtgtgcatgtgccatgtgtgactcaagcaccctgggaaactgaaggttcaaggatcattgtgcaagtcctccttgtggtggatgttttcacaagtatcactgaaggacagatgatgaaagaagaaaggaaagcacaggagctgaataatccagaaactggataattaaaatggactctatttgagaactacctggcaaagacctcttgctggctacartatcagaattcagagttgaacccaaaagttaaatggctactttcaatacaattacagtgcttgggcaaaaccatctttctttaaaaaaaaaaaaaagttttccaaagggaagggacaaacctaccattcctttcccagcaaatttgaacaatttggatggtacaatggaagaatttagcctgttgatgataataatgatgatgataataatgtctcactttaacttaaagtaagagtcataatgaaaggcacggggttaaataaagagcatttgcttacttccttaatgccataggtttagatgaagcatatatgatatgtcaagtccttgagttaggcagtgaaaacctagaacttgtctgaatgtggtttattttccagtggggaagcagacatcaaccaagcatcacaagtgactttcagaatatcaagtgggtgcaaagatagtctttttgacaaatggtctggaacaacaatatccacatgcaaaaaaatgaatctagacacagatcttcacaaaaattaactcaaaatgtgtcatagatctaaaggtaaaatgtaaaactgtaaaactagaagataacatagargaaaacctagatgatcttgggtttggtgacgacttagataaaagaggtgattagaagtaagcaagggctgtgagaaacagggtaaaatgtttgaatttgggcctaaaagtaaagccagaagtgcagagctgtgttatcagcaggatcaatcacatgcaaaggcaaagcaggtgaggttttgtgtgactgggttgcctcctttactctttcctcaactccccctgctcccagtgtctaatattccaacattaatggcaatcactttattcctcccacaattccctactgctgtgccaaaaatagtctggtactcccggggagggctgccaatactgaagagattacagactgggggatttgagagcaggccctatggtgcatgtagaaagcagggtggcactgggtgtctaaggatgggtctggaggggaagctggaacagcagcagaggaggcggggctctgggtctgttgtattccctagggtggctcttgactgacagctgcactaattgcagattacattgctgatacattatccatatagctgaattgataatgttttgacagcgaaatgttttatgactaaagactcccaaggtgaaggaaaccaattatgaaacatgatggagaatctcacagaagcacacaccactacgctctttgtgggcacgaacgtgtgtgggtcatggtcatgtgcttggccctgctttcagcactttgtaaaaccccccaccagcccccatctcatcctggctctgacctgcctctttccaggggtctcttggccaagtttctcttcctgcctgcccctcaaaaccccatgctctgttytaaaaccactgacaatcctgtctaaatgactttatttgcaataaacccatttttaccccaaatgcatacattcctgtgttagtgtttaaaagctaatggtggcactaaagtgtcatttgttcattcactcattggttctaataaatggcattcatcaaatgcccatgatatccactaaagttaaacatgcccatatcctatgacccatcaatttcactcctaggtatttactcaagagaacttagtgcatgtgtttacagaagcacatatatgtgaaggtagacagcagctttattcataattgccaaaaattggaaacaaacccaaatgactgtcaaggtgaatggatacacaaattgtaatatatccatgcaatagaataccctgcagcaattaaaaggaacaaactatgggtccgtgcaacaacatggatgactctcaaagacgttatgttgagcaaaataagccagttagtaaagtctacatacaatataaatccatgttaagaagttcaaatcaggtgaaacaaatctatggtgttaaaagtcagaatgctggttgcctctgagggagggggctattgactgggaagggcataagcaaactgggttattgagcctggagaagccttctggagtgatgtaatttttctaagtcttgacttgggtgatttgcttacatgggtgtacccatatgtaaaaattcaycaagctgtacactaagatctgtacactttactttagataagctatacctcaattttaaaaagtgttcaccaccagggcaatgtgcatctgggctgagtccagctgttccaggccaccactgttgagaagagtcaatggcccagatgagggtctgggcagccctccctcagggccctaaggaaaatgagcagtcattgggtgacagcactaactgcggctcagggtactccagggaaagagaaaagactgttaaggcagaaaagaggtgtgtctggtggtcactgctgaggcctgcaaggaaggctgatccagtgtggaccacagcagggtctcagagaggcaggaaagaacctccctcatcagtgccagtggctcagaagctggaagaactgcacagctgtgggcasgccagtaggcagtgatccagggaatggagacccaggggtcttcttaccaggaagtgaacatgtggaggagcaaaaagagagataccctgtgaataaagcagctcctttctatttttgaatgtgtacagacattatttcatttaagtctcacaactctgtgacatagcctgtattagccccactttgcaaacaggaaactcaaatctgagttcataagataccttgaaggcctgcagccagtcagtgcctcattcaaacccagggcttggggcccagaacctgcaccccagctactacactgtctgccagataacgagtgtgaggacagcttattcaacccatgatgtccgtcacacataaactgcctgttttttcaatgtctgtccccatctatgctctgctcctgagtcaaaggcttccttaatgtcacctctgtccaactctgtaacttcataatttcagttattaaaatgggataatccagttattaaaactcagcctcatttgttttaaaactccaacttcatatactttttaaagtgttattttgattttaattggcatataattgtacwtttccatgatgtttcgatacatgtatacgttgtataatgatcaaatcagagagattagcatattcatcacctcaaacacttgtgattcaaatctttcttcctttcccaagctcaggctcacctgcagttctagggatctggagctgggaggtggtgtgggccgctccctttgctgttccccaccccttccccatccttctgtagaggacggaagctgtctccttaagcaagagcatgcattarttgacgtttggtttctgatggttgtcaccactgatccatttcccttgttggagcccctcactcccatgacgcatccgtggstttcgtgtacctgtgagacacatctgaccttcacttggggcctcttcctatgctcctcaatctagtaacgcttcagccccagtctcctcttccttccttagactctaatgctggggctcacggcttggatcagattcatcttttatatctctgaggcctgggaacttgagggatattgtcttagttctggttgctataacaaactgccataggctgggtggcttacacaacaagcatttatttctcacagttctggagcctgggaagtccaagatcaaggtgctggcagaccacatgtctggtgaaggccttctttctggtttgcagatggtcatcttcttactgtgtcctcacacggcagagagcagagagagaggaagctttcatttctatttgtaagtgtactgatctcattcatgaggactctaccttcatgacctaattacctcccaaaggtcgcacttccgaacaccatcacattgggggttaggatttcaacatatgaaacgaagcagtgggaggacacaaacattcagtccatagcaggtatccttgcccctctcccccaacaccagccacagtgctacttctccctggtacactttgcctgatttgcaagcacttggacaggcagggagtccagtggctaatcaaacaaccgggaagaagatgccagtcttcccttctggaataaaatctgaactgtataagcaagtcttcttgggacttccttcctcaacttcaatttttaacaaaggagtccctaaggaactgtgacaaaagagcaccaattccctttccctcccagagtggggagaaacatgaccgatcctcatgaacactatcttcccatcagaggcaacctcctcctcctcctcctcactcacttccttttttttgtttttgttttttttttgagacagagtcttgctctcttgcccaggctggagtgcagtggcacaatcttggctcactgcaacctctgcctcccgggttcaagcgattctcctgcctcagcctcctaagtagctgggactacaagtggctgccaccatgcatggctaatttttgtatttttagtagagaagggttttgctatgttggccaagctggtttcgcactcctaacctcaagtgatcggcctgcctcagcctcccaaagtgctgggattacaggcatgagccaccgtgcccagccctcctcctcacttccaatcttcctttggtatctccaggatgaaagccccaagccagttcatccaccagttcatccccccttctgcctagaagggggccttctttgaagtaagtgctgaagaatttagcaattttattatcagcaatgtctctacctgaggtgttatctctgaactactaggtaacctctagggcaagtaaatagttcagttcaaactctcaccaactcagttacaagtttgctcctgaaaggcctttattgggaagcccacattcctgcatgaggtagtgaggtggtttgcctccttttaatacactgttcatcatgctacattgcttaggaaaggtcagattcgtgaggtttgtcatggcagaaaaatacttccagaacccctaggaatggtggctgcacaaagtcactcatgtagggatgattgtgcttattgatggggatctgcaggatggggattgatttttctcacttgtctcttggggcttatggagtgctcatgagtactattgccacatgacaaagcacaccaaacttagtgtcacaaaacattagccatttgattatgcccacaagttctgtagcccaagaatgtgaaacagacatgatggggatggattttctcttcacatgttttgggcctcagctgggaagattaaaacacagagggcaaactgaggctccaacttccatgtctctgatgcctgggctgggtggacttgaagactgtcactgccaactggagcatctacatgtctcttcttcactggattgcacctccttacaacatggcagcctcagagaagctggacttcttacgtggcagcttagagttccaagagtgtgtcactgtattcccaaatcacaggccttccaagactccggcggggagaatatgacttgggagctattgttatgatggccgttctaggaaaacaccctgccatgggagcccatgcctcttttccagcctcgaacatctcrgattccaatagagccaggtgaaagggcaccacgcctctagacaggtgcatatcgactaaaagcaccaaggacaaaatcactatactgcggaaatattgtttattctagagagtgaacaattatttaaggtgtctaaagatatcaacagcaggrgtggttgtcctgtcctatttttcaagagtacagtgctcacagagggaagcatttctcatgggccatttgttgcagtgccactaagccgtacctcagggataaagctgtctcaggatccagggcaaaattaaaaatttgtgattcccacccaaaagggcaaaggcacctcagagcatcgtcatcatcattattttttatttttattttaaggaaatgaagtctcagacatwttgtccaggctggaatgtagcggctattcacaggcatgatcatagtgcactacagcctcaaactcctgggctcaagcaatcctcccatctcaatgtccggagtagctgggactacaggtatgtgccactgcacccagcaggacattattttgagtgtccccaagtgggacagcaaatgtttgaatctctctggcccctttgggtgtggtgaccaggatgggccatccattaaggtacatggggctggggttagagaatagagcttctccctatgaatcatggagttgccaaaactagaaagtgaagttcagccagagaagaaatgaggtccaagcaaccacatggaggttccagagaagggaggagaactagatacagaagttgtgactgagtcaggcatttgggagataaagaattagtttgagaggaaatggaggaagggtcttgtattatgctgtgctgttcaatgaggtagccagtagccatgtgcggctatttaaatttaaatagctaaaatgaaataaaattaaaaagtcagttttcagtcacactagccacatttcaagtgctaaatagctacatgtgtctagtacatgctgtattaggtggcatagattatagaacatttacatcatcacaaaaagttctactggacagtgttgactctataacaattgcctagagcaggcagcttttttcatgaaccagccttagcatgatggcggatgggaaggggaaggtggggaggtagtcaggagaatgtaagcgttcaagagtggatttgactttccaaaacaacccaragtcatctggagccaagtcataccctggatctggcatcctcatgctcaataaatttttgatgattaaataaataagtgcttgagctgtacagtatcgtttggtggggrwaggggkggggaggagacagaggcctctacaaaatagaggggctaaattttcttgtgtagcagctcattaamtaaatgaaagacattctaagaggagcttcagaaatgttttgagtagtgtcagcaacatcagaatgagtataaagcctctgaacataactaccttgaaagggaccacattcaactagctggctgtgttaccaagattaagacccctagccactctgggcttcagtttcctcagctgtaaaatgaagaattaagactgaagaccaaacccagctctttctgtgtgtctgtgatttggttatttaaactctattattatcatctttgttaaaagagcttttcttgtcataccacaaagctactatgaaagcatcagggagagcaaataggtttcatctcatgagccagttttgattaattggtagtacttgcttggaaaactctgttgggaagagttcaaggccaagttcaagcttagtgataggagtgtcctggttgattagtaatgtctgccttggggatgggagtggtggagcactgggacacctaccatcccacctttaggcactgccttacccaacacccaagcctaaatgtttactttcttagcctttcttgcaattaacagtggccatgtaacacrattcctgtctagatgtgtgttagcggctatggcagccatcttgtgaccaggaggaagcttctgagaatcacagagatgcaacctctgaagctgccaaaccactgccagcagctgcctaaccactgccagcagctgcctatctccagacatcttggtaggtgagaaaaataaccccctattcatttcagttcccagaacttgggatttctgttactttcrgctaaaggttttctggatacatcccagatcacgcatctgcctttgcatgggcacacataaatggtctttgctaaatttctactacttgtccttttcattcaacttcttagtgttcagaggtgttcccctttgtctcttctctgggattttgaatttatgctactctgcttgaggaagctctggagacatattccttaatcacaacattctgtgaatattgaaagcctgggcaatggaaagaacattggccagaatgtcaggtggggcaagttccattcctaccactgtcactcactgtgtgtactcagacaagtcacttggcctcccaggacctcagttgcactctgtaaaatgaaaggctggattataaaactttcagaatctctttttagctctaactcctatggaccctgattgaaatggatgtagacatgtttgtttttccttttgtttcatgcttttccttgggtaactgcacattttaccttcaataggtacacattatgaaaatccaccttgtcggtgaagtatagctctttcttcatgctgaagcaatagttctttggcaaggaataaccaaggagttttgggataagacaatcgggtcagacacatggctccatctcagaactatcttgacacatctgtctctctctgcctgccctttgcctgcctgaaatttgatattcaagctatcctactacctggatctgggaagctcctccatgttttggatttctgcatgccggatttgtcctttctcccctggccccaactccttccctatttattttcacctctaataacctctgatctttcctttgtgctcaacatttcttaacctgaaatctgtagggtaggccctgctctaaccacaggcccaaggaaatcaatgaaaacaatagtattgcccctatatagagactaagatctgtgcctgtaagcactccctacccttccccttgtattcagtcttagtggctccagacccctccttgttaatgagaaatcactaggatccttgtgacatggtctgcctccctacccaggttctcagaggtagctagccacatgcaatcagatgcattaagtagctgccttgtcaacatgcagcagccaagaaaagtcctttctaatcatacttcctgtggactttgagattcaagttccattaggtactccaatgatcccagcaatgtgataacatttctatagcaacctcctcaggttcatgcaagccaagcactcaggcaccttggttccacctctgaggcatgagtggactgcttatctcctgacttttaaacacctatcagctgtcccaacacttgtgtaaatttgtccatttgctactagccaaagatgagaactgagcttgggaagtcatgggggaagagccataatgcataactcaatttatcctggttgcaaaattaatttaggtgaacataagtctacatggcaattaaaagactgcacactctgagtgggagatttcccatcttagtggagagcatacatgaaattttgcctcagcatctgatctgtagtccctgctctattcacatgggcctctgctcatatgtacctgttgtctggctttcagacctgtgagtgcttgcttgactttcctttaaactgtagattagctatctggatttctgatctcctgtgttagctggcctttagtaacagcatgctcttttatgcttgcgtacttgtacctctgcactattgcatgttgtggctctaataatatatatttgcttactgtttttttttttttcattgctaacatttccatggagtagccctgttctctataacccatcacccaggataatagccacagactatgatccacatagatattttggacaattttcaataacaggctgacaaatgttaatcttagaagttggttaacatttcagaatactaggtaaactctgcattactgcaaacacaaggtaattagttttcctttagcttaggttagctgaatcaatctcaaagaatagaaaaaaaaaccacgaagaccattcacactttaaagggtccccctcagctgtcctttacctccttccctgcaaccaacagtctcctatggacatgggatctctagcattctcagagcgtctgtaggaagagatggagttatttatgaacactgtgcatgattacatgactgttacaataattcatgtggagtcatcaaatggatgcttaagccttgctaaatatatcggacggaaacttttaaaaatttgaaacacaattatgcaattggcttttgaggttcacattctgaaaaggcatgtatttaaagataaggggagtttctttctggcttggaaacttaccatctctggctctgaaaccattttagaagccagatgactctgcaagttggaaccaaacaaaagagatgagaaatattctgctgtgagcaagtatttccttttaagttatgaagaaaggcatttacttcagttcttatacaagatttcttgtgatattttcccttcccagattaggttatttcttctgctaacaagctggataatgtcccaaaacaatctaaattactgaacttcactaaattttggaaaatgctctaacaaaatctcatcaacaccttggctactgtcaaagttcccagattctagtcttgtgtatgccatttaatgtctttattagcatatgtgtataagaataatcatgatgatagttttaatctaatactattttccttgtcatgacaagaactgsttaatgtgcaaaataataaacatgacttcacacttgctgcaaaaaatagtgaaaatctgcatcaatccagaaccacacaccaaatgatagtctgagttgctcttcctaatatgatacatttttaaaccatacatcctgaatcactgaaatgtatgaaaccaatgattacatttgttggcctgggaaaattcaggacaacgatctgatataataataataataaaaaagcatttattttacaatgaacaagttttttcagaccagaattttaactagtgacatttctcaggcagcagtaatgctattgccatggattttccagagaacatttcacttcactgttatttataacttagctcagcctctttctattatttatatttaaatgtagaaagaaatcttttcctgttcctatttctttggatttttcttttcaacacccacacaaatccatgagtcataaatgagactatgaaaatgaatggttccccatcacagaagaacactctttggctactcatgtgagtttagatatagttgtcaaggtaggttcaaactgcaaatgaaacaatgtcatgtgaattctactcagaaaaaacagaaattagggagttggcatattgtccttatattttaatttaacacaatagattttttatacaaacacatccttttctgaactctcacataaatactgtaaaatatgtataagtagtagaatgggatggtaagaacccagcttctaatcttagctctccacttcctgattaggtgaacagctaactgtggccatctgcaaagcagacaatactgtctgtctagcctccccagcaatgttgctaagagggtctaatgcataaaatatgtaagagtgttttgtaaacgataacackccatcacaattttaagatatatttattaccgtttctttagctaaattaattgtatgggcagaagaatgactaggcagtggaatgaactgacaggcagattataaattcgtctactgctgcaaacaaatttaatgttaaacttagtccccaaggatctgataatgaatttggtcctgtaatacaaaaggacacaattgatcaccataagtcaagtccaattcaacctgaatgatccaatgatgagtaagtgacaaatgtccaatatagagagatgttattgctttttgcagttgaactcagtttcatttttatccaagagtgaactgcccctgcaaaactccatcttagttattttgcatatgagtatgtaccaaatgttacaaatgttattcatcaccctttataatagtgtctctgttttagagatgaagaaattgaaawaaaatttttttttgagataaggtcttgctctgttgcccaggctggagtgcagtggcctgatcatggctcactacagcctccacctcctgggctcaagggatcctcccaattaagcatccctagtagctgggaatacagtcacatgctacaacacctggcttttttttttttgtagagatgggatctcactgtgttgcccaggttggtcttgaactcctggattcaagcaaacttcctaccttggcatcccaaaatgcagagattacagacatgagccaccatgcccagccttgaaatcttagaataactttattattatataattataatagcatataattacaactctgaccaaagttttatgaattaaacaaagttgtaattatatgccattactattgtatttgaacaaaaattgttagagtatttgaattgcatttttaaactttttagctgagctaggtttaccaaacataccaaagggtgtaaaacatgaaaaaattcaaaggataataatataaatggtaaacactccaacaatattgaagaatatataatgaaaagttagtctctctagcagggcaaacactcacgtcacccatctcacttccttccaagaacatactctaaccaatccggtgtgtctatgcttttagaattttttgcatatataagcatttatatatctattcttttaaaaacaaaatacaaagggtagcataatatacttgctattccacttttttttaatttaacaatatatcttggaggtagttctacatcaacttatttcatatttggacatataacaatttgtttaaccagttccctacttatgagcaatattctgctgttaccaacaagggcaaaatccttgtacatatatctgcacatattttaaaaggaaagaataaattgatactctaagacttattgaagtacaaatkcattacaagtaaaaatagaaaaaagggattatccataatttctttaagtttgaaaaaaatcctctgaattattttttaaccagatgagaaaaacagaatggaatgccatagcttaacttaagtaaatttgaccctrtgctgataaacatttggatgttgcatatgatcacccaaaagtaaactactctgcagccaacttcaagtgacactctagtgtttagacaatagtgaacttcccataaaaaataaacaaagcaaagttaccttcagcaaatagaggagatgtatgtaagaagatgatattcagctttgctgcattaaaaaaaattggagaattttgctatttggacttggtttgaggagttgtttgtggcaagtctcaggacataatataatttcacaaaaatggtgccatgcaggtcattttctctgagacttccagggaaggaaaatatagccctccaaaatgagatggggagattgcctttcccagaggccccactctcaactctgcacgtcaggcccactttggtggtgccaaggctaacatgagctggtttggagataaaaccatcccatgtgcccatacgatggagaccttccagagcattgtcaycacacttgaatctactctgcaccactccctgagatccaggagaagatggtctggcaaatgcttcccttcacctatggctttatttgtgcctcagtttcccttgcattttctgcattgttcacctaatatcagtctttttctttaatggatatattgtttatctagcttttcaggaagagatacatttgcttaaaaatagattgtcttcattattattccagttaattccaggatgatgtcaaaagcagtcctgtttgctagtggctgtgagaaaccctgtgtctggtcctgctgtgtgacttaccaatgtcctcctcatctgaaaaactggcatcccagagtttttggaaggagcagacatgcaatgtggtttaaaatgcgtgtaagcgactaaaatttatggatcactgta

SEQ ID NO: 13394 - DNA, 13179 bp, Homo sapiens
aggcctgccctctctatctgttcttcctgtttgccatgaagaacagctggccgtgttggtttaaaagccagaatttttatttgtttggagttttgcctcttcatttttagcatttctctctcatctctttctgcctttgagatagctgttcacagtgccacattttctgtrtctgtgaaaaaacgagccccttaacctccagtacacaccatagacatactcacccccttctaaaatatttattcttttagcagccctggctggtttccattgtgtttatttaatctttcaagaattttcttataaaagactggacaatcaatgcctttttactgattaaggtgaaaagttrtacatggtttttcaaatatttgtgcaaatgagagaatgtatgagtctttgcatgcatgcagatattatacctaatgttagactatagctgtaggcagattatctatttacctgtctttctctccttttggaatgctaactcttaaagcacagagaatattagtagttgagtacttaccaagtagcaggctctgggctctagattttggggacacccctgccatcgtggaggttacagtcttctcattacaactctgacccagtcattctacttctttgaagattatcctgtatgcaagctttacttagaattgcagaaagaatgagacatccttagtggtaaacattaatgaaatctacgaatagatactctcaacaacaaygcatatgcatatctgttgayatggaaagacagtcgtgttgtattaactggaaaacagcatgatataaaacaacacagaaaggatgatcccattttatgtacctataaggaaatattgtaggatatatttctggttacattagttatttctggttgctagagtttaaggacaattggggttttttgggtagtgaacatgtgatttatatttaatcaatatataaagaaatagagcaagaaaaaaacaccactgccatgattattcagataggcagacttttttcattcattcaaccactatatatggagtgcagctatatgccaagcacaaggcagagaacacaacatgctacagaagtccatgcctttagagcattctagaacacaatttacattaaaatgctactaggtaacagaaggagcagcagtgtatgtggattagagtcacctcaggatttccatcgtttctcagaacacactgttttgtttgtgggtggaataaaggaggctgccatgttcagtgtacataaagaaagcaggaggttttctcaaagagcaggcattggtacaacatgtcatttaatagttaagaggtgggggaaggtagcctaatgggttatgccagccacttatctttaggatagtctggataaaatataaagtactatttctcatgtcstctgcttatgctgggtccccatacaccatctgaactaatggactttttggcatcatctccttaaatgcatcatagggaatgaatttctccaccaagaagccccattatggctttgtcagcctaggttttgatttagcgatagcaatatgtgccttccagacataggatggcaatgagggagggcctctgctggtccttaagtgcagggagccccccttcttagagattaatcatcattgtgacagatgtgcttttgctgaaacttggtccagagagcagcagataaagatttggatgatgtctccttccttctttcttggccaaaggaagccagcccagtgctgggctttcaagaatccagttgtttagaaaggagggaggtaataaagcagaaaaagatgttttatttttagaaattaatgtgcagctttctgatctcccaatccagttcaggttctttcaacttcattatctgttgagaactattagcctaagaaatgatgtgactgtggttctctaccttggctgtgtgttagaatcatgctagaaactcttaaaaatctaggccacatcctagacaattaaatcagaaactctgggggaggggtctaggcagcagtgttttaaagctgccaggtgattccagtgtgctgctagaactgagaacttccacaatatggttataccagctacacaaggcagagagtttttaccttgaaaaaattaaaaaacagcagtagtgtaaaaatattatcctcttattaaaagaagaaacatgtgacagagtgaattcatttagatgtcttgtttggtttgattttaaattaccacacttaaggttgaaagccttatctgttgttccccattctcatggcctgatcactgtgaaattctgggaccttagaagccttttgtattgactgctcgctcgctckctctctctctctctctctctctctctctctctststgtgtgtgtgtgtgtgtgtgtgtgtgtgtgtgtgtgtgtatttttcttttacttcttgtttggccaagaaactgtatgtgttaatagcttgtttgtttttcgtcttttgttttggctaaattgcttttcaagaaactgcctgactccttgtttaattaacttccatatcctgcatatgtggctcatttcacagtccctccatcccttagtggttttccagtccaccacgaagatttgtatgaagaaaatagccacctcatctatttatactattttatcttgatgtttttcattgtttctctgaagcacattatttctgatcttgaaatgtaatgttttaaaatatatttttataggaatttatttttctcctctgaattgcctttgttgttattcctttggattttgaactcacttaactctgtgctggaaagtttctgctgatttttgtcttcttgatctctctgtttctttaaattctaaattattttgcatttttccttactgttgaattgcaacacttagtctctctatcttgtcacaatttatggagaatgatagcagaatccatctcaatagtatagcaactaaacatgtatatcatcgtttcctagctgacagcctgcatggagatgcatcctttaaaaaggggatgaggatgagaaaggtactgtgccatatagtgttgggcatacaaccaagacggcagtagacacaatttgttagtgatgtccagttactagtattgctgagtttatttgtgacctacttttttaccttttgtattccctgtgcatacgtgtagcattaaaacagtgttctgttgccaacatctccaaacattagaaacataagtaactgtttttttcagtttccctgggctccacagaatgtagagtgggcacatctgcacaaagcacagggcacagcttgcccttgaacgcttcacagcctctgtcgttgccactgttatccgcttgtgtactcatcctagcctctgggcagacctgcagaggcacggacacacgggcatccagcttattccttcccttttttcacctccccatttagcttgtcttctttacccactttccacagtcctcttaggtaagaggccattcatttcgttaataaggatgtttgtttatttgtgtttcgaaagtacatgctatgttccaagcactttgctagctgctaggatgcaattgactacaagacagatgtgttttctgccgccctaatacctgtaatctggtcgggcagacatatgaataaacaggagtttacagtggagtgtggtcagtgctgtgatggagttagtgcagaggttctgggagaccatggcagggcacccagccttgtctcccgagtcaaagaaggatgtccagaggaagtggcacctcaactgagatcagagggatagaggtgggagagaacctgccacttttgaggaagtaaaagatgtatgttatagctaaaggataatggggaacaagamcggtaatgagcctggaaagatggggggcttatcttggaaaggcatggaaagcctttagggtttgaagcaaaggattggcatgctctgatttgctttttagaaggaccattgtgactgcagtgtggagaatggattggagagggaaagcataaatgaaaggtaacagtgtttgtagacatgacccagtgagagctattggtggcctggcctcgaagaggagatgggatggagctagcaaagatagggattcaggaaatatttaacccatgccttctgtctcagggcaggagtgattttcaacccttgaaaatgagggcttgtcctgcctgtctgccatttggagtcttcatctatgttgtacatcatgttgaaaagatgtgtattagcttcctactaatcaaagcatgtttgtggatatggacaccattacaggtttctcatgcttcccttggctcccagacactgggctaaagtgttggattggttgtgcagtatccatacttgtcaactagctatttgtcatttattttgcaccctagaggccaaaaatgttagagcagaatgattccttaagttttatcccatccaacacccatgtttagcaatgaagacatggggattcaaagaagggaagtgatttgcctggactcccacagagaattgggactggaacccaratgtttcagctcccagttatgtgattctttgggccagacaatggcctctctggccaatttagctacaagagcatgtcactttgccagttttacttttcccactccttttcagcagcagtgagttagtctaaaatgtggcagttaaataaatcaaggctgattttgggtgcacccttcctttaaggcaatgggcctctccagaaggaacagtgtgaacattgtcttccagctctacctctgctccccgcccccccgctttgttttctttgtctctgacagcagtggactcagaacctaaattcccccttcttaagccacttggtgagtggcagggagcagtaggactctgagaggttctgggggttttattgtgatgggagatagtcgtcctgcacttctgtagattacaggccagcaggtggaagcctgggctgtggaatcagattgggtttgagtcccaggtctgcttcttggccactgggcatgcaaggccttcattttctcatcagtgaaataggagcagtcatacttagttgacccttgaacagccacaggtgtgaactgtgctggtccacttatatgtggattttcttcagccaaacgtggattgaaaatgcagtatttgcaggatgcaaaacctacttataaggaaggttgactttctgtaccctcaggttctgcagggccgactacgggacttgagtatacacagattttgatgcatggggggagacgaactaatctcccacaggcagtgggacaaccacaattagacttcagattttaaaagataatatattttttaaaaaccagtgcagcgcctggcccatagttgatggtaactatgcttaaattagattattattcgctgtccttttactacagtttcccaaaccatagatttaaccccccacacagctgtctaccatcagttgccctggtatcagttttttaatgaaatttcaggagtgtgggattctttgtctctgcccttctaataggtgggaactcttacctctctcatccacttagccccccaaaaaagacagttaaacttgaaagctaccagactgtgaaaaagtaaataagaaccmctggccagggagagggcttcagccttagatgtttacaagggcctgaagcagagaaagagatagaaaatatgtaaaagcaaattttacctgcttggaaagtagcttaattttttttttttcttttaaactaattctgtagtcggccttgtgctctgtagagctggatgaatggttaaaaagaaagggggaaaagccagaagaaattaattctgtggcacagagctgtgaattcttccttgatgcaggatytgaggttgaaggaggttaaatatgtgagggccagaaggaagtatcatgtaatgaatgataaatctctagctgctcctcagcagggcaaaacatgggcttagcaaatgggaaaaaaaaaaaaaaaaagggaagtagcaggtggagataatttaaatagcacagggacccctgcttaccaatccctccacagagttttgccctggagtaagcatgacatcagggtgcttgctgcttcctccagtggcccgagctctgtgtgcctttgttgaacaaggttttcgtggagctgaggtgactctcatgaacagagaatacctgtccttcatacagagaagcacccaaatgcaaacatctactttttctggtgttcaaccaggtaaacctctgtttagcaagaaacatcatccccagagtggggactgtcttgtcctttcagaagctagtaccctaagcaagactcataaggaaggtcgggcctccctaggtctctgtttcttctgaacagtgatgagctaggtgcagagagagttaaaggtcactatgcagctgacaagtgtgaccagttcccagtaaattccacttggctggggtttcagaggtgagcaaggcaggctttttactcattacacaagaatctagacatccctttaattgggtggcattctgggtgctaaaaggaaggggctttgagaggcaaagatgatgggatatcataaatttttttgtttcctttttaatatagcgcagctcctatacttaagatttaactttgaaatgtagcatagctaagatctggtccaaaaagatttctgatatctccatgaatcctagttagggattgataggaaaaaaaaaatcttgtgccacagcttcatgctatttttaggaacctttctgaaaccagtggcagcccaagttagagcccagcattaagtccacctcatgcacatcatacagttgcagcttatggtaaaagctttctgcaaagcttttctgctcctgggttaaggccttccagcatcagtcacatgtaattaacagctacattgtgtgcttactttttgctagatgtttcataaacattatctcatataaacctcacaataactaggtattattrtcccgtatccctgttttacagctgtggaaagtgaagtgaaggatttttgtcatacagccagtaagtgccagaactgacttgaacctagctctctgtcttgattcaggaactactgctctttccattggtggctcctggctaatcaatgtgatagtctttgaagaaaaaaaaaaaagagttactatcttcagagttttaaacttatctgggagagaatttaggacttttctttgtgagacagtcttgctctgttgcctaggctggagtgcagtggtgtgatcatggctcactgtagccttgaacttctgagctcaagtgattctcctttctcagcctcccaagtagctaggactccaggtgcatgccaccacacctggctaaatttttaatgtttattcatttatttattattttgtagagactgggttgcgctatattgcccaggctggtcttgaactcctggcctcaagcaatcctcccacctcagcctcccaaagcactgggattacagatgtgaaccactgctcccagcctaggacatttttattattcctctcgctgttaatccaacaaccctgtccacattcctgtaaattggctttgttcatcttttttacttccagacatgttaattttaaaaagaaggcatcttactatctttttaatggcttctgttttcttccaagttaaaccaaagagtcatttgtaatttgcctcagtaattggactgtgactttaaatggctgctagaattggccttttgttgactttactggagttaaaataattctctgttttcattagccaagagaaagacttgtgactcttgatgcttttcccactgcaggagcaaagcagtaaccccagtaagggagaagagaacttagatttgtgtaagtccactgtgtgttggacacttaaacatactttagatgtattatctcattcatctttctgactgcatgaaggtgctattgctgtccccattgtgtaggtgcagagagagttaaaggtcactgtgcagctggacatgtagtcgatctgggattcaaacccaggtctgtccagctcatgttatttctactgtatcacacttctcacctgtatatgttgaatggccagagtgaaggctgggctttatgggatacagaggaggtgactgtacaccaggggaaatcagtgtcacctttctgacgctccgtggcattaccctcattcagaactcattaccaaatacttcatgtaagtaacctcgaaagtcttatgagtacatcgagaactagttccaagtcacagaactgttcttgtggtgaaagtggttgaaaggctatagttcattttggttattggatggaaatgccctctctctctggttgattaacggagaagacttagtataccagccattgtttcttcgtatggaacgttgcttgttttgtcccattttctcatctgcaaaatgtgggtataatacctattacgtaagattattgtgagaattgagaagtgtgataatgtaggtaaaacattagcagagtatttggctcttacatagaggctcaaattgcattagtggcaggaggaaagtctgttttattcattgttgctccctcagcagccaggccattgcaaggcacatggtgcacattcagtaaatgttggtgagtcattgatttcttttctccctttgtacttattttttacagatatttgagcacctagccttgtgctggacaataggggacatggggtccttcacacaagaaacatttgtagcctcatgagatagatggtcatttgtgaaaataatctaaagaaaatgacccattgttgagtggtagatggtgacccttgaggctatagtgtgcaaagctgatttggaaatccctccagccagctctggggctgattgtggtgggggtgggggaatccttacttactacttttggccctgctgtcagaattggaccttgtactgtcattctaagctgggttgagcctgagcacgtcttgtcacctctgtgactgaaggctgatttaatatgtcatgaggcagtttggtttcaggaagtggtttgctggggcatgagcgatggatgttggaagttagaaaagagccagaaattaaaatgctgcctcagttgggtgattgaatccagtcttacctggtggggcaaccacttattgatttggaaagccttggtgaatccattttttgctactcacactggggaatggggaccagcagcatcagtatgacctgggagcatcttcagaatgctgaatctgagcctcctcgtcagacctgctgaatcagaatctgtattttaaagagatccccagatatttatgtgcagtgtgaaaagcaagctttggaaaagaaagggcaattctgtagactttaagcttaggaacaagagtatttttctggagtcatttgaatgtcagtcgttaagcagggctgccaattagggctgattttctcactgtttaatacttgccaagtatcttgagcagtggcttcccagactgagctgctaactgaataaaggtggcatgattgccgatgaaaataatagtacattcgagttttaaaatgtttttatatagatccttttctctgttcacagaacagtcttgtgagatcatctcatctctgctttacaggtaataaaactgaagcacagagaggttatgtgacatgcctagagtcacacagtaaaatcagtagcagttttgaactgaggtcttaaaattccaagaagttgggagcttgctttttttttccttttcaccatctaaattttccacattgagatatgagagaaatcctccatttctgccattgcatttgtgtaggtgcacaacagggaacgtgagacaattatagtagagaataatctggaccaggaatggcgttctgcaataatcacctcttgaacaataaacttggaaagtttcgtggttgtttctgattcagagcctggaagagcaagccatttccctcctcctacccttggtttactaatcattcacttcctcttctgtaaagcccaactcaaaggacccctgctttgtaaagccttccctctgggatgggattggggggcaggcagataattggttcctcattcatattttattcatacttctgttaacaaagctgatcacaccatcttaactgcacatcttattacccacatgcgcagacaaggctgtaagattcctgaggatctagaaagagtcttcttcaccattgtagccccattgtctggcatgtgttggtccttcatacatgttaagtgaatgaatgcgtgtatgcatgattcagactttgttttttgcctttcttttctttttccctatagtctkctctttatagatttttaatagcatccaaaagggtagtaggggcaggaagctaaagggtaggaaataaaactcaaattcttcagtttcgagttcagttctcagttcagctcctctccagcagcttttaggaaagcattttaaagaaagggaggctcacttggggcttgaggatggtctggtccctcacagtgaatagacaagcatcaggcgcagctgcagtttttacggaatacgtgcacattacctttcctcagtgtcccctcgtaagcagtgaaatgtaataaatggcgttttagggagccgaagagttgtcaagtttccacagtttggagaactttaacatatggcatcttgggatctaatgaaataaataattcatgcctggaaatataagcaagagtgaatctctctccttgctatgtgaatggggactttggttgcctttttcaaggtatgtatgaaacatatttattcagtccactcatttatgtccctttactttctcactcactcgtcaaacttatcagcctcctcttccccttccttttcccctcttcttttccctcctcccctcatctctcttctcaccgaaaccctgagggagataggaaggtaataagtattattgttttgtcagtgtctccatcacacaccttctgtttttctttcttgaggcatctcagagggaagtggcaggagatgactttcagcagacctttccccttagtgaggacagtaagtcccaaggacatgtggaggcaaggatgaggggcagatgaacaagcagctgtctggcctaggtcttacagaattatttttcctggaattaatatgcttagaatgtatactttagcaagtgtctatttctggctccagcatttttctttgggtgtcaaacctggttttatctctgagatttttcgacactaggagaatttgacattcacattctaagagtgttctgtaatgtttccatttacataccagttttcttcattttttggctggaggggtatgtgaatatatacaagaatctgagcagattcatttttagctgcagcagaggcaagcctcaggggaaaagtcaagataactggattcctgaaatggtataacttggcaactcgtcttttctgttccttagcctgtaaagcattatttggttttagaagaggagtagctcctacttgtgaaggtcttcattggaatggcacattgaatgcatgaacccttaaaatccttactccctttaacccaagccacatctcagtggctttaaagcatatcaaagcaaggaggggaaagtctgtgtgatacggtactaaaattgatcctgtagtaccaggcatgaggagaggaaggaggagtatcatcattatcctgttaaggatttgtcatgcctcagagcatctgcaaggaaatagtccacagataaagttcagcaagtgatttgcaattggtagaggtggtttggcattttgaaaagctttataaatgtgactgcagcctgagaagaatgaccaccactggaatgagggaaggctggaaggatttaaggggttctttatgaaatcaggcacacatccccatgtcgactaggctagactcaggcaccataatagccctggttcagggtcactcctctttccaggaaggtttggatcctacagttagaaaagaggaatcttggatctctaggtaagggttagagaaagtattctgggcatcccaagttagaatctggtgtctttgcttaacgagttctgaacatttcatgtgagggaatatgggctactgttgtaggccttgctgtttcacctgaaccatccctgcccttgaaggacttaaagttggaaggaatgtgaggaggcggagtagcacagttatatgacatctaatccaaagtagaatatgcgagccttaagagaagtgcagagggctgtgaggagtatgaagtggctggcaaatagattcagtattatatttcatttattcattctgcagatatttatggaccacccttttatgttgctattgctgtgctagtattggagatacaaagatgaatatgacacctctcgggccgttgccaactgtcgagtaccaggaagagcgcttagataaatgaccatgtacaatggggtacgtgcaattataggtccactgttatttgctgttctgaattccaaatgttaagagttttgacatgaaattttgtttcatgaggcttttagaagctaaactagaaacgtactggatatttaaaaactgtgttaccagaatctgataatggagttctacactagtccctgtggggtatgttgtataataaacaataagtatactgtaatttctttctgaaatctacaaaagtatgaattctaaaacagccagccccagctaaaggattgtggatacaagtaagatacttcaggtgatttgagagtttacctggctgtatgggctaccctgggaatataaccactctttataacatcctttcttcgagaatggtatgtgctaagttataaacagctgacttagggccatcattttaaagtatgaagccttccagtcttcgcctccccagtcttttccattcttaaagtttggacyagtctgcaaggtagctgcctccctaaggatttggggtattctctaaaatttgaatatatgatattcttgtgccctttgaatacgctgtttaaaaataaattttaaagaatattctcatgtaaaagtaacacacatactttggaaaatacaaaacataggaagaaggaaaaa

SEQ ID NO: 13395 - DNA, 12462 bp, Homo sapiens
actaactaactttattagactagtttttacataaataaccagatttctttgcctacctaaagtacaatttacatgcatcaacacatagattattctaagacatgcttgggaaagtaattttgaatgtaaaaagttttataatttattttctccttagggcaggtgtacattacatattagkgctcaaatatatgttcatttccagaatgaatttttgcacagtaatcatatatccatttaatatgtataaagtgttcttggggatgggggtatattcactcactgtaccatgttttatacaggcttcaacatgcaaatttgtttatatcatggcyttcaatgatcctccattctcattcctgtagattaagagktcatattgtatatctgaccctgaaatgtacaaacttcrcactacaacattcttcatgacactatttrttakgagraaagttgcagctaaayattagtcatgtgacttaaattttgagaaaatggaaaatgtaataggtataaatttcctgacacatacagcaagacaaatccagcccagcctttgatgatcaacttaaaagctggagatgtcattatcttgttgtgtaaatttgggtctatmcctacctytacttctctgtgcctgattttcctcatctactttgaattcrtcattctattaatcyacttttgcctaaagtgggaaactgaatatatcagaatgaaacatctatttttttcataaagaagatcatataatatgtgaaagaactttgaaaggatsaggcattatatmaatgcaagaatataaaagataaacaggaagtctaatstgaayaatattctgagagtaaaaagtgtaattatatttccattgtaaatgtataccaagttttcttagctttctattctccaataacctctagaaactattctaagcatgcctgrtttctgtaacttaaatatggcataaaaacctgyttcctttgaattcacttgatagcagtagtcaatcactaataacgcttgctaatttcctcttactttctaagaaaacccctatatttagcatctgcttccatatcgcacgtggtggttaggggacagcataagtacactagcggctttagcactaaactcgaggcctgggtcacttctcccttgaagaaaaaaggttttaaaaattcctaaatcacaatgtagaactaagttccaccctacctcagaactgcagacattaaaataccatctctttattaartgtctctacaataatgatatttgctaagaacaagatgtacattttttggggttctgttttgttttggcaaatattgcccaagttgtcttagtgtgcctcaaacatttactaaaaataaaaaaatttaaatctttgcctacttatttaaaaataaaaaaaatactcaaaacaaatttaagctgaagatatatactgtataaagtgttcatctacccagtactctgaagtcttaagaaaagtcaatgatatgtgtgtgtatatgtgtgtgwrtatatatatatatatatayacacattagcaatttaagcctttyaacatgccaattttttagatgctttattggttttttttcccctttactactacttcctgttttcccctttactactacaatttaagcctttaaaaatggcaattttttagatgcttgagatagtttgggggatccctagctcttatcatggcactctgttgagtttgtgaaatgcatcttcaaagaggttgtcaataatatgcaaatttttgaaaactagtgagattactaattattgatgaataaaaaatgagtacttttaatctgccaagttaaagctctagaattccttttctccagtaataactcgcagcatcactaccaatggaagggacctaaggaataccgtgtacactgatayacacgargctgctcctcatttttttgtcagattacaaaagctgggctcatgtagttatggcctatggacctctttttaagttattttagcagaagtagatgatggtctacaccttgctcctcttttatattaactgtccctaagccactctgatgactattctaatcaaaatcagtatagctgtgctcactaagcatatcactgcttattattcaaataccttctgttttctatgtagcaaaacaaaaagttttataaatttcagataagctttctgtttttcttcagtgcaaacatcctgaaacagcacaaaatcattcagctagtctgaggataaagtcagtttatgtagtgcttaaagtagaatcccagatattctggaatggaaatagctcatgtgaaacttcagttcatttttgtccttaagggcaaatgatcatcttcagagagtgaagactttttaaaatctgaattcacagataaaatcattttagctttactttataggtactgctgaagttgtagcaggaactactagtccttcactgaggcatgtagccgccttgccgtacagtctgtggtaagtaacttttaggcatgccttcatcagtcgcagcctccatgccaactgtttcaaatctttctacttgtccctcagtacctggaccaaaagcatctgctgcagaaacttyctgaaacattttcatttgcccagatccacaggattgtgaaatatgatctgaaatctgytgtttaagtctaacaaaatcttcctcattgactgatgaaacttgctttgacctttcaaaatgtgaaatatctggactggattcatgctgactgcagttctgtttgaagtastgttgcctgggcaaaataccatcaccgccatctacatgatctactaattgtagatcttctggcckctcctctgaatctaacaagggctgggtagactcggatcttgagaagacttggactgacggaacttggtgtctgtagccactgtgtaccacggtagaatactggacagtgctcgaagtgttttgtgaagattcattttcatcactgctagaaatgcttggcctaraagatgacatgcatgaagaccccccaataccactgctgtgtccttcagtattaattttttcctttttgaacaggtccaatgatttcagatcttctggaaaaggctttttgtcatttgcttctatttccacaacacttacatcagtgaaattgccatctgaatacatttgatcttttgaattaaaattgtgctaaggargagaaaaaattgtatatrgcaagtattagttaaagccacagagctaatgcatctctgaaacttcccagtaaytctcagtggtacagaaataacctgtattatgtcactaagtcactgtcaactacccaaaatgcagatactataaaatgagtctaagtagtctaaatcaatattgttggtgttacattttgataagctaatggtctacaagtagtatttaatatttcatgcctagactaggcagcctaggattaastggacagaaaactagaaaacattaaggaaaatcaaacctgaatgacagagattttgtagaatataaaaatacataatacattttaatctgttaatataaaatttaaggactaccggaggataataaatataaatgagttcccctttggggcatatttaaaattcagagtttagagtaggttcccagagatcatttcatcagtgctaaaatgataaactgttgaacttggttttaatactcaacccaaaatgcttgaggtagttaccatcacatagcagtttcagcacctcaagttttcagtttgcaagttcaaccaaacatctgtaatgtgtactaaacaatttaaaatatcagaacaaatatactatgatggtgataaaacccctaaaatatgtcatacatattaaattttgattaaaattttcagttatgtactgttttatcttcatttactttttgattcagcttgaatatcttatcttttggtacatttgtagatactcaatatacctactaactgtagatactcaatatacctactaacatgtctgtatattataaacaactcagaagcattttctcttacccttggaggagtgtgaggtgaccactgggcaatatgactctttgaaggatctggaacattaggccagatgtgttttttaattctgaagagaaaagaaaaatggcctatgtaaaaccacacataataaacaataaatagtccctatttctaaacatgttcatcaaagactcttacaaaccaaaccaattacctaaatgaacaaaaaatacctactctaccccaaacaaaaattatttttcttataaccaatagaaaaatactgttgaaaatgcataaggattataatgtattcataatgaattaacaaagctaaatctaatcagtgttcaaatttttttttaaactctcaaaattctgcaattaaaaccacttaaaatctttacccaggccacatgttgtggtattccaattaaaagaatccagataacaaattaatgttcccactgataccaaaaaagttcaaatataaaaatcaaatttaaaaaagtgactgagaatggtgcttcaaagagtgagagcctaccagactgactctcctgtaggaaatacctataacatttggaagtaatataaaaagtagtaaagctgacaacctagacaaaccaatgaatgaatccttgaaagacacaaattaccaaaacagattgaagaaaaagaaagctatatttataaagaaattgaatttttaattaaaaaccttcccacaaaactctgggcaaaaggaaacaattgtattaatactatacaaactctttcagaaaacagaggaggtaacatgttcccattcattttatgaggccagtattatcctgattttaaaaccagacagataaggcacataaagacagactaacttcactcatgaacacagatgcaaacagtattaaactgaatgcagcaaaatccaaggaatgcaaagatgttatatgaaaaatcaataaaatgcaccatattcatggaaggaaggagaaaaaccatatgatcatctcaatagattcagaaaaagcatttgaccaaattgtgacacccattcatgataaaaattgctagcaaggcaaaacagaaataagaacttcccccctgcaagtagtagtaaaggggaaaaaaaaacacaaagcggctgggcgcggtggctcacacctgtaatcccaacactttgggaggctgaggtgggtggattacctgaggtcaggagttcaagaccagcctggccaacatggtgaaacccccatctctactaaactaaaaatacaaaaaaattagccaggcatggtggtgcatgcctgtaatcccagctactcgggtggctgaggcaggagaattgcttgaacccagaaggtgggggttgcagtgagccaagattgtgccactgcactccagcctgggcaacaagagtagaactcagtctcaaaacaaaaaaaccccacaaagcaaaaacttcaacctacagctaacatcacatgtgatggtgaaagactaaatactttcacctctaaaattaggaacaawgcaatgctcttatatggtctagatgtactatatgtactagaggtcttagccagtgcattaagacaataaaaagaactaaaagcataaagattagaacaactataattactcccaagaagcatgattgtgtatctagaaaatcctaaggatccaaaaagctactaataaatgaatttatcaaagtctcagtatacatgatgaatatattttaaaaaatcaattgcatttctatatactaagaattagaaaatatttttaaacatttcatttataataacaaaaaatacttttgtcatgaattcaaaaaaagttatgcaaggcctgtctactgaaaactacaaaacactgcaaaagtaaattaaacaaaacccaaataaataaagaaataaaccaggttcacggattgaaagactcagtagcgttaagactgcagttctctctcggccttagcgccatttttttggaaacctcggcgccatgagagccaagtggaggaagaagcgaatgcgcaggctgaagygcaaaagaagaaagatgargcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcaaaaacaaaatgcccatgttggtcctctgccctggacctgtgacattctggactatttctgtgtttatttgtggccgagtgtaacaaccatataataaatcmcctcttccgctgttttagctgargaattaaatcaaaaaaaaaaaaaaaaaaagactgcagttctctcctatagattcaattaaatctgacctatagattcaataaaatcccaatcaaaactatagttttaaaaaagttgacaagctgaattaaaatgtatatgaaaaggcaaagaacctagccaaaataacttctttaaaaaaagaacacactggaagaattctacctattttcaaaatttactatagagctatactcatcaaggcaatgtggtattggcataagaacggacatatatacatttatgaaacagaagtgagagtatggaaatagatacagacttataaagacaattgcttttggcaaaggtaccaaagcaattcaatggggaaaagacactcttttcaaaataaatgacaatggaattagacatctgaaggaacaaaatgaaccttgaccctgacctcacaccatgcacaaaaataacctgaaatggatcatagactaagagctgaaactattgaacttatggaagaaaacatgagaaaatattttgatactgtgtttggcaggacacaaaactcaggaaccacagaaaaaaaactgataaaatgaacttcatcaaaataaaaaacttatgctttttttttttttttttttttttttttycagacactctgtcacccaggttggagtgcagtgatgtgatcttggctcactgcaacccatgcctcctgggttcaagcaattctcctgcctcagcctcccgagtagctgggattactgacgtgtgccaccatgcccggctaagtttttgtatttttagtagagatgttagccactgtgttagccaggatggcctcaatctcctgaccttgtgagccgcccgccttgacctcccaaagtggtgggattacaggcgtaaaacttctgcttttctaaagccacagttaagacaaaaaaacaaagcacagactgggacaaaagtttgcaaaacgtatttaacaatgttgtaaccagaacatataaagcactcttatagctcaattataaacaaaataacccaatttgaaaatgggtaaaagatttcaatagacacatcacaaaagaaaatatgtaagtgacacatgaaaagatccattactagtcatcggagaaatgaaaattaaaacgatatagtactacacacccactagaatgaaagaagtctgacagcactaagtgttggtgataatatggaacactgctggaggcaatccaagatggtgtagccactctgaaaaagtttggcagtttcttataaagttgaacatatacttaccatatgacccagcactctcactcctattatttgttcaagataaaggaaaacatatgctcgcacagttttgtatgtgaatattcatagcaacattatttataatagctaaaaattagaaacaacctaaacttccataacagatcagtctaagttttgatatatccatactacagaatactgttcagcaataaaaaggaaaaaggtaggccaggtgtggtgactcatgcctgtaatcccagcacttttgggaagccaaggtgggtggatcacttgaggtccggagttcgagaccagcctggccaacatgatgaaactccgtctcaactgtaaatacaaaaattagctgggcatggtggcaagtgcctgtaatcccagttactcaagaggctgaggcaggagaatcacctgaactcaggaggtagaggttgcagtgagccaagatcatgccactgtactccagtaagggaacagagtgagactccatctcaaaaaaaaaaaaagggagaagtatatgcaacatcatggatgaatctcaaaaatattatgtaaaagacatacgcaaaagactacacgctatgtgattctatttatataaaattcttggccgtggctcacacctgtaatcccagcactttgggaggctgagggtggatcccctgaggtcaggagttcgagaccagcctggccaacatggtgataccccatctctactaaaaatacaaaaaattagctgggtgtggtggtgggcgcctgtaatcctagctactttgaaggctgaggcaggagtctgaaccrgggaggcagaggttgtagtgaactgagatcgcaccactgcactccatcctgggcaacaagagtgaaactctgtctcaaaatagatagataaataaaaattctagaaaaggcaaaactacagttacagaaaagcagatcaatgactgcctggggttgggctgagaagaagacagattacaaaggagaacaaggaagctttataaaagtgatgaaaatgttctatattgtgattatggtggtagttatacatctgtatgtaattacaaaaattcatcaaactgtacacttaaaatggataaattttattgcatgtaaattcagctcaataaagctgggggaaaatgcaaaaatatgaataaagttacttacaggtctcgcttattaaagcagaacagcactcccagaagagttgtcaataggaatgctaagcaaacaggcacgactatggcttcaatttctccttgagcttaaaaaaaaaaaaaaaaaaaaaaaaagaggtgtgatgggaaataatgttgacatatgaactaagaagacataatacaacttcccaaccagacttactgttgaaaagataaaatacaatcctaattatttttcaaggtctcttcagacttgatgatttttaccctcttctctctttggtaaatcacatcccaaccatttatgtcttatacattaacctggccgcatagcataaaatatatgttggttgggggataaaaatgatcagtgtatcgggtaatctactgggttagagctttcaaacataaccatttgtaacatttatgatctgcatttggtagaatcttagtaaaagtttatctctgagttctaatactgtataacagagaaattatgtcagaacaaatataaayactgggtaaaatggaaaagctataaaaacataattgaactacacatttaaccttctaaaaaataaaaatgcaactctcagaagttttaagagttatttaccatttttcaaaaggaggatatagctggtacagggctaagaactttaggagctgctcaatgggcatgaggagtggcacgagtaggaataaactaaaaagtaaacaagccyaagatccctaaataccacacaaatcctcatctgcatttaaaagaggacttgttcatcaaattaatcactaattgggataaytaacattggagattttttaaatgactgtcctgattaattttgaattttacttagtcttttacagtaaaaaatgtatgaaagtaatattgcagccatatactattcacttaattttatccttccaccacacatatccctttgtaagtaactaacatcctatgaagctcagtagaaatcaagaaatcagttaaatgcttgagaataaactatgggttggcaaatattaactcttaaatgctaagcatcatatatatatatatatgggtgtatgtatatatatttatgtgtgtatatattgatatatgtgtgtatatatatattgatatgggtatgtatgtgtgtatatatatataaaatgccaaatctaatttaggcagaaactttgctttattaaacatctgcttttatgttttcaagcctgtgcctttgctcatgctgctctctaagatgccaccttcttcctatttgtccacatactaactcaaggctcaagtattttcttcttcataaaacctttgaaggtaaaattatccactactggtatatttaaattcctactctatttactgtctacatagtccacaggttctcctttttctgatttacttatgcaaaatttcttcaactaagctgtaaggtcctcgttggcaagactcawgccatgtgaagaagccataatggatccatgagactacagatagagaattgaaaaaaggtaggttataaaataatactaagtataatttaattttaggaaaaaaatatatacaaagaagacactaaaaggatacacaaatatgttattttggggtaagggactaggactaatttttcttcctctctacattttactgtacagtctaaattccctataatgaacacctatgtaataaaaaaattttaggctgagcatggtggctcatacctgtaatccggcactctgggaggctaaggcaggaggactgaggccaggagttcaaaaccagcctgggcaacacagcgagatcccatctctaccaaaaaaattgttttaactagccaggcatggtggtgcctaccagcagtcttagttacttgggaggctgaggcaggaggattgcttgagcccaggaatttgaggttgcagtgagctatgactgcaccactgcactccagcctgggagacagagcaagactctgtctcaaaaacaaacaaacaaaaaatatacatatgggcttttatgtgtgtgtgtacacacacacatacatatatacaaagctctgtagagatggctggtctccacagaaatacataaratatacatttttaagtttattttttaatttttctcaagattatggtataaagttttattttaaataacatacctattaacataccaccacatgggaccaaccttatcccagaaactatattcattactgaccctaacagcaaagctcaggaacttttatcatttattttatgtagtcactcattcatttattccctcattcagcaagcattcaaccaacaaggcacatggaatttactacttatcattaactaggctggcacttgggggtgggggttacaattatggtaaaataaggtaattttctataatgattcaaaatgtagggggagcaagaaagaatgttggttaagtttgctttagggaagatacagaagagccagatgatgaggtgaagacctcactgggggcaatgcactaagaaaagagaagttagcatgaggagcttgcagttgaagaaaatgatgatgaaagggtacgcacaatcaacaggacttgacactcagcttatgtgagagaaaaatatacaaatacatttattgtaatcacatttaaatttatggctttggcatagaacgagggagggraaatgtatttgggaaggaaagagaagatggctaaagccatggacagagtttgaataggcaagtaagaaaacagggtcaagaggccgggtgcggtggctcatgcctgtaatcccagcactttgggaggccgaggcaggtggatcacctgaggtcaggaggtcgagaccatcccagccaacatggtgaaaccccgtctctacaaaaatacaaaaaattagccaggcatggtagtgggcacctctaccccagctacgtgggaggctgaggtaggagaatcacttgaacctgggaggtggaggttgcagtgagctgagatcgcaccactgcactccagcctgggtgacagagckagactctgtctcaaaaaaaaaaaaaaaaaaaaamaaagcaaaaaaaggagaagaagaagaaaacaccaaagaacaaggagactcaggagactgtgctagcagaaaaagtatggttagaaaacccaagggaggagggagtttcaaggatggaaggccaacagagtcaaatgcagaaaaggctggaggcagtggcttatgtctataatcccagcactttaggaggccaaggcagaaggatcacttgagcccaggagtttgagaccagccatctctataaaaaaaattagctggatgtggtggcactggtcccagctacttgagaaactgaggtaggaggatcacttgagcccaggaggtcaaggctgcagtgtgccatgttcatgccaytgcactccactgtagcctgggcaacagagtaagaccctgcctccaaaaaaaaaaagtagaaaaaagatgaaaactaaaaagcatgcagtacatatgatgatcaagaggtcttctgagtgacaccagagaggtttcagtgcaggggtggggtaggacccctaa

SEQ ID NO: 13396 - DNA, 398287 bp, Homo sapiens
  misc_feature (1)...(398287): n = A,T,C or G, or insertion/deletion polymorphism (see Tables 1-2)
tttttattttaatctaacctacatggcagtttccttttttttcaaagtgtaaatcctgccaagaactattcaatatcaattgcatatttgatttttacaaatttcataggtaatcttacaagatagtactgtctactggaagcatgttgtgttatttttattgatcccttggtcagttctgaattatatagtcgttttatttcttagactttacaacccaaatatatggttagaatcttttagagaagtcatattctccatacttgggaacaatttcatttaaagcaaaataaaatcattgtaatatgcaataatcttgtgatttgaaaatcccacagaagagatcagaacagttttaatgaggtgataatgatgtacaaatattttggaaactgagcctttctctaaatatggatgtttctaggtcagtagtcatccaagagtatctcagtgtcaattttaagcttagtgttagatttttggaaaataaagctacatcgcataataaacgactatttatttatgcatctaaatgcttcacttggccttggtccaactctcctttgggtaagcatgtggtagtctatcatttggtatgttgctggccttgcttaatttttgaggctcttgagatgagttcaaaaagcaataacaaaatatgtacgctttgcataaattacattatagtacactgcactcacagacatgtaatttattataagaaaatgattccagctacacaaaataatgtcagactagatcgttagattctagaacaaagtgtaatttaaaaaaatccatagactttggtttctttccctttaaagctacaacaggccaactttgcattcctcataaaaatgatatctcgtttttctttaaaaaaatgatacatttaagcttcttttacaattttaattcatatcaattccatttcatttcacattaatatgtttatttctatttttggtatcatcagatatgaatttcatgtcctttgaggacgcagctaggtattgcttttaactgtccacatgctgtttctgtattcacaaaataaatatttagattagcttttatggtttttggtcaaaattcaatattgaaagtaaaagcatcttgtcattttgcatatacacatataaccttggtgtccatagctttcctttaaaagtaacttggtataaggaaacaaacacttggcttgtagtccagagaattatcagaggcaaaggctgaagacctcgatgtgcagtccgggttatcccacggaatctggatctaattgatgcccaaactgacatcttgacctctctgtgaaatatccatgttcaccaaataattgttaacccatcattgtgtctgggattgctgtgctcagagaattccatgccaaagagcaacttaaatgtaacagtgttttgttcaattaaaaaaagtaataacaggattcagatacaagattttccagactgtttatttcatcttgtctatatatatttttagaaatctaaaatgttacaatttgtttgaaaattttttcttctaataatgccaaaaagcctttctaaagtatgtgatccatccatgcatttagaatctaataaaaaaatactagttaagtgattataacttcgtagtatcatttacttaaggagagtctaagacatgcaacatttccagatgtaatcacgatgttgagtaccgtccagggacaagaatgagaatgctaccagctcaagatctgccttctgatggatggggataagcacttgttcattattgatccaactgagaaatttaatggtgtgcaaacaatgtaagggattgtgatacattttcaaactttatttgaaacaatgcgttaaagtaatggtaataaattactatgctggatgaacatggattatggctgtttaagaacctatgaaaaatgtactagtaacttcagagcaaatttatcattgaattatttccaaaagctgatgactgcatacacaaattaaatattacgatgttcttaaaatgcattctgttataatgtaaattttgtataaaatgggactattgtggacctcaccaagaaggtttattactagaactagattgaaratggaaataaagtcacagaaatctcctgtttaattgtagacaaacatggatgcttatttatttactttaatagttaattcaccaaggctaatgctatggaatagagctacttcaaaataatatggaacagagcctacttcgaaataatagattatgaataaattattctgaagtaagatcagcaacatgccaatttgagttcaggtgcaacttgtaggtggaggatttgcagacagaaaaccacaactagagtcctgctagaggggctaatctgttgaaagaaaaatgagcttctgtagaaacaaataaatgcctcatacttgtctttaaaagtgtaacatgcaccactacaaaactgaaaactaatggttatagcagctgttgtttcaacctcagaagctgtgacagcaatgaaaacattataccaatgtctggtccaataaaactcttggtttcctgtgttttgtgtgggtggacaaagtaataatagcaaagaaagagaagttgtatcactttagcctaaacacactgtgtaaatttgttgttgtttatttgtagagataagatattagtaacttaaaaatgacctaaaggaatcccgaagagttctacagttcattactcatggcaagtaaaactaaatactcaaccttatgaacttttaaagctgaaaatccaagatacttgtagaatgggaaatggacagagatgatggtttaaattttcagtggcatgtycaagccatgagtgtaggtagaaagccatgctgaatcattatcaatttattggggtagaaatgacacctttaatgttaattttatagctaacatcacaaaataagactgatcatagatatctttgaatctgaatgtgagcctgaggactattttagagaagtatattctacctctatgatggagtttgtgtgaaatattataagactcaaaagtaaacttaaacttttatcctcaaatacagatatttattttaaagagacctttaagaaaattgaatatcaacattcaagactgaagtcaacaaagcattctgtgatacttacaaatgtgaaataagtagttataattaaacttttaattaaaaagctgcctcgtcactatcaaaacattatgcatatcggtaagaaaacagtggtatgaataacatgtccttttacgctacaattatgtgtaaaattacctactgaaattgctctcccattactttgccttctccataaagaagttaagtctagagaccttttagtttgttctggtcttttctctcccttcaggaacttccattagtacacaaccagctaggtatcttcctgttagaaatgaaagtgtgatgggcagtctttagtaccagcttagccagttttccctagtcttaaaatttgattcaggcttagtttgggcttaatttcacagctgcacccaatgattcacatacacacatgaataacttaattctttgaatagttcttagaatgtccatcacgaaaacttaaaaatacattgagaaaacccctaaaacaatatagaatatastttgtactttttgtttatcctctaaccttgtgaccacatggttaatactaatcatggtattattggttgcaaaggaaatgaaaataacagcccacaatattctatataatttatgaaaggttaaggtatcatatatgaaaactgagaactcccccaccccaaacacattttggattttttgcatgtcagtaatgaagttcacttttcaccacctttccagttggaacatataaaatgtrtgacctctaatgcctaatacattaatgatctattgaactaagttaacccttataaagttcatagaagtgaaaatgtggtctagaacaacactgtttgatagaactttctgtgatggaaatgttgcgtatctacactgtgcaacagagtggccactaggcacatgtagccatcaagcctttcaaatgcggcttgtgtgactaaggaactgaattttaaattgtatttaattttaattaaagttaaatagccgcatgtattggattagcagtctaatagacccttcaaacattcaagtaagtgttggaaatggaaggtccattataggaaatctaggaatcttaaattctcaccatcgggtttaaaactctatcattccttcagtatgaayttttccagaagtttcagattttcaaaagataaaactcaaaccaaccaaatcctttagggtgcttttctgtatgaatcatctttctgcaaagaggtgtaagactgtctttattgccaactctgccccctcttctacagacagaactcagtgattagattctgcatttatttaggttrttcgcctaaaaaacctggtttccatactgcaaataaatgacaggaacttttccactagattatcccagacagcasaaatgttctttccaaaagtggagcctggaaccacagccccctcacattgcctgttacatctgtttatgcttatagaagtgacatccacttcgtagacagagaatgccaatttcttgggaaaggacccagaatttggtgatgcttaaaggaaaaaaaagcccttgctgcttaaaattaaaaaatacatagaactgagtattgagtagttacaaaatccttctgaaatgaaaagattttgctcccagagtatatagaatttgtgyacggacttgcctgggttcatattcagccataatcatttactattaatagccaataaagaagcgggtaagttacaaaacctaaaccttagtttttccatyagtgaaatggggctaaaaatagttatgttgggaaaacttgtgaaagactttgaaatgagcaaaagattactgtttgtcctttcaatggaatgctggatgttatctacaggactccggagtgttgtgaaatttacagtcgtctgcaccttacttagactgactttcactaggctattttactactcagtaagctgtagaaacgtttggtaatgtaaatgagttttatctacagaatgcaaatttgttactttacagatacaactggttaccgccctgtaaagcagataataataaacattacatttcagtgctctatagaatagtaagcagatttgcctcttcttgcctctatgtctactcttcacagtctcacgtgaatgggttgcagtatcttgctggggttcccttcctaattaaaagagttataaaaattttgaccaatgttcattttatatttctaccattgtcatgtttttaccttcttgaaaaattattttttaagagttcctgctccctaggctttttggaaggattggtttaaacatctgtattgacagtcatgatcagttttatatcttgcaggaaggtggtaacacttccggtacttgggggtgtaagaggkwgtactgagcctttagaaaagggcggggttcgggggggagtgagctgaaaaactctccctagacaggaaaggtagaagacctcctcatccctttctctttggcagtgagatcttaaggtcaaggtgagtagtaggccaggcgcagtggcttaggtgaaggccacaccagacttgggcctacgtcttggccttccaggtcagcagagtggcctgggacttggatgccttggggtcacggagttaactgcagactcagactaagtggggccccagcagcggtcagccccagaaccaagttccggagccaacacccgaacaggaaggggccttgccccaggccggagaggcccctcgcccacggccgagggggtggggcggcctcgcctcgggccggtgcttttcgcccttccttggccgccagaggctccctctctctccctctcccgggattttgctgccgggctccctctctctgcggccctagagttaatcccatcagccgaggtgaggcacctgttaccccggccttcctcacccccgcggcctctcctccattacaccgcggccgccgaaacggcccggcgtggcgaccgcacgtgggccaaaccccttccccggccggcacccctggccccaggccggcccgagcgtgcgggcgcgtcgctgctcgggccgccgcccgcccgcaatggcgttggggagcgcagcgcgcctcccggggccgcccgccgcgggcagggagcgcctgggggccgacgcgcgagtggaagcggccgccgcagccgccctacgcgctgcgccgtgaggagcgggttgcggtgtacccagcgggccggcgccgagccgagccgccgcgtccaccgtggggcggggggcgcctgcgaggagggggtgggagccgcggcggcccgaccctccccgcccgcggcgctcccgctcgggtaagggggaggctgagcgcggggcgaggagttggggagggtggagaggaggaaaaaatcggcttgtacaaaggctgagttgcaggctgggggtgggggtgggttgtggtggaggagcaataggttgaagatcggaggcattatcagtgggatctattgtttcctggcacattgggaggaaaaacaaagggatttattttcattaccctgtaattttttttcttttctatttttttaaatgtggccagggagctcgtctctctccgtgtcacagtgggatccgcctggcagccgccgggagctgcagccaatgtgttaggacttcaggtgcttcttggcacaaagctagactgcgacctcctaccatagcgcttggcgtcacctgctctcccggtcctgccccagggccgagggattgcgtcccgaaccgggcttgggaatcggctgcctctcaagttggtgttatttatgtttgtcttttgtgagggcaggttttgaatcccccggcggccccatctcccccgcccccgcctccttgggttggaattggcgggggagggaatggggggtgtgtgtaggggagaggggagggtgtttgtggctttaaaaagaatggtcagggtaaaaggagattgtcgatgctttacaaaaaamgaaaaaaacaggcaccacactccaaagcctttcttgtttgtctgcatgggccatgcatgcgtgctgggccaggagccgagtttggagacggtttaagtgaaagtgtgtgcctcctcagctgattgtgcgtgagggtgatgtggctcggtctaatatcaaaacaaaacaaaaataaaatgaaaaatctttagaactgcctgcattgtctgctcctcagcatatcttgaagtatttgattgctggcttattgatataaaatcctgctgtgggcttaaagagaccagcaagcatgcattgcgttgcgtgttgaactgtagtaagttagaggcaagaaagaataaacaaatcagggctgtgaaaaggggtgtcacagtatatttgctttctgattgtcacattcttacgcatttattcccttggtagtctgcatcccactccataattaataataaccactgttaggaaacttccaaatacttgttataactgaacttagtgaaacttattgctattcaggaactttttttctccttgttttgatctgaaattgcattagtattgctttggggatgctgtagatgagaacattggaccaaaaaaagtaaaatatgccgctgtaggcatgttttggagtttgtaaacatagattccaaacttaattgtacttagaaagaataagttctacctaattgtggagaatcctaaatgaagttgattttctggacagtttgatgatttcttaaagatcgatgaactgctggtttctttttaaagggcattcacaaaagygaccaaaacttgggctaaagtattgctttcaaatatacttakgtgtagcttgtatttgtgagtgtgtgtatgtgtttgtgtgtgtgtgagattttgataggtatctccaaattgtgtttggaacttttttttttttttttttaccaaagaccaatcagaatgataacttyttgacttttaacttcccatttcaatgagtartctcttctgtttgccacgtggctaagccatttggaaaaaaaaatgtatgttatttgactagacataaattcaaataagtaaatgaattcagaaattcattcttttctattgcagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaaccyaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagaraaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcartgccaaagtccgaaatcccttcaccacaaagccaactgttagaagatgctgaagctaatttggttggaagggaggcagcaaagcaacagaggaaagaacttgcaggtggtratttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggtaagtgtgttttctccattttgttttctaaatttgtttttagtactagggcctaattgtatgtagaatagacttgacaactagtaggagtttttgtaagggattcaagattgttgatacctttaaaatcacctgttgtcaggtgattttaaaagttcagagtttgagagatatcaattacatttcttaaatgtgctttataatggcatacatcaatagtgagtaatattaaagctgaagaagttcgggaattgtgagatacgttccaatgaactggagtatgagtattgtgagtactgaaaaccaggagtgttagtttgaaatgtaattactttagttttacctaaaattattcataaataatattttctgaatgtacacactttaaggtatgaagtataatgtacaatgggagagttttggtaatctgggaataatattcgatttactttcttaaaaaaatctgagttattaagtgtaagtggattgtgaggaattttgttggaactttttttggggggtactgctagttggtggtgaaaatttaatttatggaaatatattagctgacttaaatactttgaaaagctttgactgtaaacagtctgagttcaaaatttgttacatagctttaaaatgaattttttgaaagaaataacattgatttgccattcatggatttatttttacctcttaaaaactggataaatgccaatggaattcacatgctctaatgacttcacttagttaacatttggtatggaagaatagcacaaagtacatcagcagtgggtggtagaatgttattagtggataatggcaataggggcaggaggtggttggttgagtaccagaatctcctggggtgctttttcaaagtgtacttgcccacagctcagtcytgagatgctggcatgctctccttggggaatctggaaggttatggtggcagaatgtgtagttttagaccacattctaggggcttctagcttacacagtgtgtatatatgrtagacttggaatttgatatattcctgtaaattttctcctcaaaatctaaaatcactgtctgttattttcattttgggaccttccatataaggctctaaaatataaatttacatagaaatatttaaagagaaatctgacattgttctgattatgaaatactattctgaaataaagtaataatctatgaaattatttacagatgttagcaggcagactttcattttattagtgtaaggcagaagttctgggtcagaatgggtcatgttaagttaaactgtagtttaaaataaactacagatgtcaattcagtttgaaagtaagtttctttgcagtgctttaccaccttcctttgtgattatctcctcctgccttcctattcctccccaacccccactgccctactctagatggtctttaaaggtgcctttcccccaagcctatccagtgagctcctaaactttgccattcgcatcccccttgaacatcatctttctaccctttaggragaaagcaataagattaaatcgtttcacattgagaaaggcaggaataactgaaatgaactcttcaaggagttgttaaacccagtgactaactttttaatacaagggatagcagcttatgaaaatttatcaagtagaccactacccagtcaaccaagtgggacaccagcctgtatttgggtcctgtgctgcacaaaacataactgtgcactagttggtttaatggattttaaaggatttatcattgaaatgtgtctgtttatatgtgaacaaaccagctttttgggaatgatattttgaagttcaactaatttgtgctatgattgcttataacaataagtattttgcctcttaattttcatataatgacaattttatctagcaaataatgaaacattacctacatttaatgcatttcatcaagaataagatttctaaaacaaattagatcaagcataagacttgtgaaacaaagataatgtattgcatttgattgggcagttaacaggacttcttggagtggattaagtttgcaaacagaagattcattcttagccctttgtaatgaataacacaattactctttcttgctgcttccattgttaaatatgcaagtggattcacttggaaaatttgagagctgctttctactggtcatggtrgtggccatagtgtttaggttattctccaattaagattttttttgctgcagagggtggtaataccttattagatccaattaaagtatttattgaaggcttatcatgtgtgttctctcatgctgttagctgaagaagacacaaaaatctgtaaggttacccctttcctctgtgagtttgtagagtcaattcttaaacacattgtatttaaaatccataaaaaacagtataaaaaactatgccaaaatttttaatgtcctgtgagtcctttagtggcacttggttgtactaaatgcatatagtgaaagggatttgatagattatttggaaaggaatacatgcaaccattttctatctgtgtttctttattcttttcataaaactttatttatggaatgggaagttgcaattcctaacctcagtcttttcctttgaagcttaaacatacttcctcttaaagaagcaacagggaatgtattctttaaataaatgatttttagaacttttacattcttttcctggctgtcactttattctgtactaggttaaaaattcctagcacctttagttttttgttatagatcttatttatcatctttgtatgtgtaatattgtcctcagtgactacttcagttctttttatagatgttttacatagatatttccataagatgtcttaaatctggacttagaaaaacatcagaataatagttgatctttcctgtgtagcatataccttgtacttgtacatataccttgatttttaaaaatggtcagactgtattgccagccatcagttagtatgactttcctatctttcacagacagttatttcttattagatagattgttatgtttcatagggtcatgaaatattagaatgggattaataatagcaaattaaaatccaactttgagatatggcatgggagaatgttatggaccatgctaattcgagatggaattatgccttcattttcaggaatttttcaaaatgaaaggattgaattaaagtaaatttgtcttagatgaatcaaaacaagagagggtgacatgtcatttttttctactaattcagaacatttatggagcccctaatatgtgtcagggacaatgcaaatataacaaatacaacaaatacataaaatgaggagctgatgaagtaaggagctgctggtcggtgggacgtgtacagcccattaaggaagctctcaggctgttcccaactctgtgctttgatgatctttctaaggttgctgcagcctcattaaggaagtcacaacctttctctgtttcttatgtcctttggattggtatttttttttcccctcaaatactattgtgttacaatggattgttattcttgaaacagcatatctgaaaaagatttttctaactcacagtaagaaggatattgcagagttaatattgaggtacattgtgctatattttgtgttttctcaaatcatatggagctttacaggattagaattcaaataatcagcaagggcaccagagcttcttcaaaccttacatgatagttgttgaaaatggatcttcttgtattctctccctttttgggggctccgagtcatagttagggcattcatggatatatgaagtttttttgttcaggatggttttcagggaatagttctgttgagatccarctttttgtctttgcggaggcttcctttataacagttttgtcagtgcttcttaaactttaatatgcatatgaatcacttgggagatcttgttagcatcaagattctgattcagtaggtattctatgggaaattaccttgatacaatggttgagctacaagtacaccagcaggcaagctatctcagaggttatggaatagaagactcagaaaacaaattaaaatgcttgaatcacatgatttaccaaaccagttaaacacaaatccagaagcaagaggaaagctatggagtaagttaacacacttcargttcaaaccaggttggaaggaccacgctacctgtcctggataaacaatgttcctatgtcccatctttctttcacataacccttccccattaatgatgtggttatgaggaccagagctgatgtttgagccaagactccatagactaatgatttcctgggtcgatgatacacacttgttctgttgaagagatgtgacaaatacacttaggtacagccgtagctttgctagtttgcctgctgatgagccatgggaccatccttggtgtcttcagtagatgactgatatggaagtaatgtagctatcagtccaggcataatggtgacttggtatttccactgctttttgtctataagtaaatctcattcattttatcataatttctatttattttattgttgtcatgtcttactcccagcttacctatttattacgcatctgctgactgccttcatttcaccagcttgcattctcattatcaatacttggcccagcctgagtgttgcctctgtctcataagttgttagtttatttaccatctatgattatcacttcttaagtgtttcatccatcccattagttttgtttacctctataatagaatttcatattctgaaataatacaggaaaaccacgttaacagtatgtctggaggggaaccttagattttacatttctaacaagctctcaagtggtgccgatgccgctgatcaagagatcactctttggaatatgaatttgaagtacaatcttctggcttctgaaagtggctggccatagcatgttagggaagcaacatgtaataaatttcctttccagatgggctgctatatctggttgggtggaataatattctctgaagatgaaataaggtataatcttgtaaagtgcatgaayactctgtttctggatcccaaagtggattattatccttaactcaaggcatttgggtcattaaaaagtcacatcctaggctctttgtgtggtttaagtttttagttataaaaagttgggaggaagaagtttttaatggaatcagaaatttcatttctttcattcttttgcaagtgtaaattaataaacttagtataagaatggtcatatgatttaacttgcttttcttggataactttgatggtacaactttttttttgtttgttttttgttttttgttttttgagagggagctttgctctgtcacccaggttggagtgcagtggcacgatctcagctcactgaaacctccacctcctgggttcaagagattctcaggcctcagccctctgagtagctgggacaacaggcatgcacaactattccagactaatttttatatttttagtagagacagggtttttaccatgttggccaggctagtctcgaactcctgacctcaagtgatctgaccgcgttggcctcccaaagtgctgagattataggcgtgaaccactgtgcccagccgatggtataacatttaaattggatttccttttaaatttttatgttttatgacctrtgcttcataaccaggtaaatgaaatatgtcaaatattttaatatactttgtaaaatcaaataatgaagatttgttgaatgaaccccttttctaaaatccagaggtatagctatacttttaaactgaacagtgatcatttagtgtttaaaaagggattcttttgacagcagattatttcagatgtttactggtatttatttgtaatagaaatatttaaagtttcttgttttttgttaatttaattaattttttttgagacaakgtcttgctctgtcaccctggctgtagtgcagtgatgcagtcatggctcactgcagccctgacctctggggcwcaagtaattctcctgcctcagcctcccatgcagctaggactacaggcaagcgccaccatgcctgttattattttttttttttttgtagagatgaagtctcactatgttgtctaggcttgtcttgaactcctgggttcaagcgaccctcctgccttggcctcccgaagtgctgagattaaaggcatgagccactgtgcccagcagttgcttgctttttggatcatacatactttgtgttccctctaaactttctcacaaatgacactaattgttgggttcatgtacttgaaagataagatgccaaatttggaggaaaatcactttgtgttatgttatccatgtgtcgtttaccttgttaacccagttaatatgcccattacaagtaatttgattgaaatctcatctgcattagatttttttctaacactttctctaccacttgaaaacaagtttaggaattttcatagagaaatatagttagatgtgggataaattctgtataaacaaaacaaacattactatagattgttgctttttatgctgttatctaatttacctgatatttttcttgattttctatgctctcatttggacctattttctttttgttcttttgcttcattatattctatagctatggttttgaaaaggaagaaaacttttcaagttatgctttatagtttttcttctggtcacttttacagttttctcctggttctcatctctttagtttgtgacatagacatttagagatgaaatatacttgaaggtaatctagcgtcatttcccagtcacttcaggaagcccttcagtagcatactcctgacagatgatgtttcagcttctgcttgaataattctaccgatggagrgtttattactttggaaggtaaaaggaaagttagaaggaggggcatgctggtgtgtgtagggaggtggtgcactcactcttctttttatttaattttaatttgcaattttttattaagataaaattcaggtaacaaagttcaccactttgaagtgcacaattcagtggtttttagtatattcacagtgttgtgcagccatcacttttatctgattctagaactttttcatcatcctagaaagagaccctgtgtctgtgaattgtcattcccaattccccttccttcttcatcctctggaaagcagtaattgacttgctttttctgtagacttacttctggacatttcttacaaatgcttttaaaaaagaatataggagacttgaagaagaatataggagtatggcttggaatatattaaatttaagatatcaaaaggatagcacactacaggaaagtctagagagcaatggcataaagaattttcttctggttggtgatatggtctaaaagttaagtggcatgatgtgggagcaacaaatgctatctgccattttatgtgtttcatagagaggaagaacacatgaagctgaggagacagtaggattcaagaagaatgaaatgtataactgaggaagaataggtttatgtggctgagaggatggctgaacaactcccttgcgtgggacaccgcacttctcttaatgtaatctaaaattgctacacatgaagcatgagtgtttgattcagcatagggtttctttatttccttttagagacagggtcttgccctgttgctcaggctggagttcagtggcacgatcaaagctcactgcagccttgaactcctgcgcacaagggatcttcctgccccagcctcccaagtagctgggactacaggtgtgtgccacagtgcctggataattacwttttttttttttttttttgtagattcagggtcttgctatattgtctaggctggtcttgaactcctgggctcaagtgaccctcttgcctcaccctcccaaaatgctgggattgtaggtgtgagccaccatgtcctgccaacatagggtttctttaaaggtacaagtggcattgatgctgagtttcatctttacattggtctttttatagcgtgaaggaatcctgttccttttctaataatctgatgcttatttctatcctacttctcttatattgtcactttccttattcttttactttgattggaattgttcacggacagcttcactactttaaaattttttctcatccttcaatatttcgatatagatttcctgtgcctacatgctattatctgtactgtaaccatctataagatgagtgatttgaagcagatatttatttagtttactatgtattgtctgttggagcatattactatatagtctatattactawtaaatatcattaactagtaataataatggtaacatcgagaggtacttgatattctgtcaggttggacaagtgtgcctcttgaagccttgaatttcttacctgtaattgaggctgtcttacttgtaatttatcactaagattgtttctcggctttaccatcctgtaattctctgtgtcttaaacatatttgtactataccataatcataaatatttgtgctatgatttcaaagagaaaattctggacatcttttgttgaaatatcaaaatgaaaaatttatgttaaattgttcttgagaacaataattctatagattatagtagaaaccttaaaatgagtaaaatattaagtccatgggagcacaattttatagagtggatttttagagcaacttgacttttgaaagtatgggtttaactatatgttaaaacaccctgctgaggaaactaagaataaagaaagaaatgttttgtaatatagttgctgacatattaattgcttcactcacttttgctctggaaatagcttcatagcacagttcaacatgattgaaatattgataatttttttttttttacagttcccggttttcagcctaacttactctttctcatgcacatatccttacaaagaagacagcgaaatacagtatgaagatatcaggaaattttatattttaggaggaaagttttgttctttgcttacttaatctatttcattggtatttttaaaaagtatttgtggagttaaaactgttcaccaagtatttatggataatggtaaatgaaactgctcacagatctgttagtctcctgccctcttttataagtcagatgagttttgtgccggggaaagctaatcttccaagttgttttccatgccagttgaaatatatagggctagattcggacatagagtggttggcaagggtcaaaaaggtgaatagagtcatgaccatgaaggtttctttacaggaataagcagtgagaatcttgcggattaggtctttggtatttctgtcttgatgcctttgaactggcatgaccctatgaaactgagtgacctgcatgttgagtctgttgctgtatagtaagatggtcttttctcttttattcacctcggatttctcctccaaaaatttctttttactcctcctcttttaaaaatatgtaagtatacagcctcatggaggctacattcatatcagaaaattgtctaatcttcaatataacaatcttaaatagtactcacagtcagaggtaccttttcaggcttgtgaagagttttcttttcatggttagggtccacagaggagagggaaaagcaggtttattggttagtttttaagatctgtttttgaggccgggcgcggtggctcacgcctgtaattccaacactttgggaggctgtggcgggcggatcacgaggtcaggaaatcgagaccatcctggcgaacactgtgaaaacccctctctactaaaaatacaaaaaaattagctgggcgtggttgcgggcgcctgtagtcccagctactcgggaggctgaggcaggagaatggcgtgaacccgggaggcggaagttgcagtgagctgagagggcgccactgcactccagcctgggcgacagagctagactccggctcaaaaaaaaaaaaaaagatctgtttttgagtagtgttattttgatggattcctttacgaagtacttgttttgggtaaaattgatgtgcaaaattgttttgtaaaggaagagaaagacataaatttgcacttttcattgttaattgatattatatatgtataaaattattatttttttaaataacccatttctcagggggaaaggcaaaacttattgtaggatgtttgaatgacaccttatctaccattacctagaatgtgtttatttttagaagtttattctgtaggtggaataataaaatacagtaatttaaattatacaccaggtgttatataatattctatgtccagagcatctatttccttttagaaatcttatcattgagcactgagcactaaaacaaacaaacctgtaagtaagtcttttgaaaaataaaggctggctggaagattgaggctgcagtgagctgtgattgagccaccacactccagcctgggcaacagagyaagaccctgtttcaaaaaagaaaaagaagggctgggccygaaatctatgattttcatatctgtattatatacagtttcttgcttagcgtctagaattacctattatttaggatagattcctaaaaawatataattttattaatttataatattatttataattttattaaattatatttaaattaattaaaaataaaattattttaaagccctttatatataattcagaaagggtgaattatattgttattgccggaattgttattcagaaagggtgtattagtttataatcagcactgcattggaatagttttctcacaatccctgcgccagtacttagttttatttatatgctttgtagttttcagtttggtaggtgaaaataactgttataatttctacttgatatattgttgagattgaagattttttatgtgcttataggcttttttgatatgacttctgagtggtttttattactttctaaatcagtgtttgttagtaaagactacatcaatgtgttatttaaatgagttggtaaaagttaaagcaactcacatatccagtaatagggatatggttaaattcattacgataaatgcatatagtataataggataaagctgtattactcatgttttctaagattacttaaagatgtaaatacttcatagtaaaaagtctggttaaatgctgaatatgcatttctgtcatatttttactttaaaaatatgtgtatttgcasctaggacaaagattaaaaacacatacatcaaaatgtcaactctggtaatttctggattgagagaacagtgataatgttaaatgaatgtatacttttctgaatttacttaattttctacaataagcatgtattacttctttaattacattaaaagatagtggtgggacacaattggaatgatcagcaataacaacataaggaagttaacaaaaacactttttaaaatgctgccccaaattctaataattagtcttttaatgtacttttatttggaggacaacatgtcacagaaaaaaaatttggtttaatagtgtaaatttatgtaacactgaagaaggtgttactttaagaaaatggatgaacttttgacagttgaattcattaagtgcatatttcttaaaccttggtaaaattgatcccacatttgtggctaaccttgtaagtattatggggaaggagaccctccaattcattttaaattgtgattatayrgcatttgcataggcctgagatgttttccttaagttcgactattgtgtatatgatattctaatgtgttacttaaaatatgctttcaaacactgggtataatgaatttgaagtgaaacatattttaatgagtagtcttactaaaaataataaacatgtacttaaaggaaacttaaccattttcccatgtggcataatgtctttctgatgtcttagattattgagcctcaacaggcttgctctctgtgaaggtgagacagtggagatgtcaagttcattatcttgcttatatataatcctttgaaaaaactcatgtacacacccagttaaaaataggattttgagttctaggcctccacagaatccatttgaatatgtttcctgtcctaaaacaccagccaatatgtggtttcctgttgttcctcttaaaaaacatattagttgaaaagagattcatttgatgtatggttagactatatggtagtatgttatatttttagttagagtcaaagggtcagttcctctcatctattgggtaattttccacctttgaaaagctttggtagataatgttgtagtatataaatgatgacaaacatatttttgttgggtggcagagttttctgaaattggaagtttaaattattgctttttgtttaatgagatgagcagattactctgatcttacagttttaagcagttctgggattttataagttctggtgaagtcctaattaaattgccttacaatataatctggtgtttggattatcactttttgttaagtattcttaaaccttactacaatatggttgataaattctgttaatattttattgtatactgggtttctagtagtgatatatagatgattgtatataattataagaactatttaaagaaaaagaggcaacattaacagacaaaccatgtaaaattttgactcttttctataaaatggttacactggaaaaagaaaattggagttcaagaaaaaaataatttcactggttgtgattttgcatatttatgtaaatttgtgaatgatttgaggcagtgatatctttttttagttaatcatgtacccaatcaagtttgagacgaggcttatgtttttccatagagactatgacacttgtggaatttttatcttgctggctccttctctgtataacgagttctgtgagtagtagcattagtgaactggagctccctcaggagattgkcccatttgcagatgtggcaatcagaagagttttagtttgagttactgggttttgactcttattacctaatacaattctttatttatttagttttgagatggagtctaactctgactgcattattagcatttttttgagacggagtcttgctctgttgcccaggctggagtgctgtggtgtgatctcagcttactgcaacttccgtctcccgagttcaagcgattctcccacctcagcctcctgagtagctggaattacaggcacgcaccaccatgcctggcttaatttttctttttttmgtagagacggggtttcaccatgttggccaggctggtctcaaactcctgacctcaggtgatctacccacctcggcctcccaaagtgctgggattacaggagtgtgccactgcgtctggcctaccaaacgarattcttactcttaatctagaatgagaactattgagagttcatccattagaacccttgaagcctgtccctcagatggttgaaagtctgtagctggaggacggttgaaataaacagaatattgatatgaaatatttctgaaggtatcctttttccatatcctatatttaacttagctggcatattagagttgtccagagaaacagaaccaataggatgtgtatatatacagagaaaaatgtaaggagttggctcacaggattatggagactggcaagtcaaaaagctgcagggtgggttggcaggctakagattcagggaagagctgacattgcagttcaagtataaaagccttttgctggaaaattttttttttgcttgtgggggagtcagtctgttgtcctattcaggccttcaactgtttcaatgaggcccacccacattatggaaagaaatgagctttcctcaaattatatttaaaaacacccccacagaaacatctagaataatgtttgattagatatctgcgcaccatggcccagccaagttgacttataaaattaaccatcacggtcaagctttcttgttttgattgccccttctgaagctgtttcrgggaggaaactcatttttccccccacatgtcttagtgggggagttggttcctctctccctctcattcttagaaaatttgctgaagggattccctctgttgggcagtgtgttgtaggagaggattatatgtttggaatcagacagacctgtattcagatcctgcagacacctgatcttttaagaaagtttgtttaaattttgagggcagggaatttgttttatggttgtgtctctaggattgtcacaccgcttggcacattgtaggtacacagttggtgttaataacctgttatgttcatcatctctgccctttctccttcctcttctccccctccccccacctgaaggtccaagttgggatgatattaatattattatttttattatatttcgagacaaggtcttactctgttgcctaggctggagtgcagtgacatgatcacagctcactacagcctcgacctctgggctcaagggattctcctgccttaggctcttgagtagctgggattacaggcgtgcgctgccatgcccagctaattttttttccatttttgtagagacagagtctcactgtgtttctcaggctagtctggaactcctgggctcaagcgatcctcccacctcagcctctaaagtgctgggattacaggtgtgggccactgctgggctaacatttttatatgtataatgcttgtatgatttatttataggtaaaatccttcaggttagcagttacaaatgaaagctgggtgattccattacagattaaaatctttcctggccactgctctggcttgctgaagctgttgtgctctctttcgtttgggaaatctcaatctattgccctgtaaggtaatgacagttcataagtaaccacagtcattaaaatatggttgtttgagatataactatggaagctgaaggggagagtactcattttgccttaactttatatttactttgatcaccaaagcttgtaattagttgcaagaaaatctaaaaattgagattccatcagaaagttgtaaagctacttatttagaggttgcagtaacttgcctcacctttggtaacttgagtatgtgagtgtatctatattctgaaaatgaaagttatcaaaaatttaattaactaaaaaatttgaattatttcttttactatttagtctttttgtcttccttttatttcctgacttgtttactaaaatgtggtttcttttgttttttttcagtggttagagaggaattacttttttggggtcatttctgtccccctactcccttaatattgattttagaaatgtgcttggttttaattccatagctaagttataattttgtaattatttttgtagtcggttgtctcattctctaatcaagcttttgctgactgtgaatttgtttatccagaaaacagtttttcattttcttggtgacttgtaattagtaataaattgcatgggaccaaataatccaaggtcttgaaatcgtattttttgcctggatgtttcctccgtgaattacattatctggaaaatgtctgacagttgttattaagctgaaatatgaaatagctttgcttgttcatgcaaatttgtttatgtagaaacaagtttttcctaggcagaaatagcttttgatagcatcctaaggaagagaatggttaagctgttttctgcattttctttttaaatgtacaataattttttgggggggttatgtatgtttttgcagatacgtaaaaaccatgttttgtaaaatgcattgtagacattgaagtagaagaatcttagtattttcagggcccttgataatatcctctttatttaaaaatgtaactataaaagttattgtttttccatttctaaaatgaatttaataaaagcaccttttagcaggatgttggtaagaatatatgacttaatatgaaggttcattatattatttgaatgaattgagctactatgtcagatgtgattttgttactgctgtttttcatcttgagattaatattataacattttataattactatataggcattagtcaaggctgataaatcgcctattattcaagtgtttataaataagtggttatgctacagctatttagagaagcattgtcttctgagttgattgataaaagtcaacaaacattgaatatgtttaaaatgtgttgatttcgagctctgctgtgtagatattgagataaataagacaaaccttttctccttgagactatagactttgaaggagatagagaagtaaacatttgtaggatagtgtgataagtgctgtgatagaggtatatacatagggtgaccatatataatttattgtccaaactgttgagaaattcagtgttctgattattattactgtctttaaaaataagggcacagaccattgtttagtcctctttggatcatgcaatgtctagggtgaccattgggatttattgtcaaaattgggacactttttgagaatgaaaggggatgttatgaatacttacactggggcagcagacataatctggaactgacccagggaagccagtacacatgtcaactttgatatagcagcttgctgtggtgctcctaagcaggggagtctacctttatcaggaggagaggaatcattagggaggacttctcagaggaagtgatgcttgagttgaagctttaaagatgaataagaattaattaggtagagaagtgaaaaatcctaagctgagggaaaagtgtgtttgagaaaagagtaaaccagaacagttggaggaacatgaagggggtgtgtgtgtgtgtagtgtaagaatgtaggcaggtggtagttcaaggagggacttgtatacataggagttggaaatgaaatgcaaactatggggagtcattgaataatttaaagggatagatgacatcatcactttgctatatatacctctcctatttgttggtggttatggaagggtggagaagatccattggtcccccattttttctctctgttctttcagtaaacatttatcctagaagctttcaaccaacttctgtttattcagctttctggattaactgatgtcttccatttgctggataggacatgctgactgatgacctcacagactgttcttatgccctcactactcacctcaccacctacagtcataggctgactaggagttggttgtgtacattcctaaacctttttgccctctttatttgtctttctaagtgtgtattcagtactatgtaaattgataaaacatgagtgtgaaaatatttttttttgctataaaaatgtaaattgaattctttggggaagagctgataaaatatgtcacttaaagatcttgttaaattagatgagggagatatagatgacagaaactctttcaacaaatatctaaaaagatgtgccactccaattattttgtgagtgtcttcaagtttttgtcccactttaaagaaaaccaaactggccatcatagccaatgaattatgcaggaaagatactgtggatcattaatttgcagacctaagctcaaagtaaaggtgttggcctgatgtcaaaagattggtaaatgaatatacttctaggtgtcttacattaatatagacctattaaaatatacatcagtttttatgatttctaactttaactgccattttcaattatcggacaaattcttagtctaaattgcttcttctaagagagcatctttttgtaaaaagtgtctgctttaagctaggcagtatgctaatcacctgaattacatattagaatacatctcccaaggagcttgaattcgcttgggagagacggacacgtaagtcacaatgtactgagagttgcattgcaatagaggtgtgcacaggatgctgtgagtgcggagaggggacacttgggttctggaggcaagttccaggaaactcctgggagaagccaaactctatctgagtttcgaaggtttaataagtgttggtagaaaaagggacaagtgtgcaacctaacagcgaggcacagaaaagagaaaaaaatgctgtcttttgcagatctcagagtatgatttatttataggcaaaatattgttggtacatggtaaggcatgtaccacaaagtttaatattgttggtacatgttaaggcaagggcagattaagaagcttcctttgtgctagacttagtttgcacacttttctgaaaacatactagttggagggggttttgagcatggaaaggcatttttagatttgtatattagaaaaccactctaatagagagtggagatagatagaaaggctaggtgtggggtgggaatgcagcagtcacagtgaacacggatgagactgatgaatgtttgtcagaatggaggctgaaacaggcaaagggtaaactgggcaagctggattaggcagaagatgataagaggtgctattttgtgtgaaattaacttttaagtgcaaaaatcatatgtgactattttttatttatccatgtatttttcctactctccccacaaaggatcttgcctagtgcttggttgataacagatgctcagcaaatgagagctaatgtaggaattaactagacataaacagggaattgattgtctttgatccaatagttgcaaaatacgagggatgaactcataggggccttagagccaaggctgtggatctgagtgttagatccaggtatatatgtcattgggatactgtgaggagaggaaacatgagaataaggggtaagacagcaggagagtgttgggaggcagcatgatgggggagccccacattttggagaaatagagtttgagaaatagcgcttcagagaaagtttggagaaaaagattagaaagattttaagaagcataaaggttgctaaacattttctttctttttttgagatggagtctcactctgtcaccccagctggagtacagtggtgcaatctgagctcactgcaacctctgcctcccaggttcaagcgattctcctgcctcagcctcccaagtagctggcattacaggtgcccccaaacaatgcctggctaatttttgtatttttagtagagacggcgtttcactgtgttggtcaggccagtctccaactcctgacctcaagtgattttgcccgcctcggcctcctaaagtgctgggattacaggcgtgaaccaccatgcccagccctatctttatacttttatagagatgggttggtaggtgaagtaagtaactctgaggaaagccaatggtatatgtggattgagactggggaaagagtactgcacatcaggaaggggaaaggagttacagagatacaaagatagagacttgcatttatttctggtaaagtaggttaacattacctatttagccatttaaaatkagccatttaaaatatgtaatagtaacttagagctgtgcacaaggtcatggcagatttggaatcagagatgaggtcctgaaagaaccagtgctrggcttagctgtcagttttgcaggttaagctagactgttagcgtatccgtacaaaatagttatgaagattaatgttgccttctgtagaatgattttgcctggtcagctggaagtttttctttttttcctttgcagatttttccagctgttgttttgccctctgaagtactgggtctataatgatcttaaagtcttcagagaaatatacatgaatattattcttcatcagcagtagaatgaagtaatttctctttcaatattaatttacactgaaaaaagaagtgctcaccagtaagaggttttatgttcttttctgacggcaggtgaacttcagataatgttctggtaactcctaagttacaggaacgctattgacccaattgacccagttgatttcaagtaatagacttgacagctcattgtaaattaaaatccctttcctattggcccagtgtcgtacagtggtattttgtttccggaaacagatatcatattataaaaatactacaattagtcatgaaaatgaataaagagaacttacagtgtatatttatgcaaatactaggtatactaaccaacatgataataatgtaaatgctccttttagggattttttttctgcatgaattagactgactggattctttcttatttttatttttttgagaaggagttttgctcttgttgcccaggctggagtacaatggtgcaacctcggctcaccgcaacctccacctcccaggtttaagtgattctcctgcctcagcctcctgagtagctgggattataagcatgcgccactacatccggctaatttcgtatttttagtagagacagggtttctccatgttggtcaggctggtctcgaactgccgacctcaggtcatctgccaggcttggcctcccaaagtgctgggattacaggtgtgagccaccgtgcccgactgactgtggattcttaaaatacagtttctatgtgtgtctcagagtgtttggatggtaaatgcaggggagtggctgtttccatggctatttcttcttcagtgaatttttgttgctgagtcttcagtgacctggctctgggtattagcttcacttgaagtaggtaggtgatggaagagtcattagccagttttaaagacaagtttagttttctctgctgttatatagataaattggcaagtggttgtgattgagcctttccaccttaggggtggtcagaaatccattaacttagtattgcccttcttagaaataatggattatgatgatgatgatttttcaaaacagatgagtacttaccagccaaaaggcttttgtgycattatattttgctttatgattttgtaaattgtgtcaaaaagattgaattggtgccagctccatgtttgaattctctaaaaaataagtgctggtttagatgatctatctagataaaacatttcaaacatttattattgaattcttcttaatatgctacataaatagtcagaccccttgtttttgtgaatgttattttgaggtatgtattcagtgtttgctaagtttgttagaattgaggcagagttttggagacccttggagtagagctaattctggaagttaaatttttacctatcttaaaattgagagagtatgtattcatggcatttgaccttgaaattatatgtaggagtggtggagaagggaaaggggtggtggaactcaacatcacgacagttcatgaattaaattaactacctgctctaccaataataagtatgatacatctttttcatatgcctctcttcatttacaaagatggtgctgggcattccaatctacctgaagcattttttttttttttttttggtcaggagaggtaacagggtttgaacccatcttcattccactatgcattctcccgtgtgactgctgtcacatacctgagagacagatggttgggagtgcagtaaatatatgtggaacagagtgaaccagcacaatgtgactaaagatgtgactatatgataaaaagtcaggaatgaattaactttgtctataaataagcacacacagatatagattttctctgacaatttaggcatacacacatctctgcatatatatatwcacatatttagtgtcatatatatgtatatatatgacatatatatacacagcatatttagcgtcctatcatcatgtaggaagatttcagtgctgtaattattaagaacagttacattattgaactacaaagctgaaagaaattctttgggaatgtagtttgccatgattccacttgaaatgtgcaaatttacgaagagattaaggaagataaatgtattatggtttagtttttaaataaggcctgctacttctctggaaagtcagaaatacaaccaaggtgaaattaacatattctgaactatttgcagaaatgctgctgaaacatgtaaagtatcaaagtgcttcttaagtcatgactgaatttaggtagacaggcagagagatcagaatagaatgtgaagtgggaggcattctcctccctctctcaactgtattggagacacagctccagtgtgattaacactgtgaaaaggaggtatactcaattacatgcttctagtgctaaggacgaatggcatctttttacctcagaagaaacaaagcttttgttttgttccaaaatgataatgggacattatcattttgatgatgataataaaatagataacattcaccataccaggcaccaagtaaagggctttatttatgctaattaacttggtccttacaatagctgatcactttttagcagtggaaacccaggcaccaagaacttaagcatggagtccacagcttatgaacagacccagcatgcagcctaggtagtctggcctgagcctgtgtttactgatgtaagagtcaggttttagaataggcccttcatgataagctatcttcttgctctatttttatcccatttggaaaatccctttaatgcttttaattgaatttgaagcagactgccattgaataacgtgatcaaagtaaagaygtatgttctcaatttgggacaaataaaactctaacatttttagtttttttgttaatgttattttatttactagtctttgaaaacttttgtgaaatagttcatatttaacagatgaggaaccagaggcagagtcttaaatccacaaaatgagggtaaagtaagaggtgacccaggaattatttgaatgtagaattttgtttgggcaatattttggcctttttactgtataaaatgcatatgagcagaggagagcactagatcaggggtcagttaatgtgtcttccctgtatcagactcacactgacagttcagaaagtaattgagtcacaacagcacacctgtaacaatttagacatcaaacacttgctttgaacattttgtcctttgtttcatctcctttaatgtgacctttcaagatctctaacatgtggtatgaatttgagagcttctcaacctttattgttgagatctatcctgagttttatcacccaagtattatccctcatgtttatagaacattttttttttttgtcaaaaagatctggcctttgaattcagatcagattcagtgtagttaagaaaatatgtcaaaacaaatatagtcagaaattcacagtacctttgtgttctgtttaggctattagctgagcctttatttaccatttttggtgcttttgttatcgatgttatgttttaaaaatatatacatgtttctggaactayatatatgtctgtgtgtgtatacgtatatgtacacatatatacgtctatatacatatatatgtgtatatatttgatgttaaaagcttttatcaaattgtgtgtgtgtatgtatatacacacatacatgtatatgtacgtatacatacacacacacacacacayatatattttaagagatgtgttgcccaggctggagtacagtggttattcacaggtgtggtcataattcactgaagcttcaaactcctgggctcaagtgatcctactgcaccaagccttcctagtagcttggastacagttgcgctccactgcacccagcttataattttttgattaacarcaattctaagagaatattatgtaatgaagtgtgagaataattagtgcagtggtttgaactttaagacatacgaattttatgttcatgaataatgtacattgtgttttcatacattgtctatggagagtcattttcactgcctgaaattggtcaccttcaattccttctcatctctccgccaaagtatgaaaagaagattgcagggctaagctactacttaaatattattccttttcataacccttcatatagcaccagtgaaccaaggactttgtacagtctagagccaaatgatgacaacatgtggcctatgccaaagataggttttagtagatattagggagcattgtgaaaaaaatggttctgtggttgaatatgtttgggaaacttcataccatgcccccttcttagaaaatcataaagctattaacgtatgcagggcccctgaaagaccacattgttacattttttaaaaagttctcttcttgccttgttttaaatgtgatattatttaacattctgtggcttctggaacacagttggataaaaattattgttgtacagttttaaaaacagaattattcttttgaattgcgtttcataagttcagttcttattgcctttcccacctcaatgattatcccagaaatctgaamattttataataatgaatgtaggcttatgataaagtggtttcaattaacaaaagtattgctgtgataaagtagtttcacctttgagtaaaacttgttgattgcactaagtrgaccatttttgccatttcattctggaaaccagagattgcggattttaaattttcttttaatctcctgaatcagcctggattataacatgctgtattttctgtctcatgataaccatattgctgtaaaatatgagaaaattataaacattgttttgtttaaataattgatagtagtaaagtaaatattttaggctatgtttacatttgtaaaagaagatttgagcagtaatttcatcccttagagaaagcccatttgggtaatcaagtctaaattaaagtaattttcctcaataattaggtttaagtgttgatgtctgggtaccagagaagacaatggacttggagtgtggatacttttagactttcctgtctgtgttttcttagtggtaattatttgttatgggtgatctttttcctctgggcgccagtttcctcttctctaaattgaaaaggttctattagatgatctaagatctgtttgagctcctaaaatcagtcttctttaattctgtatctaaacaataattctagttcttatttctgttttgcccaggaaagcttttaacattaaatcaggcttctgccagtagtagtctttgctctttagcaatactggaggtccagggataaaggacatctctgttttcatcttaccatttactatcttatgtcatgttctgtattccgtattctaaagggacttgagtattgtaaacaggaaaacctgagcaaagattgcatgaaagaaccttttaaggtactttgccttcaagtaatgttaaagttgtttaaacagtgtactaataaaacctttcactaagtatggggagactgtgtaggkggtgtgtgtgtgtgtgtgtgtgtgtgtktttgtgtatatattttttccctccaaaagtgatctaacaacttaaataattaagaattctaaacatactggtgggaaatgttaccaaatggtaaaacattaattctgtaatatgttttgtttagtaaatgaccagtccctggtcattaattgcttccttgactttgggcaagtaatttctctagttgttaaaagactctttagctcttgtatatacttagggtattctgaataaatttatacatattaaagcaaaaataggaggaattttttttgttttatccctctggcttttttcaattggtagtatgacagttgacaggcatgtaagaccattccatgtccatgtattagcatttttaatagctcygtagtataaatgtgccctaacttattattcatcctttctttattgatggatattagattatttccgatgtttttgcttctatgaataatgctgcatcttgatatattttgtgtacatgtctgagtgttgtgggataggctcctagaagtagtgctgctcagagccctttcttgtcctccaagctctccctctcctaagctccctgcaaatccttctagcatgtaatgaaccatattttattgaaagtatgaggctgttcccttcactggaagttcctaggggacacagattgtcatttattcattgttatatcctyagcactgagcacacggtagttaaaaataaatttgaactgaacttgaaacttgaaaatcaatatccaatgttttaattttaaagtcttggcctgtcttttacagacttcttcaatgttgcaataatttttttccctagtataattggatcataacatagatctcctgatggccacagctatcaacatataggtaactcagttctttgcaacttacatttcagaagcttgtcatgacccaattacacaggcgtagtttcttacagaataaatgttttccaagtctcttgagataattctcctaattagaaatcaggggtgagaacctttatgtaatcagcattgtggtagattgaaaagaatacaggttttggagttgatgtttgaaagcatcttctctgtggtattctatagccatttacttaggctgagtttactggtttatgggagatccagttttttcctctgtaaaatgaagatagtattctatattaagatagggcactggaaaggctaatggaggtcttgaatgtgaaatgtttaatgtgggacttggtacaggtacgtacttgtgaaatattagttcccttcccaggtaccatcagagttttcaatcttgaggggagctgggctgacaacatattcactatagttttctatatcagtggggtactctggtagagtagaacaggggtcctcagaccctgggccgtggtctggtaccagtctgtggcctgttagatactgggctgcatagcaggaggtgagtggtgggtgagtgagcattactgcctgagctccttctcttgtcagatgagtggctgcatttgattcttaaaggtgcatgaaccctattgtgaactctgcatgtggagggatctaggttgcaggttccttatgagacctgaaactatcacctgcccctgaattttttgtggaaaaattgtcttccatgaaaccggtcccttatgccaaaaaggttggggagtgctggagtagaaggtcataactgataagtacttcagagattttggacaattactgttcaattttttgccattcagacatacctgatgctttcagaaggttttcttttttttttcttagtatgagtatgttgactgtggcactgctattactaggaaaaaagtgttcctaatttaccagtgttaatcatttcatgttttcattgctagctcttatcttttttttctgtcatcttccttaatgtggtttatttaaaaaatttctttgactggtcctgtttcaaattgaatgattatgctgtwgaaaagatcagaaatggtcctggctctcatctttcttgggcaagccaatttttaaactaatctgtaaatttcattaaaccatgtgaacaaacagtaaaactgctttcaaaagcataagctatcagagatagaatcagttggttctcctctaagttcctttttggggggtagaaactgaaatatgccatgctgtacgtagttstgaggattgaaagagttcttgcagtattttctcatataatcttagacacgtatcgtgatgtggatacgctattcctgtgtttttaaagggagagataaatggtgttttttccctcaaattgtggaagaggatgaatttttataagcaaatatattagtattatttgtttactggtatagagatgctcagccaggaattcattactgtgtgatgaaatgaatctcagtggaggcactgagaaggatgatggatttggaacaagaagatctgggtttgagactcagctctggtgcttactagttgtatgactttgtgtaaatgtcttcccagcctcatttcttcatctaggaaaagggataataatactttttcacagtgttgttttgggaattaaattaatatgtcaagacactttctaaacttaaaagcattattatttacattggcagatacctatattgttgatagatattattatggcagcacttacagcagtgctggtagaaagtgagtctacaataactacttgctgaataaatgaaacagagtaacactgaactggaggaatttgcttcttagcagaagcattcagattacccctttttattttctttcttctgtatgtttcaattcaagaaaataaatattaatccaatatagatttttcatagaggcaaggttttgataataataatgagttgctgagtattccagtggactttatatagtgctttagtcagcaaaacagactaagcatacaaattattcatatcattgaacagtttatgtaacaaatattttttgaacatacactatgtacttagcacttagtgacttaggtgaacattgactgggaggataccatgtgtcccatcccagaagattgtataatgttatgacagggacaagattatatatatatatatrtrtatatatatgtatacatacatgtatatatgtgtacacacacacacacacacacacacacacgtcccaggagattgtatagtgttatgacccaaacttatagacacctaaacacactatctcttcattccttaccttgacctgtgctaatcactgattgcatgctctacaagtaggaggttttatgtcattcacttctatgaccagcacttggtaggcccctaggacataataactgctcagttaatatttgttgagtcatgaatagatgaaagttctgatttagcagtatttctatggaaaagaatttgaaccataataatcatgatggctattattaattaaacccctataatgtgtcatgctctaggctaagtaactttcggacagtaactaatccttttataacatcttgaggaggctgctgttactattcacatttgacatttgaagaattggagtctcagagaggttagataatttgccagtgtcatataaccatctctcatattttttttccatttagcaggatcaagtataatgtagggtgtcctttttctttttcttttaatttttttttaastacagctcattggaacttagcctatttcatccagatgtgtaacatcctccttaatactatttttcttcttattcccagttactctgagaattctttccctttcttcactagatctgtgagccaaagatgatgctaatcatagctcataaacatgagtttggtattaatattatatgtttgtataataaaagaaaaggaaaacatttagccttaaagtaaaataagttggctctgttagcctctagagttcttaaaaataattataagtctcttcrgaatccctctaaatgtcttcatctcctttattgtctttatctgcttaaaactgcttctcttgaaagaccagaatgcaagatcaaaaaatcaaatattatatataatattgatttctggtagattcatagaatttcaaagctggaaacaatcttattttattttttagaataggaaaaatcttttgtaaattagaacacttaaaaaataagttaggacactggaagtcttagggaattaattctgccaaaatacaccttgcccarctcccatctttctgtaagctataaggagttgttcataatgaagaaacagacccctttaggcaacaacaaaatcagagaagagctgaagatttggggaatacattatgcacagttactgtgtgtcttcattttgcagaaagaaaagtatactctacttggtttgatattgtctgtgaaagactaatattttttaaaattcagaagtcgcaggacagacagtaatatagaagagatgaaaataaaatgggagtagagaggggaagaagttaaaagaaaaagcagtggcatttagaagctgttgcagagatcaaacaggacaaacaaggcttagagttagtaacaaatggacaaagcagagatcagttttgccttcaaggggtgctgtgatgagagtatgtgtaagtggtaagacaattgcctaaacctcagtaagatatggaattgtatctttacatgcatctttatccctagtaattacaagattggaattgtatctttatatgcatctttatccctggtaagtggtatctgtacttctgcatatgtgatggtatgattcattgataatttgaacctcttcattgtactctttttaagaagggaagaaagtgtgtttgcatactttagaaaggagtttatctaaatgctcttaaagtatagtttgatatggaaaggtttcaactctcaattaatcagcaactattttttttttttggcctaggctgacccgtttctcaaaattaaaagccactcatatttgggrtctgataaataagtgtttgtgggctggcaagtgtgggaacctaatgtccatttaaatcttgatttttgtataattaagttgtaaattatatatgtcttacaaatgatcttttatgatttgatgatgaaagttggagtcctatttttgaaatagacaagagaatgaaaaaaaaatcattgaatttttagagaaacaatgtagttaatggaaagagcaattggctatgtttttgcatctttgtgaccttaagccaaagtttcttttttggtccttagtttccttacctgaaaagtggaataatttctggcacatatggtttggtacatcacatgaaatatatatatgaagkgcccggttttgtgtctaatatatagtgctgactcagaattttataattcttaatgaggttaggaaaaaaaagaaaaraaatttaatgattaaatatctaaatatcatttctcccacttctctcttctcagtcagaatatatttctccaattcttagtcacttggcctgtcactcagaagccataatagcactaaagtcaattttgctaggctctagagaatttaacctgagcttcaaattagttctccttttgtattctgcagcaggaaacaaccacttcctagacttgggtgggaraataaatattatgaacttgtctaggaataagtcaaccctatcaatgaaaagatcatgattttaactgartaatttaggacagaggttggcaaactatggcccctaggccaaatctagacctctgtttgcttttrtaaataaagktttattgaatacagccatactcatgcctgtaagtattgtctatggctgctttcctactgtaaaggcagagcaagtagttgtctgccttcccagcactttgggaggctgaggcgggtggatcacctgaagtcaggagttcgaggcaagcctggccaacataatgaaaacctgtctcaactaaaaatacaaaaaattagctgggcatggtggcgggcacctgtaatcccagctactcaggaggctgaggcaggggaatcacttgaacctgggaggcagaggttgcagtgagccaagatcgcaccactgcactccagcctgggtgacagagcaagactgtctctcaataaataaataaataaataaataaataaataaataaataaataaataaaagtttgccaactgctgatttagaaaattgtgatcatttctttaggtgaatattcctgacaaactggtttaaaatcatgtttaaatatctgcaaattttctcattaaaaaatcaatctcataactttcaagtgtttgctacaatgattctgggtgagctaaaagatggtctggaattcatagatctcatttcatcattcatggactatttagttattttgggtagaacatgtactgtttactgttcttcatatgttttcttaaaatttcagaagttgtttcaaggttactaaaattgagtaaactgctgattaaaataatttcataagtatttttatttatattatgtagacatctgttttcatctctctgggataaactataggccattaaatatctccccagaggggtatagctttctgtcattattaaagctgagctttctaaatctctcctaaaagattgttggcacatcagttagaatgtaaacaaaggctttctgaaatttcttcctgtaaacaaatgctttatattttcacatggagatttcctagcttgtgccatttaagctctgtagaaatgtttatcagtgaatgaatgagttcaggttcttaggcaataaaatgggggaaaaagtaaggtaatatttactgaaataagtcaactttgattaggtctgttactcagagattttgctttgccttcccaggcaaattttatagctgtctaaaaggagaggtcttgaggaagtcaagcttatgattgcctctaagtcatctactgacatgctttgaactatcaaggttcaaggcagtgtggtagaccttgggagatgggatggagatattatttattatgtttcagatacaaaactaggtctttgttcataatgatatttaaaacaaataaccctcatttctatgcatggaaaatagtgatagcttatgaaagagtttagaaatggatttcttgcagtggagagtgatgttgagaaaatcagtgaaggacaaattgtgacctacattttagcaaaagtaggttatttgttttaaaaatatagtcagttttctaattactgagtttgttattccctttgtttgtaaagtacttacctcatgcyatctgtgtgagtgtcctaccaaacttccaagtccatttcttttttaaaattgatatataatagttgtatacattttgggggtatatgtgatattttgatacatgtatacaatccctagtgatcaaatcagggtaactgagrtatccatcacgttatactttcatctttccttgtgttgggaacattccaattcttctcttctagctattttgaaatatacaataaattattgtttactatagttttccaagcttatgtctgatgacacttcctcattgaatttttcctgccttccctgcccttctactctaacacatatcccctttgatcacctgttctttcagacacctcctatgatatttacataaaataatgctggagtttatcaccagtagtgcttagcaccatgccccttacacactcactaaacatttagcgaagtagtttgtgactatagtagaaatatccacccccccaccccccgattaaaaaaaaaggtcattactatctatgcctgggaagtgagtcatcgttctttagatttgctaatttttacttaagggggaagagggcacctcgtttcttataaaactgtagagttaaactgactaaaagcagagtgatgacctagtgatcagaaccgtttctttgacagatttgttcatttgtggaaatcccaaacccttttcagagcagtttttgtaatcactttttgtggtgtttgttggattctcagaatctttttctcaaaatagtagatgcctggatttgctattccaggtacttctgaaaagaagattttgagagatactgtagaattttaattgcattggaggtaatgcttttcagatgtatatggaaagttagattccaaggattaaaaaaaaatgaaattcttaaacaaattttggattccaagtccagattcaccrgctagttccaatgggtttgaggggatgacgtataatgtctgtgtttgataagactaaaagctttttgaaagtgtgtgatagccaagaggtaaacttttgctcctaaggatctattgattaccttgatttcatctccttacatgagatacgtaccttttagctttcatgggccatgaatataccctgtatatgtttatatgcctgtatatatgatatattcatatatatgtaaataaaaatcaagtatgatagtaaaaggatttgtgttaggtctctcagctcttagaagtttgaataatctcatataagttgcttaacctctggtgcttttctttccttttaaaaatgagggtgattataccttcttaagtgaagtttatgaggcttgttttcatgacatatacaaaagacagggattcttaaggtcaaatgaatacagctagggttaggttatctggataattaaagctgaaagcttggagaaaaaagatttcattgggatggagggacatatattagggagagtatttaaataatttaacttgattcattgtggatgtccgggtcattgaaaaattaccagtctttcattttgttttgtatcaaattgacatgaaaactgtagtcacttcatatttatgcccagttcacaaatatctccttgctgtttagtcacagacaaaagataataatattctattacagtgtatcagttgaaataggctaaatatttatgaatatatgttttgaaattggaagcatgttggaagaaaagaatcaataaagatataaacttgttttgctaaaacaatttgaaccttttaaagattttcttactgatctgattatttgacatgcccaaagcgggatagaaacaaaagaatttgttaagaggcttacttatatacttatgtatagagtttaattcttggattttattttatgagtttgaatattaattttaatatactttactagatcagtaactcacacactattcattctgggaatgtttcatcttcagataactaatatgctaaaaatataagagattccaaaaaagttcaaaattacacatgaaaatgaatctgtagattttaagctttgattagaaagatttgaaaatttattgtgattaaagataagtttaagtacttagataaaacactatggacagatgaaaggaaatctaataggatagcaaatatgtagaacacattggtatttccagcattttatattttagtgtcttcagtttccataggtaccattacttaaataagagtgatttttttttcattctctaaaatggggaatagataaaaatgtgtgaagcaactggtttcttctgtctgatttgggcttctagatgccatgcctggagagtttgtagaagaacatagtattaggacttgccttttttgaagtgtaatttagaagtcaatataactaggaatcttagttggacaatctctactttgttatggaggcactgtgtagagtgagttgcatctagcagtcaggtgaaaatcccatagtcagaatcatggtttagggatataacacagtggccaattttaccttacttttttcaggtcatgtgtctaggtggtctcacttcagttaattttacaggaaattcattaatactcatttgcatattttatttctttttctttagtcagaaaacacttaaaataatttatatattctttccataggatttagcctgtgtatattgactgtcagacttcaggcatacattatttggggatgatggaatacaaagacccacatgattgattatgtaattcaaatttactttctgcgttctgaagataccacttcactgtaccaacaatattttgacttgatcttagttactgtattttaaatgcttgcacaaaatgcaaggtaagggcaagatgtctgtttactgtttgaactgttgtcatcctaagttaaatatgtggatttttggctcattttttgtataactgcattgatctgatgtgtcctacctcagagaactgtgtttatatctttgcatcactttcttatgaattttgcattctattatttgtatccttttattattgttattagtaaatactaaaagcccaatggtcagacattctatctttttaatttttttctttgaggatttggcacagtacttgaatatggttgttacttttaagtgaaagttgttactttatagaaaagtcggcttgcaggccatggagccaggaactgatatgctcaccctctggagctggtcaggtgaagacatatcacccctgcttccagggacagacattggcttgcattgcctgaccatcagtgctggacactcctttatcaagctccagaattgctgcctctggaaacggaatgtagttttgccaccctctcctgaattcctgtggtcctagcttcttctcatccctagcttctgttgaaaatctgtggacccttggattagttggctgggcctatatcctgagcctaagtcctagctacaaggaaggttgagcagagccgtatgtggcattttctacagctacagtgaagagtgagctctgcctcatgaagtaagagattcttcaaacacagaaagtgggttcagatgctgggtactgaacagtgctttctctgggggcagttgctacattcccagagagctgtaaagtgacatgctagaagggacaagaaactttcagaacctgtactaccatagtacaggtgtcacttatgttgagaagagttctagtatatattttgaaaggcagattggtgctaatttatagtttttgctgtgtttaatgttttgagtatatatgatagtgacttagaatttgtaataagtttcatgaaaaaacaaactagaaggtgaaacaataggggaaaatatgtatgctaataacaggtgcaggtcaaaacagtaagatgaaagcttgtttcaaaaatgtagcctcctgataggattgacacttatagccaagtagtcaggtccttttggctggggtttggggaggcctgagtgaaatattgagtctggccatgtgactaagtctgttttattactcaaataatggacccatccacctgatgctcagctctgtatacagtccatctaggtctcctgatgtcgtgttctccttttcccatgccaccttgtaatcccatggtgggttctccttcccaagagcaggtctttcatattcagtatgggtccgtaggaatatattggtatatattataataagtaatgagtgaattaattctaaatttggaacatgatggtcrtgatgaattagaaacctgtcacttagttggtacagtggtggggcaggagcagggagggacaggccaaatgtgcacattagagttatctggcaaactctaaccacttttactttatttaccataatggggtggttttgtttttacattttccctcttcattcctatgttttccccattcccccatcactcccattcctagcagctggaggtttctatttgggtatcctctaagtagctagtggtcatatgcctgatgttggtttgccagtcattgggagggggcagaggggtgtgtaccatgacacattttcccaaagatgctgatgatttagtttccaggctagcctacagaagcttatttaacttattatgtctctgagatatactaaggggtagaaaggaagtatagctagctttcccctctctttccaagttacatggttagtcccaagcataattttgaagtaagtaaaatccatcttttgcatcttgtaacttctctttgtgcatcctggtaatccttttgtcattctcckggcatttatagcatacttgaaacttgggactccatggwctttcagaacttttccaggtttaaacagagagctctggggacaatgtatttcccaagagagagaaaggctaagtactccaattattattattcattttgtgtcaagggtatatatcactacgccaaaaccctggggctaacttgcaacctttatgttccttagaaaactttggccttaacattctggtccaagcatggcctaatgtttttacctttgtttccrttaagcacacctgggataagccagaattttcaaaaagaaattcttaaataccaagggagaatggtaagaaaatactttttaaaactgacaaatgtattacagagctttgcccatttctatccagttttgattagtctaagcagagcaggtttgtgggattttgcctgtgtgtgagcttggctgggcttacatggagstgactcaagggctagcacttgcttttgggagttgaaatgtcagttttctcaaaactctcatatgccttttggtttctacactcacagatttccaccattctcccacacatgcagggaggaggaataggagcaatgaaaggtgaatttcatgaggactattgttgtattaagaagtgtaatactcaaatgtcttgctggtctgacattggaggtatgaagcagggaatgggatacttaggtcaggtcaaggagggcataaaatagggtcctcagaattggatgcaagtgttgtggcccccatataaaacaaaaatgggatttacccaaaatagaaggctactctgacttactttagagactatgaagcctctattgggctagttagcagctcagacagtggtgggaatttatctaagtatgctgagccttttaatgacagtgctatgacaggacacacagctctggaaggcttcctaatggggcaggaacctcacctgggggagggtggggtggtgatggaggaaacaagttagagagcgcctaggggaggtgaatcatagggtgtgatgttgagatagtttgctcctttccactgagtgcttctctactaaggttgtcttctggctagtaaaggaggcattccaaaatggttcatgcttcaaaatgacatgttttctttccccagtaaaacagttcttttttttttttttttgaatggtcactttttttttgaacttttctgcttttcttattttttcagaagcagctattctcaaactttttggtgtcaagacccttttacctaaaaattatgaaggatcccaaaaacactttgtctaggtgaattatatctattgcacaagaagaataagttaggattttatggaaagtaactgtctctactgttttgcctgtttacatatcttcagtaatgtatacctttttcctctcaaaaacttgagataggatgagtgagatttctgtcattcttggaatatgaaatttatatatagtttggtatagttcagagacctgaattgcttagctgggaatagttgactaggccagctctttttttatgttcatttccatgtaagcaggattctgcttctggggtctcttttctgtcatgatgctttatttgctttatttctatgtcacaaactgattttgtcaatttttatagttttatacgtttggtatcatatagggcaagttttctcatcttgttcttcataagagagctcttcttagccctttgttcttctgtgtaatttagaattagcctgtgcaattgctcataaaacatttttctttcagtttgattggaatttcattgaatctgtagattaaatttgagagaatgtttaaaataatgaattttccggtccttggctaagatcatacttttctatctctttgggtcttctttaatatatttattatataattatacaacttttgtttaaaacattttttgctactgttgtggatagtgtcttctttttgtccatgaawtaaaaggcaattaatttaaaaagatcattttttctgagacaaggtctcactttgttacccaggctggaatgyagtggtgcaatcatggctcactgcagcctcaacttcctagacttcagtgatctttccacctcagcctcccctagtagttggggccacaggcatgtgccacctcactgggctaatttttgtacttttggtagagatgaggtttcgccatgttgcccaggctggtctcgaactcttgggctcaagtgatctgcccacctcagcctaccaaagtgctgggattacaggtaatcacctgtatgattaccatgtccagcctgaaaggcaattaatttttgatactaactttcttagaacttctgagttattatcaattttaaaaatttgcctgcagatttcagattttctaaataggtgattgtatagtattccaataatgatagtttatttctttgttagaaaagaaaaaaaaatgcttatacttttgttttttttcttctttgtcttacttggacctcctttaaaatattgaccaaaggtgagggtagtggacatttttgtcttgtttctgattttaatgttaaagattttaatattttattattatatatggcatttggtgttaatttttgttaggtatatttgatcaggttaaggaagttctcttcaattgccatttatttatttgccatgtgttaaaaaattgtgaatggatattgagtttcrttgaacttttaaaatacatctatatagatataatcatataagatttctcctttaatgatattaataggtacttttcatgttaaaccacttgaattcatgggataagtctttgttgtattttatgtttttattcactggctgatcatatttgctaatatttttttcagagttttgcgtcaatggttgtgagtgagatagacccataattttccttcctcctactgtccttctgggttttggtataagggttataccagtctcctagaatgacctgaggaatgttttcacctcttaggttttctgaagcagtttttgtaatactagattggtttgttctttgagtgcttcattcagtttcctctaagaccatttaggacttttttttttttgcattatgagttttaaatttttcattcaacctctttgaagactatagcactctactttaaaaccattttttggagtcrattttggtaaggttatattttctttctttttaaattattattatactttaagttctgggatacatgtgcagaatgtgcaggtttgttacataggtatacatgtgccgtggtggtttgctgcacccatcaacccgtcacctacattagatatttcttctaaggttatccctcccctagcaccccacctccaggccccagtgtgtgatgttcccctccctgtgtccatgtgttctcattgttcaactcccacttatgagtgagaacatgcggtatttggttttctgtccctgtgttagtttgctgagaatgatggtttccagcttcatccatgtccctgcaaaggaaatgaactcatccatttttatggctgcatagtattccatggtgtatatgtggcacattttctttatccagtctatcattgatgggcatttgggttggttccaagyctttgctattgtggacagtgctgcaataaacatacatgtgcatgtgtctttatagtagaatgatttataatatcctttgagtatatacccagtaatgagattgctgagtcaaatggtatttctagttctacatccttgaggaattgccacactgtcttccacaatggttgaagtaatttacacacccaccaacagtgtaaaagtgttcctatttctctacatcctctccagcatctgttgtttcctgactttttaatgattgccattctaactggcatgagatggtatctcattgtggttttgatttgcatttctctaatgaccagtgatgctgagcttttttcataagtttcttggccacataaatgtcttcttttgataattgcctgttcatatccttcacctactttttgatggagttgtctgtttttttttcttgtaaatttgtttaaattccttgtagattctggatattagccctttgtcagatggatagattgcaaaaattttctcccattctgtaggttgcctgttcactctggtgatagttccttttgctgtgcagaagctctttagtttaactggagcccatttgtcaattttggcttttgttgccattgcttttggtgttttagccatgaagtctttgcccatgcctatgtcctgaatcatattgccttggttttcttctagggtttttatgggtttaggtcttacatttaagtctgtaatccatcttgagttaatttttgtatatggtgtaaggaaggggttcagtttcagttttctgcttatggctagccagttttcccaacaccatttattaaataaggtatccattacccattgcttgtttctgtcaggtttgtcaaagatcagatggttgtagatgtgtggcattattgctgaggcttctgttctgttccattggtctatatatctgttttgggtagcagtaccatgctgttttagttactgtagccttgtagtataatttgaagtcaggtagcatgatgcctccagctttgttctttttgcttaggattgtcttgactatatgggctcttttttgcttccatatgaaacttaaagtagttttttctaattctgtgaagaaagtcaatggtagcttcatggggatagcattgaatctgtaaattactttgggcagtatggccattttcatgatattgattcttcctgtccacaagcatgtaatgtttttccatttgtttgtgtcctctcttatttccttgagcagtggtttgtggttctccttgaaaagatccttcacatttcttgtgagttttattcctaggtattttattctctttgtagcagttatgaatggaagttcactcatgatttggctctctgtttgtctattattggtgtwtaggaatgcttgtaattttggcagattgattttttatcctgagactttgctgaagttgcttatcaacttaaggagattttgggctgagacgatggggttttctaaatatataatcatgtcatctgcaaacagagacaatttgacttcctctcttcctatttgaagaccctttatttctttctcttgcctgwttgtcctggccagaacttccaatactatgttgaataggagtggtgagagagggcatccttgtcttgtgctggttttcaaagggaatgcttccagttttgggccattcagtatgatattggctgtgggttttttccttctattttactttttttgttgtttttcttattttgatgcttagctcattaattttcagcctttttttctaacagaagattttaagactaaattttactgcttagctgcatctcgcaagtttttatatttgtatgtttgtcattagttttgtgttttctgatttctattgtttactcctttggccatgaattatttgtaagtattaatttttttactgacagttttttactaatatatttcaaagctctttgttaagtatatataagtttagacttatgtcttcctttataattttaaaagtcattctttccttatgtacttatatgccatttccttatttctacttaagtctatatgttggatgcaaatatagctaaattggctttccttgaaggcctcttttaaagtcttttatttgcaatatttttgtgtccttattttttaagaatgtcttatgaacagcatatcaatagatttcttaaaaattcagacttttaaagataacagggaatttggttcacttagatttattataattattaatatatttgtgattatttttagcattttaatgtaacatttccatttctgttggttttttttttcctcttttttggtgatttttttgagtttttccttctcatttgttttgtcccctccactagcagggagcttagttatttttaaaattgtttattctgttattttaraatatatgtttgtaaatatgcgtgtgtgtgtgtgtgtgtgtgtgtgtrkatatgtatatgtccacatatrtttgtatttatatatgtgtatsttaacaaagtctacagttattcaatattcttactctccttgtgaaccatttaggtcatttttgttattctgcttcttgtgtttacaaaattgctcrtatttagatttttaaaaaaactttctgaatcagataattcttactgtcattaatacaattattatttattttcatttacatacctgtttttcttttcactgtttattcatgtatcatagattttcctctagtattagtttcctttttcctgaagtgtacatcttttaataaaggattattaagccctctcatttttttgtctgaaatcttatgcttactcttaagcaactgtaaatagcacactatctgattcctgttgttcaaaagaaaacataaatagtaagataaacttagtataaaattttacttcttaaaatatctatcaaagtataatgatttgtgtattatctattgctttgttttatccatactcctatactgttcttgcgacatggataatcaagaataacctgtaggagattcagaatctttttttttcctattacaaaattagtccaaaatagttctcctatttctttttattcccactggatagtactttcttgcttgctctaattgctgttctgttctaaaaaaatgtctgaacttgacttgtgttaattttctttagttcccttaactgtctgggcactgaaacgggtatagctattctcaatgcattctcacttgtcacaaatttgttattttgtatggtttagaaaatcagtgcttatttgaagcagaactaggacttaggagttcttcatttgcatatttgtagttgtcacattgtgataacttgaatgactaagtgtcactaaagtctaccagtatcctataagattgcctcattttctgtgtcagtcttgatagagactttggggccagtattgttagagttggggaagtttaggtcttctgtgcccctgttgtaggatgagagttcctgtcttgctttctgtgtttggttacctgccttcatgattacctggacaactttaactgggatctcgctatctgctgccaggtttgcctgcctacttgcctacctgccagcctgtacctgtgacagtgttgctcactctgtcctgttgcctgacactacgttctccagttactgctggcccctagcttggttggatttttttcatcagtgatgctggttggacagacttccaaggaaaacatttctgtaggcatgtttaattttctcagacagcccattttgttggtagttgaacccttggctctaaagtaccggtgagcatttcagaaaggacacaagctttcaagagaaaattagctgcaattaagaaccttctttttattgtaaacatattgagtgttaatattctttggttctagtttatttctaaacaaaaacctgygtgccatagaagtagaattttagatcttttattttctatgtaaaggttgatttcttaactttattcatgttgaatttcatattattctatttaatttatctaaacaaatggattattttcctacagtactgaaatactacctcattgatttatttcattttctggttgttacctggtgattaatttctgtaaatcagcagaagtaataggactatactgtaatatcattgtactgtagtcatagatacttggaaagctgaggtaggaagatagcttgagctcaggagttggaggctggcttaggagttgaaggctgcagkgagctatgattgcgctactgcactccagcctgggcaacagggtgagaccttgtctcctaaggaaaaaaaagtggtatgtagagatggtcagctccccgaaggcaaatcttattattatttttaatttcacagttactggctcagtgcctacccatagtgcatagtcagtcttccattaatgttttgaatagaaatcaaccagatgagctagcattaaagtttggattcmgaattttcatttatcaattgcagaaatataggtaattataagataactgcatmctgaagtaatttatatccagatataaatgtacgtgatcagtttgatcagttttccttttcacaaataaagtgttaaacatcaaagtggtttttagtataaatgggacttatgaaatggcagagttctctgccataatttcacatcttattttggaacaagtggaagatttgtttccttgtgttctttattttaaagctacactacagttttatcggttaataatagacttattcttaaggcactgcatcagatagttgaagggaagacatagtttttgcctcagtcactcatgtgctgtacagtttaaagccatgggacagcctggacttcagtctagctgcttgggtgtcatgcttgacaggggttaaaacttgaagttccttatctcttaaacatttttatgtttctgagttcaatcctgttaagattaytgacaacattcttggaagactgtgtcctaaggaaggaagaattttgaaaataaatgattttgctagatagaatgggagaaaagaaattcttggagtacatatgggaggatgaaagtcagaattttagggagttatcaggaagcaaaagtaagtgtgactagattggcagttatggttagaactgggttccaaagcttagggaagggagatgattttaattccttttccaaatgctgactgttacctttgaaattataggatttgggagcaaacgttcatcttttaacaaaagaaagaatctgtattattattctttctgttgatttcatggagatatacaatgcctagctttggaggagttaaaaattggtgcctgagatatcctacttagcccactttactgtacracccctttcttcacacttctttttgtaggaacgacaggaatagtaggcagtaagccatactaactaaagcaattttaattgtttttctacctttgactaactagttatgagaaagcaactatatatttgagaggcctgctgtcatgatttctgggtagaaatttcataagcagctttctaatctactcatttttagattagaaagtggcttagtggtaaggtactagtgttagacccttattctttattaatcattaatcagtttcaaatgtggattataagtgccctttgaggacaagacatactttgtattttgtgtgcaaaaaaagcctaaaatgtggttgttggtctcagtagatccagcacttgcctagaacttaataaaactagttaaattttgtgaatgatttgccggaaggagtttgtgtatggatagtttctcacctccaaaccacttgcctaaatatcacttccttggagacctcccctgttctgcagtttaaattggcttctcaggctctatcatatcactctttttatttccagagtgtaacttatcattacttgatgtttcttcttcatttatttttctcatattagaacttataggttccaggatagtagagcccttgtctatctcattcacctctttatccccagtgcctaggccactgcctagcacaaggcaggtacagaaaaaatattcaccaagtgaatgggtacattttcttactctcaccttcttttttcttttttgcttacttttatttgttagagttattatgttgttatttgttagagttattatgggaataaataataggtgtgccctaaaaaataatgaacagccttatcaaatcagggctctgaggtaaatacagtttcattaagtcatcagcaatgttaaattaagctttgagattgtattcgctctcttgttacattgattatatatttattttcattcattaaaaattgtaacttgggtaaaatcccagactgtataaacaattcctttttaaaatggatttggttattttcaaagaaaagatacattttctgtattaatgcttaaatttccytaagagcttttatgataattaagcttaaaataccaaagatggatatggttacatattttgctgatttcaaagtttggagaatagttaatgaacaactactagaaagttaatagaaatagttaatggacaaccacttgaatgtaggaataaaattttcatttatatccaaactaaatccagcatatgataatggaaggacaactcttgacttagtttggatgtaaatgaaaaagcacaaaatgttgcaagattagtatttcattttgcctatggaaagaatcatttacttagatttatcaagttacttagttactcggtatttaataactacctatagttggaggattctatgaattcagattctataaaagaaatagtcacttctaaaacctgtcattaaatttgctttatttaatgtgatgtgtttggtgttttctgagcaatagtggttgtggacataaaaaaatgaaaagattattttgattttaaaaattaatattaaatttattaatgttacagattcaaacacctagttttatctttggcttctaagttctgtttataaaacacattattcttgttataagtatatcaaattttaaacatttaagggtttttgaatgatacttagtcatttataaatttaaccacattaaaccatttaaaactctatacatttaatatatttgatttttaattacttttctgagaattgaaaaaattttatgcatgtcacaaattaaacttacaaatatagtgactgtaatgttctcttaaatatgtcaatactatgtttagtgctartaagatttctacttataatcacaagtctcaatcagttattcaatttttaattttaatcagaactacaaggaattattgtcctgtcactctaataggtcatattctcttataagttacacatacttaaaatatgattggttttgttattataaaatgttaacagtatgaatttgattctcctaaatatttcatattttaaatctcctcagargtatattatcccaagcaattttctcaattatttgargctgcgtgaagaatttgagcaagatgttcatcagatttttgttagttcatttaagatatatcaaactttatttattgataacaggcatgtaaaaattaatttctgcttcaccatgtggtctatacccctattctattcatttgtagaatgttgtctgtaatacttgattggattttctatttctttggctgttaagataattaaataccttttcaccaagctttaaagatccttgaactatatggacttctttctctctctctctttttttttttttttcttcatgttcttcctatctggcagaagcacagaaatcttactgttattaaaatatctgattgaattctggcactctcttaagactgttcagttataacttacaagatgattctactgatcctaagtaaaactgatcagtgaaatcttttagtcctttgacccttcttccagctttgtgtgtgtcctctatgctgagggagggagggggaaataagagttctcttaaaaagtacactgatactaatcctatagtgtcctttatgttataaatgatagtctgtgttcctttcagttgaggtcaaaataaaatgaagagaaagctcctgaaaccctttttgaaagtaggggtagaaaaaggaaataacactaaatgcctacaccttagcagatgttttgcatagactatttaatttaaattgatttcattcttaccataaacccccaggtaagtaatattaatccctcataaagtttatttacacataaggagactgttattcagtaaagttaacaacttttcaggggtcataaaactattaagcaaaggagccaaaatttgaatctagatgtgtttattttttttaaatccagatctcttttttttaatccagatctccttcgtcagaagataaatgacaataaaattaaaattgtgttcatttaaaagatgtttcttgtggctatgtttcttttcatttgcttgttttccctgcagatgtatttaatagaaaagcaaagttccaatgtgctttctaaatcatccctattggttttgtagacccatttattggcagggaagatacatgttctatagagctggcatctgcttgcaggtttctatagcctttcctctatgtaaattagtttgaataggtaaaggggagaattgagtagtgatatgatgtatttagtctggaaggaaaattgtaaattcactaacttcctgactcttttaaatgttctcttctccttcctctgctttataagaaaacaagactggttaataaaaaaaacaaaacttataaataaatgacacatttgcyttaaaagggaaacttgaacyttaatgaggggtggtttattttttcagataacttgggtgtcttttggttgtattgaatgttttgtgcttttcaaaatcatatcatgaataataatattagtattattctaataacccagtaggttgagtatactaggtattattcccatttcattaataagtaaataaaaaaaactgatagcctgagtcatygggccggacaaattcagagccaaaaatctataatattttaagcaaaaggttatgtttgaaagactgtgaggttccttatatgtataaaattggatagatttaggagttctatctggttatctttataggaagtttaagtattcagagttaaggttatttttagaaatgactgggtgcccttttgcaaaaactgttttgaactatttatatgaattgtagtatcaaatagtgccaaatttggatacaaatrtccttttaggcagcaaagtactatttaaagtatgaattaaagtatttggaaaatgttygcccttatcgtttaacacattcatgttttactcgtgaattaagcacaaatcgtagaacagatttgtattggtacagccaatgtatttgagtggagcccaagtattgatatgtcagagggtggtcattttgcyttatttttttaatcaatattgttgactattttataaatatttcaatgcctactatgtgcctaaaagtattctatgagaaatgtattgaatctactttttgaatcttcaytgggtttcgggatagaaactttagagtcaaatgaattttctgggattcactgtacatcaactaatcccctagtcttaatttaaatcttttcaacatcaggagtgacaggtttttttgttgcaggtcacctgtgaatgggtcctttatatagaatgagactttaaaaaatatttgtttatgtctaatccatcctcacattaactcatggtatgtttctgggtagtttgttgtctccaaattttataaaccacaaaaatgtgytgctgctgagatgtcagtaattaattatttttataaataatcttttgtcaactctggtgccttagctgttcttaggtttttaaagaatatcctgataaagcaaagttctcatatattattatattggattgtcagttgaaattagtggtttttttaattaagaaaaagccactcagaattttgtaaaatattgtaaaatattcaagggttttccccatgttgtgaatgtatgacatatgactctaaattggatttctttaacctctttctcataaaaaaaatctcacttttctgttaaaggaatgcagaagttattccttataaggaaaacatcaggagttctatttataagcgtatagtattcaatcaaaaaactcatgttgaaaattcagataaatagctagcaaaatcacacattaaaaaatacattgaaatgatgtatgtgtaatctaaaaaaaattaatatacgtgaaatgcagtgaattccaccttaattttgggcttgatcttgggagtctgagtgactacagtgtcattgacttgagcatgaaaggactaagtatattcctgctggagtcaagctcgcatattaacacagctccctttgaatttctgtatctgtgggttttggtgtaggcagaagacttgccacagaataacaggataattcacagtagaactttcctttcctggatttgcttcctgttcatacatgctttatcagtaaaatgacttacttttaaatacatgaagtcacagaattgaaaattcaaaatagaaattgcttaaatacagcaaaaaaatctagttattcaagatacttggggaatcaggcatttgggtttatgaaaccacatagccataaaatataaacaaacaattctcaaaatattaaaatatatttaatatggaaacttctttgaataagtagtttttgtgtaaatgtgacattttaggaatttgaaatgaattttgggtttaccagttatgccacacttaacttggattggtgaagcatggaaatgaaaaccctttcttaatgagactttctaaattttaatatgatggataactcaattttaaagtatagtttctattttttatagcagctttattgagatataattcayataccataaaatttttagtatacttgcagaattggtcagccacaatcaattttagaaatttccatcaccccatccctggctcacattagccacaggcagctgctaatcatatgtttttttctggattggcttgttctgtacattttatgtaaatagaatcatataatatgtggtcttctgtgtcttctacctttcacctaacaatgttttcatccatgttgtagtgtataccaatatttagttcctttttgtagtcaaataatattcattgcatggatatacatgttgagtttcccttttcagaaatgcgtgggaccagaatgttttggatttttgattttttgaagttttgaatatttgcaatactttatgtattaggcaagcctttgtgacatattcaacaatatctttacaccagatagtagagaataagcagaaaaaccacaatragtgatgcacataggtcttggcctcatgtgggggcattgtggggaacctggcattggcatatcccattggcatatccacctgcacatgtgccattttattaccctttgtctgagtgtttgtgtaggagaataagggcatgtaggaaaatatatattccaactgaagagggttggaggggtcttttttcccttggggacactgactaaattgtttattgtgcgcctgtgttctgaatgcaacttgtcacaagaagtcaggtgtggaattttccatttatggagttatatttgtgctcaaaatgttttgaatttctgggttagggttgcccaaactgtaccatattttatttatccatttatcagttgagagacatttgggtagtttcctcattttggctgttattaataatgctgctgtaaacattcatgtggaaatttttgcagggacataggctttcttttttttagataattatctgggagtgtatggttaatatttgaaagattaattttacttttttaaatttatactttaagttctgggatacatgtgcagaatgtgcagtttacataggtatacatgtgccatggtggtttgctgcacccatcaacctgtcatctacattaggtatttctcctaatgctatccctcgcctaaatccccaccygctgacaggccctggtgtgtgatgttcccctccctgtgtccatgtgatctcattgttcaactccaaattatgaatgagaacatgtggtgtttggttttctgttcctgtcgtagtttgctgtaaatgatggtttccagcttcatccatgtccctgcaaaggacatgaacttatcctttttatggctgcatagtattccatggtatatatgtgccacaatttctctatccagtctgtcattgatgggcrtttgggttggttccaagtctttgctattgtgaacattgctgtaataaacatacgtgtgcatgtgtctttttagtagaatgatttgagtatatacccagtaatgggattgctgagtcaaatggtatttctagttctagatccttgaggaatcaccacaatgtctttcacagtggttgaactaacttacactcccaccaacagtgtaaaagtgttcctrtttctccacatcctctccagcatctgctgtttcctgactttttaataattgccattctaactagcatgagatggtatctcattgtggttttcatttgtatttctctaatgagcagtgatgatgagcttatgtttgttggctgcaaaaatatcttcttttgaaaagtgtctgttcatattctttgcccacttcttggtggggttgtttgtttttttttcttgtaaatttgtttaagttctttgtagattctggatattagccctttgttagatggatagattgcaaaaattttctcccattctataggttgcctgttcactctggtaatagtttcttttgctgtgcagaagctctttaatttaattaggtctcatttatcaattttggctttcattgctattgcttttggtgttttagtcatgaagtctttgcccatacctatgtcttggatggtactgcctagattttcttctagggtttttatggttttaggtcttatgtttaagtctgtaatccatcttgaattaatttttgtatatggtttaagtaaggggtccagtttcagttttctgcttatggctagccagttttcccaacaccgtttattaaatagggaatccattacccattgcttgtttttgtcaggtttgtcaaggatcagatggttgtatgtgtggcattatttccgaggcctctgttctgttccattggtctatatatytgttttgggtagcagtaccatgctgttttggttactgtagccttgtagtatagtttgaagtcaggtaacatgatgcctctagctttgttctttttgcttaggattgtcttggctatatgggcttttttttttgtttcatgtaaaattaaagtagtttttttctaattctgtgaagaaagtcaatggtagcttgatggggatggcattgaatctataaattactttgggcagtatggccattttcacaatgttgattcttcctatccatgagtatggaatgtttttccatttgtttgtgtcctctyttatttccttgagcagtggtttgtagttctccttgaagaggtccttcacattcctttaagttgtattcgtaggtagtttattctctttgtagcaattgtgaatgtgagttcacgtattatttggctctctgtttgtctcttattggtgtataggaatgcttgtgatttttgcacattgatttttttatcctgagattttgctgaaattgcttatcagcttaaggagattttgggctgagaccctggggtttctaaatatacaacatatacagtcatgtcatctgcaaacagagacaatttgacttcctctcttcctgtgtgaatacctttatttctttctgccctggccagaacttccaatactgtgttgaataggagtggtgagagagggcatccttgtcttgtgctggttttcaaagggaatgcttccaatttttggccattgattatgatattgactgtgggtttgtcataaaaaactcttcttattttgagatacattccatcaatgcttagtttactgaatttttagcatgaaggggtgttgaattttattgaaggccttttctgcatctattgagataatcatgtggtttttgtcattggttctgtttatgtgatggattacgtttattaatttgcctgtgttgaaccagccttgcatcccagggatgaagctgacttgatcatggaggataggctttttaatgtgctgctggatttggtttgccagtgttttattgaggattttcgtattgatgttcttcaggaatattggcctgaaatgttctttttttattgtgtccctgcagggttttggtatcaggatgatgctggcctcataaaatgagtttgggaggagtccctctttttctgttgtttgaaatagtttcagcaggaatggttactgctcctctttgtacctttggtagcatttggctgtgaattcgtctggtcctgggctttttttcgttggtaggctattaattactgcctcaatttagaactggttattgatctattcagggattcgaattcttcctggtttagacttgggagagtgtatatgttcaggaatttatccatttcttactagagtttctagtttatttgcatagaggtgtttatagtattctctgrtggtagtttgtatttctgtgggagatcagtggtgatatcccccttatcatttttgttgtgtctatttgtatcttatccctttttttctttattagtctggctagtggtctattttgttgatcttttcaaaaaagcagctcctggattcattgatttttttttgaagggtttttcatgtctctgtctccttcatttctgctctgatcttaggtatttcttgtcttctgctagcttttgaatttgtttgctcttgcttctctagttcttttaattgtgatgttagagtatcaattttagatctttcctgctttctcttgtgggcatttagtgctataaatttttctctaaacactgctttagctgtgtcccagagattctggtacatttgtgtctttgttctcattggtttcaaagaacttatttatttatactttaattttgttacttacccagtagtcattcaggagcaggttgttcagtttccatgtagttgcgtggttttgagtgagtttctttttttttgttttgaggtggagtcttgctctgttgccaggctggagtgcagtggtgcgatcctggctcagtgcaagctcttgagtgagtttcttaatcctgaattctaatttgattgcactgtggtctgggagactgtttgttgtgatttccattcttttacattttttgaggagtgttttacttccaattatgtggtcaattttagaataagtgcaatgtggttctgagaagaatgtatattctgttgatttggggtggagagttctgtagatgcctattaggtcaacttggtccagagctgagttcaagtcctgaatatccttgttaattttctgtcttgtttatctgtcaaatactgactgtgaagtgttcaagtctcccactattattgtgtgggagtctaaatctcttcgtaggtctctaagaacttgctttatgaatctgggtgctcctgtagtgggtgcatgtgtttttaggatagttagctcttcttgtcgcattgatccctataccattatgtaatgcccttctttgtctcttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttrtatttttagtagagacggggtttcaccgttttagccgggatggtctcgatctcctgacctcgtgatccacccgcctcggcctcccaaagtgctgggattacaggcgtgagcgtctcttttgatctttgttggtttaaagtctgttttatcagagactaggattgcaacccctgctttttttttgctttccgtttgcctggtaaatattcttccatctctttattttgagcctatgtgtgtcttagcacataagatcggtctcctgaatacagcacaccgatgagtcttgactccatccaatttgccagtctgtgtcttttaattgtggcatataacttgtttacatttaaggttaagaagttctcctggataatatcctaaagagtgttttccagcttggttccattctccctgtcactttcaggtacactaatcaaatgtaggtttggtcttttcacatagccccatatttcttggaggctttgtttgttccttttgattcttttttctctaatcttgtcttcatgctttatttcattaagttgatcttcaatcttggatacgctttcttctgcttgatcgattcggctattgatacttgtgtatgcttcacgaagttctcgtgctgtgttttttagctccatcaggtcatttatgttcctctctaaactggttattctagttagcaatwcatctaaccttttttcaaagttcttagcttctttgcattgggttagaacatgctcctttagcttggaggagtttgttattacccatgttctgaagcctacttctgtcaattcgtcaaactcattctccatccagttttgttcccttactggcaaagagttgtgatgatcctttggaggagaagaggcattctggtttttggaattttcagcctttttgtgctggtttttcctcatctttgtggatttatctacctttgtgttttcatgttgacctttggatggggtttctgtgtggacgtcctttttgttaatattgatgctattcctttctgattgttagttttccttctaacagtcaggcccccctgctgcaggtctgctggggtttgctgcaggtctaccycagagcctgtttgcctgggtattaccagtggaggctgtcaaacagcaaagattgctgcctgttcctgcctctggaagctttgtctcagtggggcaccttccagatgccagtcagatctctcctgtatgaggtatctgtcgacccctgctgggaggtgtctcccaatcaggaggtacaggggtcagcaacscacttgaggaggcaatctgatgcttagcagagcttaagcactgtgctgggagactccctgctctcttcagagctggcaggcaggagtgtktaagtctgctgaagctgcgcccagagccaccctttcccccaggtgctctgtcccaaggagatgggagttttatctataagcctctgactggggctgctgcctttcttttggagatgccctgcccagagaggaggaatgtagagagtcagtctggctattgtgcctttgctgagctgtgttgggccccacccagttcgacctttctggtggctttgtttacactgtgagggggagaaccgcctactcaagcctcagtaatggtcgacacccctgcccccaccaagctggggtgtcccaggtcgacttcatactgctgtgctggcaacgagagtttcaagccagtgggtcttagcttggtgggctccatgggggtgggatccactgagctagactgcttggctccctgccttcagccccctttccagggagtgaacggttctgtctcacaggcattccaggtgccactggggtatgaaaaaacactccagcagctagcttggtgtctgcccaaacggccatccagttttgtgcttgaaacccaaggccctggtggcataggcaccaaagggaaactcctggtctgcagattgcaaagaccatgggaaaagtatagtatctgggctggagtgaaccgttcctcactccacagtccctcacggcttcacttggctagtggagggagttccctgaccccttgcacttaccgggagaggcaatgccccaacctgctttggctcatgccccaccctgctttgtctcactgtctgtgggctgtacccactctctaaccagtcccaatgagatgagctgcgtacctcggttagaaatgtagaaatcacccatcttctgtgttgaccttgttgggaactgcagactggagctgttcctatttgaccatcttgccagccacctttttttttttttttttttttgagatagagtctctctctgttgcccaggctggagtgcagtggtgcgatttcagcatattgcaacctccgcctcctgggttcaagcgattcttctgcctcagtctcctcagtagctgggactacttaattttacattgttaagagtaaacagggttctgtattctgtatataaagaactgacataaggaagcatccttgagtagtggaaatgggttttctaaccatggctttagtatttaaatcttctgtacctctaatttcttacatagtaagtggaagttcaacaactggaagatctctgtggtctttagcgtcctcaccctctctctatgctttctcrttcagcaaacatttgtcaagtgtctactctgtggcagaatttgtgtaagaacttggggatagtctgtcttcagatgagctcagagtctagtaggagagaggggaaagggacaaaagagaaaaaaaagcaatacttgtaagtcaaccgttagaagccagtgtggtgagtgcctcaagagtgataatcacttagtggtggaccactgaggagcctcccactgggggtcagggtgcagtgggggaggtctaggaagatttcttggtagaaatcacatttaagtaatcctcaggtagtcagccaagtgtattaatgggcaaatggcattttatgacaaaagctacttggtaatcatttcatgcttgaaattttggataaatgaattgctaaagatgaccaagcaagaaaagactgcaacgctttttttctttattacccatggccagatttcctagttattttctcattgcaaaagaatgtgaaacaaactgattaagtgtaaaataactcttaactcttatttagactatcrtagtcatcttcaaaactctttgagatcatcttgagaattcacagttttctattctttttgttgctagcaggtgaaattatgtacctttggaaccctctgtatgggtcagtctgtggtactcacagtagtctttatataggagtgtttgcatgtgattgcaggtcagcggagaagcaaacaaagcaataaccaaaaaaggtgtgctgaaagttgctgtttcaactcatagacatagtaatctagttgaagtattttaacaatctcttcagtgctattcagaagacaaatacattgaactttgttaatctattgagattttcaggatttttaaattggttaggatataagaattctttcttcctaagtttttccctttgctttcatagtcatttcctttaaaacctgatttaaagctttgtgttgaagaaggcttccatcattacaaactctccttatgcaatttatttacatacttcagtacaacttattacccagtttgtattctcataatgagttgattctaaattaaaatacagagatatttctgttatggccatgatgacccaggcacacatagaaggtggctgtgggatgtgaataataatgcctaattttaattcataaaagcagttgtctgttttttcatacaaccttggtattgtactgtacttattactggtcttttgtactgtgtatatatggtcttgttatttttattaggtagtttatctaagttttagttctagttatgtaagtggataagattcacattgattttgactttcatgatttattacattaatgcaaatcaaacattgaccagagagaaaagcaacaacctttcttagatgaaacaatgcattcctaacttatgctgttaggaccaattttttttttttttccctgcaaatgtgacaggcttcttgttctctagcagtgacctctaccttggccctgactcagctggtatgatggttctttgtgcaaatattttctcaaccttcaatttgtcacaagtagctaagcattatccygtgaataatagatttatgattttgctagcattagcacagtgactaggatactaacttattccagctgtgtttcctgggtttgagttttcttcccaggaactggcctttctgagcaagaagagaatgaatggccgattaagtagatttgcagtaggtgtacactggcagcctagaggaagattaatctgaagacaggttgagagcacctggaacattttaggatttagrtgatctgactattaagtgttgccaagtcatgggacctggtaactaccatgttactgatggggagactggatcttagagagttagaggatcttgtcaaaaagtcatcccattctaaatttaatacactcttactgaatccaagtttcatgttctttccattccataacagttataaagaccaatggaatgaatagattcttaatggtaaggaaataatgacttcctggacacaatatatttttaaaaaccggaagtagaaattacttcgtacttttccaggatgtttcagtcatttaaaacaatgctgagatttcacttccttcacttttttgctttatgagattttgtcccttgtcttaaatactgtgaaaacaagaaacctccacaaaatattgaagcaagaaatatatctaccacatcataaaaataatgtgtttttatattttggttattgtttactaagttattttctaccttaggttataaactagagttgaaaagggctgaactgcttatttttaaaaagtgatttaataagattattgtttaggagatgtagagagaatgataggctaaaaaaatgccttgaattgtaatgatgtcatgtgttgagaaccaaaaagcgagtttgggacttaagcattcccttgaagaatagatggataagaaaaaaagtgaacgttatagattttggagagttgaactgttggtggtggagaatgacagactaaaatgaatatagtaagtgagataggaattagcatgttgaatgaacatttgtaatcagagtagataattcataggggacaagagagagatagggattagatagtgtcagaattaggaagatgacctttatttatggtatataagtcaagttatagaacagagaaaacaaaagtggtgttttagaaattttattttttttctttctttctttttttttttttttgagaaaatgtctcgctctattgcccaggctggagtgcagtggcacaatcatagctcactgttgcctcaacctcaaggctcaagtgatctttccatctcagcctcccaagtagctggaattacaggcgcatgctgtcacatccagctaattttttatttttcgtagagacagggtctcattatgttgcctaggctggtctcagactactgagctcaagcaatccttccacttcagcctccctaagtgctaggattgcaggcatgagccactatgcctgacctcagaaattttaatttgaggaaatgtagacaccatttaggaaattgattgtggttttaggatcctgcactctggcaacaatagtaggctttgagagatgaaggatgtgatattggatgaactgcatgagttaaggatgaatctgagatagaggttctgaaacttgagtgtgtattaggatcgcctaaggagcttggtaaggttctgattttggcaggttgggtaagaggacagaaattgcatttttaaaggcagtctcggcatttctgatgtaaatggtaaacaagttcctagccagagacaccaggataatcatagatagagaaatggaaattaggagaatagttttataagatgaaatggtaagtttagttttggataagttgagtgttatctttatatattgcaatgagtttgatgacaggacatccaaatggaacgagctgtccaataaaaatagatctttgtgttggattgtagtgtgagagtggatgatgtatcagaggaaggtgttggaaaaagaacaagagcatgtccttttcttctgattaattcatctaagaaacactggggcagtgatgggtctctttagttacgtcaggtcaacacagtttcattcttgtttctcttctaaaaaaacattgacgcttcttgttttattttcttaactcctgggaaacgtacataaatgtctttgccacagtcaagctggtcttgactggataacagcattttcaatcactaaagtcagctatttgagttgttcagtagaggcacattaaaataactcataaataagtcaagacaagttatagagaagagaaagttatagagaagagaaaacagaaatggtgttttaatttgaggaaatatagacaccatacaggaaattgattgtagttttaagatcctgggctctggtaagcagtaatagaatttgagaggaaagtttatagtatctgatatgtccctatatataaatgattcttaatccatatttttcaggacccttagggagcttttcagataagtttagctagcatttttaaattattgaaaaaatgaactcttctcttaatttggaaaaaaaatactgtgttgcagtctttagaagaatcttagtatataacatactctggtctcaaaatcaaataagcagtgacattgtgctataacctaaaaattgatatgaatcactgtgataaaggaagtttactctagtttattcatagatgaagaaaagtagcctggtagcttgaagctgttyttttagctttgctgcagatttataaaatgttcaacatttccatttacctctggacaggctgtagttttttttkttttttttttkttttttttttttttaaggattaagatccttgaagctagaggtctttgaaactgcatctgagtggaagaggtctagtgtaaagtgactcattcttaaacatattcagaaatgctgtgggccaaattgaatcccttgaaatataacctgtatacacagtttccagaacatgagctagttgtgtttcagaagtttatgtgtaagacagctgtttggaactcagaacacattttttttttccttattgaagcagtacaaaaattactggctatgttcccaggccagttcacaaatatttttcacccaaatgtactttaagtattaactgtacaatttccatttattgagttgatatttttgtttctgtgggaaaatatatcccaaatcagtttgaaagaaataggttatctttgcttagctggattggggtcttctcagaagatgtcactggtcattcataaaaaccagtaatttattaattgtacatttttaaccccttcctctcaattataaaggtacaatttcaggttattcattcccctagtgattactattttagaaagtagccccggtttctctgtcttcctctttctttactttctcttttctctctaaatgttgggtcattattaagtttatgtctctatatcagggattgtgtgttcaggtttggttacaaaatggttagtgctcctgtawtttttttagccagcattgattaacagagttaatcactttctgtctttaaaagagactgataagggcttatgatataaagtttatttgggaaattatctgttatctgtcaagtatggtgatgactggtattgtacaggacagaaaactaaaatacctactaaattattaataacataaaataatacaaaaattattacggcattgtttattatgttggattttagttctttggtgagtcatgcataatacattatctgttatatttaacatgttttattcttttttttttttttttgagatgaagtctcgctctgtcacccaggctggagtgcagtggtgtgatctcggcccactgcacctctgactcckgggttcaggcgattctcctgcctcagcctcccgagtagctgagactataggcatgtgccaccacgtctggctaattttttrtatttttagtggagacggggtttcagtgtgttagccaggatggtctcgatctcctgacctcgtgatccacctatctcagcctaacatgttttattcttaatgcatattttgttttgactggttgtggttggtgaatatatgtgttcattaaataaaagaggttctttttagcagggagtaaggctgttttaacttcagcctcagggaatgttttactttgatgggatggctgttattttgaatggaatcaaggatctggaatcttttatttattaatcattcactctacatgtatttattgagtatctgcttggtgtcaggctctattctaggtattggggatactacagtgaccaaaacagacatggtcccttctttatgtaggttatattcttgctggggatctagagaataaatgagaattgaataagtaagtgtgtgttgmgatatattgggaaggtagatccaacttggctaacagattggctatggtatatgagagtaaaggatatcagccaggtttttggtctaaacagctagaatcctgtaattgcctttccctacagtggggaagactgaaggatatgggggcttgtgggagtaagaggggatcaaggatatggtttttacatattaaacttgaggtgcctgttagacattcaaattgaggtgttcgaaaggcagtttaggggagatgtctgggttgaagagaaatttggcagttgtcactagagagtgaatataggaaaagaagagattcgagtcacaagccccagagctctccattattgaggggctgggaagacaaggaatcagcaaagtagaccaagaagagcaactgtgaccatcaagaatagctgaggtagatggttccccaaaagccaagttaagaaacatgtttcaagaaaatggggtgatcagttttgttaaatgttgctgatggttcgactaagatgagaattgaccattgagcaacattgaagacattggtaatctttgaatggagtcattttcatggagaggtgggacaaaagcttgaatggggtgagttcaggagagaatttagaggagataattaaattgaagattaacaagtcagactgtttatcaatctgtagacaattgacaatgagttcctgagaggatggttgggatatgaggccaaatcaggggatatagagaatgttatggtgataagaggctaggtggtgaaggatgacttgggtatcttggtcttctttttcattttcttttttttttttttttgaaatggaatcttgctctgtcacccaggctggagttcagtggcrtgatctcggctcactgcaaccactgcctcccaggttcaagcgattcttctgcctcagcctcctgagtagctgggactacaggcrcgtgccaccatgcccggctaatttttgtatttttagtagagatgggatttcaccatattggccaggctggtcttgaatccctgacctcatgatccacccgcctcggcctcccaaagtgctgggattacaggcgtgagccaccatgcccggcccatcttgggcttcttgtggtgactgatatgaaggggataaagtgagtgtttagctccagtgtcttcaaagtagattgtgatgcaaagcctgtgaacgttgagggatagggaatggggagtggcataattctcctaggccataaagtgatttcttataagatacctagctaaggaataatctaggagagtaaattgtttcagtttacctgagattgaattgtaccaaaaagccaaattatggctatctactaaatatagagcctgcatgtttttaattgatttatgattatagagtagactaaatttttatgtgacatgtaaatggctactgaaagaataaatgcttgaaagactgaataaatattacagattctccttcagtaaagttatgaaagcctgataaataattctaggcatgatagtatttttcctaaaaacttactccttttcttggaggctgcttaaaaattttacattgccaattcatttctcgacacttttttctatcttgatcttttttttgtgggctgcattcattttcattcagtggtttcttcgctgagtgcttttcccaaaataaacaccagtcatatttagaatgaaataatgacctagtgtaagtattctgaatactgtttcaacttttcaacatttctgaaaattctagactgatttattttccagaatccatttaatttagatgttcagagtagtgcttcttcttaaaacatcaacagtttttgttttgttttgtgagacacggtctcgctctgttgcgcaggctggagtgcagtggcgtgatctcagctcactacaaccttcgcctcctgggttcaagctattctcctgcctcagcctcccgagtagctaggattacaggcatgtgccaccaggcccagctaatttttgtatttttggtaaagatggggttttgccatgttggccaggctggtctcgaactgctgacctcaagtgattcctccgccttggccccacaaagtgctgggattataggcatgagctaccatgtccagccaacatcaacatttgtagtgatagaatttgagttgtttagatcaagtttatggtgctttctgggcaaattctgaagggagagacagttggtttactattagagtttacttgtttgagcaaactcttttattttgttaatcagatttgtcatatatttgtagtgccagattacatttttagtttttctgcaataaattgtattaaattcagtttattaatagccaggtatatcctgtatatctccattagtgagtctttataggagagtgtagctgttaatcagtgctgtctctgtgaattttcttggagatctctcaatgggatttgtggtttgagtgtatcacccttaggtttttacaaaagataataagcactaatgttaaatgctacttagcaaatggatgcaaagctttgacagtaattttaggttatttctagatagtgtggacttaaaaaaagytttttagaaagctgttttcagttgacttagagttacttgtaatctgttattatcaaggtcaccccatggaagatctctgaatacccaatgaggcaagtgtcattattacctcttaattttctccaggggaaacaccaaattctgtggtggcttaggtgaaggagtaaggctctttactcagcttttgtttttaattgtaactgtgcagatgtctcmtatgtcctatggccagttatttaaaatagtgaaagccaaatgctagtttggtggtgtgcaggcataactcaattatctgacaagagaaaaagaatggttgagtatatgttactttggttgacaatgttaaaggtatttttttttggttttggggtacctttttagtatttacctgtaaggattgaaatattaagtcagaaaattcataatacttgtgaattggtataattgtctagactaatgcttcttttaccattggcgtaattgtctagattgatgcttgttcttaaaatttggccacaactctacactctaagctggggtgtccaatcttttggcttccctgggtcacactggaagaagaatcgccttgggccacacatgaaatatactaacaatagctgatgagctaaaaaaaaaaaaaaaaaaatcacagaaaatctcataatgtttaagaaagtttacgaatttgtgttgggccgctttcaaagccaccctgggcctcatgcggcccgtgggccacaggttggacaagcttgctctaagcagtgcattggcacatttatgtgcgtgtgtgtgtattaatattgtattaatattacagttatatatataaaataaaagtttcatgaaatagtacttacttttacattgtacagtacattctaatacttttctagctgtttataaaatattcagtttttgagacagggtctcactctgtcgctcaggctagagtgtggtgacgcaacctcctgggctcaggtaatcctctcacctcagcctcccaagtagctgggactacaggcgcatgctaccatgcccagtttagtgtttttttttttttttagaaaaagttggacatgagctaaattgatttcataacccttactgagtcataacttgctttttgaaaaatcctggcctaccttatctctgaggtgccgcacaactatggagtatgttactgtgacagtgtacataaaaataacttctttgatctgggttcttatgagaaggataaaaatattgaatattactcaaagcccactgaccataagaaagtgatctctaccatcagataattttaaaaatgcatatagaagagtcatatatttgtataactaatctttgttgagtggcatctgtgtgccacgctctgaacttaccactgcctatttgaaggtgaacaaacaggccgtccttatctccaggaatttcagtgtagtggaagagataataagcaagtgaataaatatttgtaaattgctgtgcagctgtgctagagaataatgggagatggttgcttgctcacagtttttcatcatctcatttgtatctagcttaaagaagaaaatgtgagctagaagcttaggtttttggtctcagatgtcacattctttctgttgagtagggtacccttgttcccataaaccttcttaggcagggggcccagtgtacttatttatttattttttttgagacacagtctcactctgtcgcccaggctgtagtgcagtggcaagatctcgatctcggctcactgcaacctctgtctctcaggttcaagcaattctcctgcctcagcctcctgaattgctgagactacaggagtgcgctaccgcagccggctaatttttgtatttttagtacagatggggtttcaccatgttggccaggctggtctcaaactcctgacctctgatgagcctgcctcagcctcccaaagtgttgggtttacaggcatgagccactgtgcctggcctacgttttttttaaaaaaaacttattattacagataattatcttgtgggcatmttttcaccttgtattacagataattttcttttcaacctccagctggtgttattttcaggtgaagtcttcatcttaggctattatacatacatatgtacatatattctaatacaattttgtatttcttgtcttttcacactagtgtccatattttcatagcagtcatgaagcaaaattgaggttgttacaagttgctgtgattattacagagaagagtttctttttttaatttaatttaattttttttaattatactttaagttctagggtacctgtgcacaaygtgcaggtttgttgcatatgtatacacgtgccatgttggtttgccgcacccattaactcatcatttacattaggtatttctcctaatgctatccctcccccaaccccccaccccactacaggcctcagtgtgtgatgttccccgccctgtgcccaagagttctcatcgttcaattcccayctatgagcaagaacatgcagtgtttggttttccatccttgctatagtttgctcagaatgatggtttccagcttcatccatgtccctacaaaggacatgaactcatcattttttatggctgcatagtattccatggtgtatatgtgacacattttcttaatccagtctatcattgatggacatttgggttggttccaagtctttgctattgtgaatagtgccacagtaaacataggtgtgcatgtgtctttatagtagtatgatttataattctttgggtatatacccagtaatgggatcactgggtcaaatggtatttctagttctagatccttgaggaattgccacactgtcttccacaatggttgaactactttacagtcccacccacaatgtaaaagtgttcccrtttctccacatcctctccagcacccgttgtttcctgactttttaatgatcgccattctaactggcatgagatggtatctcattgtggttttgatttgcatttctctgatgaccagtgatgatgagcattttttcatgtgtctgttggctgcataaatgtcttcttttgaaaagtgtctgttcatatcctttgcccactttttgatggggttgtttgattttttcttgtaaatttgtttgagttctttgtagattctggatattagccctttgtcagatgagtagattgcaaaaattttctcccattctgtaggttgcctgttcactctgatggtagtttcttttgctgtgcagaagctcttcagtttaattagatcccattttggcttttgttgccattgcttttggtgttttagtcatgaagtccttgcccatgcttatgtcctgaatgggtattgcctaggttttcttctagggtttttatggttttaggtctaacatttaagtctttaatccatcttgaattaatttttgtataaggtataaggaaaggatccagtttcagctttctacatatggctagccagtttccccagcaacatttattaaatagggaattcctatttaataaattcctcattgcttgtttttgtcaaatttgtcaaagatcagatggttgtagatgtgtggtgttatttctgagggctctgttctgttctattggtctatatctctgtttttgtaccagtaccatgctgttttggttactgtagccttgtagtatagtttgaagtcaggtaacttgatgcctccagcattgttctttttgcttaggattgtcttggccatttgggctcttttttggttccatatgaactttaaagtagttttttccaattctgtgaagaaagtcattggtagcttgatggggatggcattgaatctataaattaccttgagcagtatggccattttcatgatactgattyttcctatccatgagcatggaatattcttcaatttgtttgtgtcatcttttatttcattgagcagtggtttgtagttctccttgaagaggtcgttcacatcccttgtaagttgtattcctgggtattttattctctttgtagcaattgtgaatgagggtacactcatgatttggctctctgtctgtctgttattggtgtataagaatgcttgtgatttttgcacattgattttgtatcctgcgactttgctgaagttgcttatcagcctaaggagattttgggctgagatgatgggattttctaaatatacaatcatgtcatctgcaaacagggacagtttgacttcctcgtttcctaatcgaataccttttatttctttctcttgcctgatttccctggccagaacttccaacactrtgttgaataggagtggtgagagagggcatccctgtcttgtgccagttttcaaagggaatgctttcagtttttgcccattcagtatgatactggctgtgggtttgtcataaatagctcttattattttgagataggttccatcaatacctagtttattgagagtttttagcatgaaggsctgttgaattttatcgaaggccttttttgcatctattgagataatcatgtggtttttgtctttggttctgtttacatgctggattacatttattgatttgcgtatgttgaaccagccttgcatcccagggatgaagcccacttgatcttagtggataagctttttgatgtgctgctggattcggtttgccaatattttattgaggatttttgcatcaatgttcgtcagggatattggtctaaaattctctttttttgctgtgtctctgccaggctttggtatcagggtgatgyttgcctcataaaatgagttagggagaattctctctttttctattgattggaatagtttcaaaaggaatgggaccagctcctttctgtacctctgatagaatttggctgtgaatccatctggtctcggagtttttttggttggtaggctcttaattattgcctcaatttcagagcctgttattggtctattcagagattcagcttcttccttgtttagtcttgggagggtgtatgtgtccaggaatttatccatttcttccagatttcctaatttatttgcatagaggtgtttatagtattctctgatggtagtttgtatttccttgagatcggtggtgatatcccctttatcattttttattgcatctatttgattcttctctctttccttctttattagtcttggtagtggtctatcaattttgttgatcttttcaaaaaagcagctcctggattcattgatttttttgaagggttttttgtgtctctatctccttcagttcttttctgatcttagttatttcttgccttctgctaacttttgaatttgtttgctcttgcttctctagttcttttaattgtgatgttagggtgtcaatttttgatctttcctgctttctcttgtgggcatttagtgctgtaaatttccttctacgcactgttttaaatatgtcccagaaattctggtatgttgtgtcttcgttctcattggtttcaaagtacatctttatttctgccttcattttgttatttacccagtcgtcattcaggagcagattgttcagtttccatgtagttgtgcagttttgagtgagtttcttaaccctgagttctagtttgattgcactgtggtctgagagacagtttattatttctgttcttttacatttgctgaggagtgctttactatgtggtcaattttggaataagtgcaatgtgatgctgagaataatgtatattttgttgatttggggtggagagttctgtagatgtctattaggtctgcttggtgcagagctgagttcaagtcctggatatccttgttaaccttccgtctcgttgatctgtctaatattcacagtggggtattaaagtctcccattattattgtgtgggagtgtaagtctctttttagatctctcaggacttaccttatgaatctgggtgctcctgtattggatgcatatatatttaggatacttagctcttcttgttgaattgatccctttaccattatgtgatggacttctttgtttcttttgatctttgttggtttaaaatctgttttatcagagactgggattgcaactcctgcttttattttyttttgctttccatttgcttggtacatcttcctccgtccctttattttgagcctgtgtgtgtctctgcacgtgagataggtcttagaggagagtttcttatgattgagggcacttgccccaattcttctctattactctataaaaaaatggaatcataaaattttctttcagattgttaaatattcttcaacttaattttaatagctaatggcaattgccatgtatggatggatatgagaaagttttcagaaaaatgagatatttatcttgaggaagatttggctgktgggaggaggagacataatagcttttttcagatattcagtgtaagtgagtttgcacaagttttaaaatctttggaagctaacttgatatcagcaagcaaaaaatataatggagaaaattttgatggttggggaaagtttgtagcactggttttggtgaataatatgttaggtaggttctttcaaggttgtgttatacttttaccactaccattattttctttttagttaaacttgcatttccattgctcaaattctagaagaacctgttctgttgtctcttccttttccaatattcttgtccacttgacttcatgctctcttataataaaattattaaaattattgttacatggattaaaatattgacattcagaaatagattcatgcttctctgcaacatggatgaacctggaggacattatactaagtgaactaagtcaggcacagaaagataaatactgtgttctcactcatatatrggagctaaaacatgagcggatagaggtagagagtagaattgtggttattagaggctaggagaggttggttaacagatacaaaattatagctagaagagaggaataaattccagtgttgtacagcaatgtaggatgattatgggtaacagtaatttagtgtatattttcaaaaagctagaagattttgaatgttcacagcacaaaatgataaatgtttgaggtgctgcatatcttaattatccagatttaatcattatacactggatacacaggcattgaaatagcacactgtattccatgaatatgtacaattattatgtgtcaattaaaaagaaaagggaaaaagaaatagatttatgattttgacttttgaatagactatatacttttaaaaagctgctgctgcttctagttttaggtaactttgttttgtcttttttattataagawtggcttatgccagatctttaatgttgtaaaagtatccattgctcaccagccatataggagctggccagtagggtttgggcagcagcctttggtgtggagctgttctcttgtcggggtatggattgggccacttttctcttataattgataacatgaactatccagttccttggtgatctcaaagtaagagaccagtgaagtttaggaataaaaataaaatgtttgcaaatggtcagaaattgataaaatatcaaccagaggagaacattgtgtggttgacaaagtagggaatatttgtcgttttcaaacctttttctcttttaaacctagctttggctgtggctctgctgtttatgtcacataaagtaattcattctgttgtgtcctattcagcagataagcagcgtctcaaaatttatttaaaagaaaaaattgtaaatttagtgaaactgcaaatatggttgaagatttagaaattaaatcctattaagaaaacagtatcttaactatatagataaagtaatactccttttgcatcaagtgtgatagtaggagaggaggtatttcttccagtaaaaatcaagatgtattcrtatcctttgagctagtaagcctacttctcatagtgtattctatgtaaataattcaaaaggatgaaagttctctgtagcgttatttaaactagtgaacagtcacatacccttaccctaaaagtgacacattttaggtatcttccctgaatgctattttatgcaaccattgaaagggatatttatgaaattatttatagtggtatgggacatgtaaaaatgttttataaaatgcaatttgtacactattatgtatgagccattttttaactttaaaaagatgttctcttcttttgaaaacatgtttagaatagttgttagcttatttgctaacttactattattgttttttctcaattcctccttatcttattacatacatttgagatgttattcagatttccagctttattctctttgtaaaatattaactgtcatttgaagtacagttcttgtcatgttttgcattgtaagtcacttaatattctaacttaaaggtgataaaacacatcctactgtgtataagttttatttatttgattaaaaaaatagttaacacagtaaatacttggaattggatcagaggttcattaccctggacacttgtgggctaaaggcctaggaatttttcatctgtttccagatgggaaactctgcctgctgatgtttggtctttattacaattaaaataccagaaaattttgttagaaggagatattgggaatatgaagacataacccaaatatgtgtatattacarttctggaggaaatacctcagttaaaacaaaacaaaaatcaagaatattaaaagtcttttataatttgacaatagatcctccatatcttctcatattctggtgcttattttacatatttgtaacttaagtatttaagaagagacctttccaatttattaaraattattggataagacaccagctcaacagtttagtaagttttttttgttttagtaatgtttccaagtggtgacactgtgtgtatttaagtaattagtgaattggagggatgagccaatttccagcagatctgattagatctgaaaactaggctaaataattcctagtgagtatagaaacagaatttgagtgtctgaattatgtaggtatttacttctgttacattttcttaacctttattgaaaacagtggaaaagtgaaatgagaaacgtctactttctaaaaaaatgaaaataagaagttatgagtcaaaatatatgttgagagtaaaccattctgtaggtgyaaagtaggcagagtttcagctttagaatagatgtaatacaaatacatatacatatacttatactgtttcatatcctaacatcctggattgataacctgcctcccaccccataatttagcctgattttttttttcagtccttagctgttcaggagttttaaaatttgcattaaatcttttaggttattttactcccatgtaaaactactgattaaatttggtgaaccctttgactttacaacagaaaacaatcaaaatagttaactctaaaacaatggttatcacagttttgaggactcttttagtccagtagctttcagattttagcttgcatcagaattacctggaagtttggttagaaaagtaggtctaaatgtagcctgagaatgtgcatttctaacaagtttccaggtgatgttaatgaggctggttttagaaccatatgtgaaaaaaaaccccactgacttagggtttcaaagagatgtaaaattaacactcttatctagatacaaatratgagttatctaagtattgaacacattttgaagattttatttaagtcattaatgatggaactagtcagatattataaacagttcaaagaagcacaaatttatgtggagtaaaggatattgaactaaatttccaagtggtcagcaaactgactttctattgggggtagtcagttgaacctccatgggacagaattttcttgcatgtctccagactagaataatttacattgctctcagttatctacagcagttaatcaacaatttgagttgcagtatagctcgaagtcaatgaaaagctagaattagaaaacgtggaaggttttgtaccacaaagtccatattttttcatcttgagtgcactgtcatcttttttctcattcccaatttccttacagtggctttttaccaaactcctcaggtgattctgatgcagtctgaagtttgagaaccatcggcttaatgtaacagacaaaatatttagtatatttgtaatacttatttactaaatcatgttttcttatacaacttatttcttatacarattatttcatacgtagccagttcattatttgaaaaatcaaggtcagattgcccctgttagctgatattttaacctcttgattgcctataaaggaattaaatatgcatttatataataaagtagttgtgaagtttttgaacataattagaaaaaagactctttgttgatcgagtayaaaatgtgcttcatgaagcgtttgattagttaaaatatgaaaaattttagttgaagagcttttaatagggcttatctttagtcagtcattttatacataataaaatgcctctcacaattctgaaaggacctagcgaatttaagaagctgggtgatgtaatataaagagccctggatttaggaggtcagtcttagtttattccctttttgtagctagtaagttatttaatttgtaattcacaatggtggtgagggcataaagataaatgcatcacagctcttgtgatgacataagtgcttgctttctggatttcagttttctcatgtgcaaaataaggattatagagccaaatgagacccaaggttgtcttaagcactaacattatgtgatactttgaatattrcacagtggaaaacattaaacaagtgtgtgctaaatcggagttgttcaccatttctctctcatttttcttttttttaacttttaaaactgacacgtaataattgtgtatatttattgagtacataatgatgttgcatatcagggtaattagcatatccatcacctcaaatatttatcatttctttgtgttgggaatgtttaatatcctctttctagctatatgaaactatgtattattgttaaatgtattcattttacaatactatagaacactagaatttactcttcttatctagctgtaattttgtattctttaacaaatctctccctttcccttccttgtgcttccccttcttagcatctagtattttctgttctactttacttctatgagatcaacatttttttagcttcctcatatgaatgagacatgtggtrtttaactttctgtttttggcttattttacttaacataatgtccrccagttccatccttgttattgcaaattacaggatttccttcttttttatggctgaatagtactccattgtgtataaatacaccacattttctttatctctgttgtcggacacctgatttaatttcatatcttggctattgtgaatagtgctgtagtaagtaagtatagggttgcaggtgtctctgcaatatactgatttcttttcctttggaaaaatgccccagcaatggtagttctatttgtagttttttgagaaacttccatactgttcttcatagtggctgtactagtttccattcccaccaatagtgtatgagttcccttatctccccattcttgctagcatttgctatgtcttgtctttttgataatagccattttagaatgagataatacctaattgttttgatttgtaattccctgatgattagtgatgttgagcattttttcctaaattggttggcaatttgtttgtcttttttagggaaatgtctgttcagaccatttgcccatttttaaattggatcacttgcctttttgtttgtttttctgtttgagtttcttgtatattctggatattaatctcctgtcagatgaatagtttgaaaatattttttcttattcaacatgttatctcttcactctgttgattgtttcctttactgtgctgaggctttttagtttaatatagtcccatttgtttgtgtttgttgcctatgcttttgggagtctgattggtaatagttcttcttttcttaatctttattttttctttcctttttattttcaccactctttatatttttttagtttttaaatttttgagacagagtctcgctctgtcacccagggctggagtgcagtggcgtggtcatggctcaccgcagccttgactttctgggctccagtgatcctcccacttcagccttccgagtagctgggaacacaggttcacaccaagacacccagctaacttctgtacttttggcagagatgaggtttcgccatgttgcccctgctgttcttgaactcctgagctcaaacgatccacccgccttggccttccaaagtgttgggattacaggcgtgggccagtgcacccggcctgttgtcaccactcttattcaaagtttctccttttaaaattgctttattgaggtatagttgacatccaatgtactgcacgtatttaaagtatactatttggtaagtttaaacataatgtataccctatgtgatcatcatagcaatgaggaaaatgaatgtcacaccccaaagttttctttgagtccttctataatcttcccttcccccacttcagacaactactgatacgcttcctgtcataatagactagtttgcattttctaggattgtatataaatggaagtacagagtatgtactcttttttaaatccagcctttttgttcagcataattgtccatgttgtgcaagtatcaatactttctaacttcttgttgctagctaggattcttttttttatggctgtrccacaattcatttgtttgttcgcctgatgacagatgtgggaattgttttcagttttgggtattacaaatagagctgctatgaacagatgtatacaaattttaatataaacatgcacttttcttttgggtaatcacctaggagtggatcgtattgtaggtgtatgtttacttttaaagaaactgccaaactgtttttcaaagtgattgtaccatttttatattcccactaatagtatgtgaacattcaatttcctttacatccatgccagcacttgggctgggcagtctttttaaattttagccattgtaatagatatgtagtagaatgttactgtggtttcaatttagatttctctaatggctaatgattttgcatctttttattgcctttttttgcaatcatatgtgtatcttattttgtgaaaaatttgcttaaatattttytgattttttaaaaattaagttgttttcttactgttttaagagttatttattctgaatataagtaatatatttattctgaatattttgttgaagtccgctttagcaagtttttctttcatggatcatcttttggtgtcatatctaagaaatctttggttaatccaaggtcacaaatatattctactttttcttctagatttttgtagttttagttttacttttaagtatatgatgtattttgagttaattttatgtatgttgagaggtatggattagtatgtgtatggttttttttttcttttttgcatctggatatccagttgttcctgtaccttttttcaaaaagaccatcctttttctacagaattgcttctgtcaaaaatcagttttttatatatgtgtgggtgctctattttatgtattttatatatttctgggttctctattctgttccattgatctatttgtcttgtgttgatgccagtaccacattctgttatggtagcttaataataatccttaaaagcaggaacagttagcctttgaactgtgttcttttccagttgtttggctcctctaagtattttcwtttgtctatgaattttagaattagcttgtcaatttatacaaaagagcctgctggtattttgatttgtattgtttggaatctgtgaatcaatttggggagaattggcatcttagcaatatggagtttttgtgaacaagctgtagctctatttgtataggtctctttaatttctctcagcagtgctttctagtttctagtgtacatatcttacacactttttttttgctgggtttattcctaaatatttcctatttttgctgctaaggtagatggcaatttttaaaatttcaattttcggtgctagtatctagaaatgcagtgggttttaaaaatacttttattttatatcttttaatcttactggactctattagtagmagtagcttggaaattttgtcagaktttttacccagactgccatgttgtctgtgaataaagatacttttacatcttccttttctctttgctcgagttactgaactggctaaagcctccagctgaatgttggataaaaatggtgaagcagacatctttgtcatattcctgattgtagggatgtaggggaggaaaagaaatatcttttccttgcccattacaaggtttatggctgacatcctataacaaaagacagactgacaagagagaagcctaacaaatttatttaaccgaagttttatctgacacaagagccctcagaaatgaagacttaaagacccagggaaaactgtgtattttttttttcatwggtgcgatgaacaaataaatagtcatgtagaagtatgattggactgaaaagatataatctattgggatcatagaggaaacttagaaaggcctgtttgttcagattcttctgtgtcttcattccttcccgctgggtatagggcaggacaccagtcacatagggtcttcaggggagaaggtggggagaattctttttatggacccaggaagaaagggcgggagaagatcagagtgatctttgwgttcatgccaagatgccgtattttgggatataatgtcctgagccctgaaaaggaaaacactgagtctttcaccattaagtaagatgttagctggatttttaaaaaatgtactttttatcaaattgatgaagttcctttctattctttgttaaatagagagtttttattaggaataatgttagatttttaagttattaatttggttaattacattaattttttaaaaaactaattgctgggcgggtgtggtggctcatgcctgtaattccagcactttgggaggctgaggcagacggatcacgaggtcaagagattgagaccatcctggccaacatggtgaaaccccgtctttactaaaaatacaaaaattagctgggcatggtggtgtgcacctgtagtcccagctacttgggaggctgaggcaggagaatcacttgaacctgggaggcggaggttgcagagttgacatcgcgccaccacactctagcctggtgaccaaacgagactccgtctcaaaaaaaaaaaacacaaaaaacccacaaaacccaaattgctttttcaaggtaagccaaatttgcatttttgggataaaactcacatggtcataatatattatcctttcaacatactgtttaatgcagtttgctaatgtagtgatgaattcttccagcttttatgtatctgaaaaaarktatttttcttgcctttatttttgaagatatttttactgattatacaattctaagttgatattttttttcattactttaaagaagttgctgcattatcttcttgctgtcattgtttttcaagagaaatggcctctcatcctcatctttggctgctcttaagagtttccttttattgctgattttgagtaatttggttatgatatgccttggtgcctttttctccatgtttctcatgyttgggttttgttgagcttcttggatctatgggtttagagtttttataaaacttggaaaaatttggccattttttccccccaatgttttctttcccttctttttcttttccttaggggactcaaatcacacatatgttaggttgcttgaagttgtcccatattttacttgatgctcttttaatttttttattataaatttttttttcctgtgtgtctcattttggatagtttccattatgtcttaaatttactacacttttcttctgcaatttctgtactctactgttaatcttattcagcatattttttatcttagacattataattttcacatctagaagcttgagtcttctttagtatctcccatacctctacttaatttttgactctatgatacagttataatgatggttttatgtccatatttaccatttctaaaatttgtgcccattgtgtccattctatattgatttcaatgaattgatttttctcagcattattgttcaaactttcttgcttctttacatttctgagactctgtgattggataccattctgaaaattaccttattgagtactagatatttttgtatttctataaatattcttgagtttttttctgggatgcacttaagttatatagaaataattttatccttttggatcttgctttaaaaagttttgaacagtacaagaacagcatctggtccatggctcataattayttcactagtgagacaaagtccttctgaatacccagtctatttctccataaattacaatgttttccagtctggtagaaggactggatatatcttggggaaaaaaatgtaccttgacctctaacttatgctatacaaaagttaatatgtgatgaattgtagacctaaatagatagctgaaactttaacatctctaggaaaaaaacagaataacattttcatgtcctgaagataagaaatgatttattatacagaacatagaaaatatgcataaaagacgttgataaattgaacatgataaaaattaaaagctttttataaaaagtcactgttaataaatggataagaaaactagatactgggagaaaatatttgtcatgtatgtatctgacaaaaaaagtcctctttagactttttaaagaactcctacagatgagttaagattttctcttttttgctggtttttactaatgtgatactgatgtggctttggtgtggttttcattatgcatatcttacttgagcatctgtgagttattgttttcataaaaatttgggaaattattggccactgtttcctcaaattccttttgtgaccttctcttattcttggattcaaagtacacatatgtcacttgtttactattataggctacttaggctctattaattttttgcagtccattttttctcactcttccatttttgttagtttgtattgcagtgtgttaaaatttactgtaattttcatttttcagttcagatactctgtgtttttttttttttttttttgagatggagtttttgctcttgttgcccaggctggagtgcaatggcacaattgcagctcactgcaacctccacctcccaggttcaagcaattcccctgccccagccgcccaagtagctgggattacaggcatgtgctaccacgcccggctaattttttgtatttggtagagacacggggtttcaccatgttggtcaggctggtctcaaactcctgacctcaggcgatccacctgcctcggcctcccaaagtgttgggattacaggcgtgagccaccacacctggccagatactctgtatgtttttggtctctaaaagttccattttcttttatatatcttccattttttaaatcatattcatattttgttgtaaatatttgagcctatttatattaattattttaacatttccatggtctactaagtttattatttcttagatttttgggtctgttctagtctctttttttcacccatttatgaatcacattttaaaattcatatctgaaattttttattggatgttggatattatgactattatactattgtctagattttattatcttcttttamattttttgaaatttgttttgagtgctgtcaaagctactgtggtttagcttcattttttgaggcttttatcaaaacttcgttatagtgggtctggtgacacccctgtggaggcagggtagctctcctactaagatgtaacactctgctcagtgtttagggtgtttgagtctctctattcatgtctgtcagaactcaagcatcttgcagcccagtgagaccactgggaattatttagcttgcagctccccagtaataggtcacccagtctcatagaattttctcctcygtgtatatgtgtaacttagtagttagctattggcgtaaggggcctctgtgaagatttctggagtttttctctgccaagctctgagctcactagtactcagccctacaaactctggcctcttcagtctccctagagtcttatttttaactcctcaacygagtgagactgctgtgatctacttgggattcctagcctgcactgttatggaaagggtcttatggaaaagggatttactcagtttttttccttcactcatggatcataattctgggctgcctgttgtctcaatgtttgaaaaaaaattttttttcctcagttttctagtagcttacagtaagaaggtatggacaattttacttattccatcatggcagaagtggaacagtttctgtttttaatagaagaatttattttaattgtgactttgaataaatataacctgaggttgtttatttttcttgtttagtgagtagctcttcacagaattagagccctccctccttttttaaaaaatgaaattctacacaggaccccaatatagaaaatagttaaaacttcatctgctctcatttaaattaggtttatagctctgttggtctctacctaacaccaaagcaatctggtactcccaaaaataaaatttgaaaacctgtgaactatttacccctctcattttacaggaggaaactaacttctagaagggtcaaatgttttgtcttaaagtaatgaatcttaaactgtctggcttatatgagtttttctagcatttgaaataagacctcttatatcctaactcagtgtctgatttttcttagtcagcttgattttttttaaaaggtctctttgattttgagctgtttcagcatgagattcttgagaactccatttcctattaatctttgtatggcgcattgagtccacatgggctctgttgtaacttctagctgtttaaacaatcttggaatagtttatattaaatccagtccaacatttggtttattctgttttctcacacttcagtatataagatttctgcttatccgttttacaaaaactgtatgaagatggctacatacttcttggtgtttttttgtttgtttttgagacagaatcttactctgtcacccaggytggggtacagtagtgtaaccatggctcactgcatccttgaccttggggctcaagtggtccttccatctcagcctcccaagtagcagggactacagatataagccactatgcctggcaaatgtttggtagagacagggtctcaccatgctgccaggctgatcttgaacccctgggctcaagtgattctccccgcttggcttcccaaagtcctgtgattacaggtgtgagccactgccatccatcttgttttattccttattcctcttcaattgttgtgtttatgtcatttaatctcctagaaactatttggactatattgtgatgaatgatgtactttgaactctaagtagtagatcatggattgtgactttgaattgttggggaagtttcatattgaaggaagcagggaatgtcaacagctttcactgtgttacttggcagaaatcttctttatgggcagtctgcagtctgaatctaagagctacagtttaattcttcctgaaagctgtcctgtrttcagtcactgcttcatcagtatggcctatggtatagaaatgggacagccactctagatggatgagaggtggacaggcaggatagatacagcactaggttcatctcttcagtctactggttatagctagactttaatattgaagaattatgttgctgctattctattatttcattttcttcttacttaaaaaagaaaatcaacagaaaacaccaaataatttagttatacatatgtcctcagatagtcttagaaaggtttcctttgaaatgcatctgtagtggctactagggactcaatgaatattcatccaatgaacagatgaactaagcccaataaaatcaacaaaacatctcctaagaaattgttgatcgtgtgcaactgtttgagttgcattactttttagcacaagaagaatagcatcactaccaaaaccagctgagatatcttattttattwatttatttatttatttatttatttatttatttatttagatagagtctcactctgttgcccaggctggagtgcagtggcatgatcttagctcttggcaacctcggactgccgggttcaagcgattcttgtgcctcagccttctgagtagatgggattacaggtkcctgccaccacgccaggctaattttttgtatttttagtagagatagggtttcaccatgttgactgggctggtcttaaaatcctgacctcaactgatctgctcgccttggcctcccaaagttctgggattacaggcatgagccaccgcgcccagccaagataccttatttaaattaagattcatcatgcagttctgatgtagttcttttgtaagtagtgcggcaraatttttcatacccatcattgtgtcctaaacactcaaaataatgcttcatacatgatataggtgttcaggaagtgtttgtagaatgagaaaataaatctgttctattgcattgcagtgtgtgcacatgacaggcctaacagatctcaagaaaactgttctttcatggctgttgatttcatgtagatttttgcatgtacacttcacatacacatrtgtttacatctctatgatgtatattagtagccatttcctttctaacattggtacttagtagtttgatttttttttaaacaaatcttattttatgtagtaattgatgctttttcatgtactcttactatagcctacataatttgagttctttttcctttatttttttcctttttccaggtgaaaatttcctacctattggaaatataatttgtagtttttgactgatttatcttatattgataaaagatagggcatttaggaagaatttttatrcatattattttgttttctccctcaacttctttgtaaggtaggtgaacagatgaggtaaatgatgcagataggctaatcgtctctctccaagtcacacagttaagttgcagggttaggattccagggtcattgttccttttgctgattctacactatctctgaatattctctttcaaaaaaggatacataatctatttgctttagttaacgcagaattgacttgcaattttggttaaagagaatgaaaaggaaatcactgtatttagtgggaaaatgtcatttcaaaggttgattctgatctttaaaaattgtaattgtaattatcttgtgtagagccctgtgtcttaacatcctcatttaataatttgtttgtcatataagcagatggtgagaaaacagtgattcccagatctgtcattactgctgtggtaatttgatgttttatagttaagaattttgactggtagaaggctgatctagaattcacatgtctctggggacctgtattgtttggatttggaggtatacttgtatttgaattcagggaaggctgttataaataaggacttggcttgcatgataagtaacatttctttatatagctattcagttgagctattgaaagtaaaacatacaaacaaacaaacaacaatagcaraaaacgctttgtgttgttgttgacagaaaagttgaagcttttcaatggtgttttcctctctcatgtcgcataaccatgatggtgataagcgtacaattatatataaaggcaaaaaagttcaaagtccagaggtattaaatctttatggtaaatgagagcctgtaagtcatgtaatacactaagaagtatgttctgaaaatcttaagagatccaattgccatgtgactctcacaatgttatcctttatgaggagaataaaaggatgcttagtgtgacttttgcaacatcaagcccagttgaaacacaaattttattttgatttgtgagtccaatccaaccagttatttttcattttccatttaccatcattttgattagtattttttgttaatcagttcagagttactatttgcagccctctgaaagctggagcctacattagaagttttctaaatgtattgaagacaaagccatttattaaaatctgatattaaactgtcactttccagaggcatatttgaaaaacagaaaaacaaacaaacaaaaaaaacacaagggaaaccatagagctcttcctgagatgctttaattcaggagtttctactcaaaaagttaatcactgacaaaattctttgaaatgttttagtgttcgtgtgagtgtcacaagccatgctttttagaaaccagaattttgtaataagtgctctctctgcagcaattaaaaagtggcgtcatctatggtaaacactaagttggtctattgagagggaaatagctagcccttcaaaatacctttgtgggagtgaaaattacctttcgtactgaaacttactaacccccagtgattaagaggccatttcatgttcaaaaacatgttattaaaaataatgagtgtgatattttaagtacatgactattactacaaaaattgtaatattatagattaggatttattcatacactgaaggtctcatatgttgatatgaactatatttcatttaagaaggccttgggaggaggagtcaggatcatgaacaatctgagagtttatccaagacctgtaagttataagaaggaagagttgagaggtagctgaggtgggtgtctccaggtaggacacgtgaagatgggaataagttcaggggacctgagaaaggtgcttggtgcctaaagtcagaggaaagycaaattagggattccttttagggaggtgaggagagcaacttagacgtgatgttgcatttgtgagcttggaacccagagttaaaagaaaatatacagaattgaaaaatattacctggcctaaaattggaagtagaatgatttcgcaggaaagaaaagtgaaagaggaactatcatctcctaggcaaaaacagaacagtgtagagtcaggaagaaatcatgatttgtcttcaagctgagattagttaattggatggcacagtataggtgtctaacttacccgtacatagtttactctcttcaggtgtccttaaactgtgatgtaagtgttcatctgaatttactctgtatttacattctatccatgatgtctgtaatagctatgactataaaagggagggccagcctcattactccttggatggctacactgcagtaggacccagaggatgtgagtatgggaatctgatcctgagtcctgctggttggagagttgccagtgtcatcataacttgtaaaaaaagtcccataagacacttgtaaaggataagtcttaaagtatgtaagaataaatcagaaaattgccttttttaaaaaaaagctttttaaaaagctttttagctggtgattgtgtctttcttttctttaggattctttaataagtaattttagtaaagtgtcattcttagttgctaaagaaaacagtcgtctcctgttttcagtcatcagattcaagcctattaggaaaaacttgaataattattcttacacgtctccattaatatgaagaatcrtgcataaaatgtagtccatgcttatctctaaaataaacaaggaaataaaatttccgggttctgttagttgttagaaaacatggtaactcaacttgttattctgcaccttgggaaaaaaatgcttccttgttgattccaagtaagatcatttagaaactaaagtctaccatgtagagtataaaaatgagattgttaaggggatgctcctttattctgaaaactctctaatgagggaacaaaaatataaccctggttttaatatttatgtaactttttgcagaaataatttaaaatagggagaggtaactttcaatcccaaacatagatcaaatacttagtaatttrtttgacctataatgctggttctcaaccctggctactctttacratcacctgggagcttcttaaaattaccagtgtgatcttaaccccagagattctgatttattgttggtctgggttagggcctagrcatggttaattggattccttaggtaattctaatgtgtagtcagaattgaaaaccactgccttagaaacacacagttgaactttcttttatcttcatatggaatcagaaaagtaaagaggaagaaaaggagtgacctgtagattagctacccatctgtacttattctaaaagatcaaggtagggagcaggtgaaggcttggattttgcaccctttgtaccagaacacatgggccagtgtgcagtactggaagtaaagttcttggatgttacagtgtggtggcatttcttgtcaggagagaagggaatgatagattgttttaacttttcttcttctgcttgactttgagtaaaaagttgagcatctcctgcttttttagcattttaggaaaaaaattattgtgccaagagtatcaggtaatctgtcataaaaatatatgaatggagcagatctgtgcatcacttcaaactaaagatatataaaagcattcctttgtgcttttttgctaagctgtgacagcacaatcactggttattttgtaaagaaatttattttaaaacagtatgacggccaaaaaaaagctattggaaggagaggaagagaggacacacctrggttacatttggcctcttttaagtctgtgagacatgtttaaaaatctttaaagaaagcttactttgtcactatcccatttctgctataatcaacataattatacctttttaaattaactaatctatgagtaccgacttaatgaatgagttccatgtatatggagctgcttaaagactctgaaaagaataggaatgtcttattaatatcaattctggatactacgtgcctaaatgaaccttctttagagggctaatccagagtactcatgcatagaataaaagcttactggataggctcaataatagaatggatatgactggatatgactgagagtagataccgtatactgtggtatgactggtgacctgttggatgtcgctgtcctgtagtcattggttaaatatactcctgatgacagatgggtacatgcayttcatccagctttgctgctgcacgttgtcatggtgaaggggaaggacacactacaaatgatgattccttcccacagactacagtccatatcttaacaaagatctgtcgaatgtttccctgtggaaaagaggattttaatatatttttctcttgctgacttgagtaaagatttctgattatcctagaacagagataatggargtaatttttcatggaaaaactatatactttcgtttgtaagctgttagaattggcattttgttggttgggtgccargctgctagactatgcaccacgtgggcagggattttgttttgctcaatgttgtattcctgatgaaaggtaaatgattttaattttgataaagtgatttatttactttttaattttttcattttttccacttgttatttcactttgtaattatatgatataatctatttttagttttctccacagggctaaatatggtaacaatttattgtttattcagggcactcagtaaactgaggatttgtgaatmctgtatgaattcattttatagagaataacagtttaaaaaaactaatgactggaacattagtattgaacttttgtcttacaataaactttttaaaaaagtttaaagaaaatttttagaagtttcaaggcatataatcacagatataaaatgcattaagaaaacctattcagaatcgcacagatttattcacatttcaaaacacttaaatatgcaaaaaagaaaatccacagaatggttttaaattacaaactcaccttgtgaatttaaacctaatttcattttcaaaagttcaattttcagctcattttaggatcatttatatgttgtaaaagtgatatatactagcatctggttatggtcagcacctgccaagaaagttaataaagcatttctttaagatctttggtttagaaaaatgttctggctatatttatagtagcctatataaataagtgctacaaaccttaccacttcacaatttttgtgaattctttttctccattgaacagatgcaaatagaaaaattaattagcctttcccttgttaccagacataaattattattctcttctaaagatacaaaaaaaaattgatgagaagaatcatagaatttttagaagtggaaagtatcttagaagtaatctacacttatttttagcatcttgcttatagatttcaattttgtaaaaaccttagtggtattttgatggtaggatatttttattaagtttttaaatgtcttaatgttctctctgtagccttatttgttaatttttgccaagaatctttccacaaaatctgaattacttgcttcaatttgcacctttcataaggattaaaataaattgagatcttaagaacttatttatttatttatttatttatttatttatttatttattwgagatggagtttcactcttttgcccaggctggagtgaagccgcacratctccgctcactataacctccgcctcccaggttcaagtgattctcctgcttcagctccccgagtagctgggattacaggcatgcatcaccagacccggctaatttttgttatttttagtagagacagggttttaccgtgttggccaggctggtctcgaactcaggtgattcacctgcctcagcctcccaaagtgctggaattacaggcgtgaaccaccttgcccrgccaagaacatttttaatgcttgtttatataagaagatatttggctaggcctttgattttttgaaaggaagatcctaaatataaagtgcatgacctattatatatttctgcaacacaggaaattaacattttatttagtaggataataccttctggtaaactactgagaaaaaataaaatttactacattctaattataaagagtactttgccatatcccttacccttctcaattctgatatggtctcctggaggtgagacagggtttatttgctaatagcctgttgagcaattcagttgtcttaccattgtctcctttccctgcctgatcttttttcaytgaatggccataataattttttttttttttgagagacggagtttcgcgcttgttgcccaggctggagtgcaatgctgcgatcttggctcatcgcaacctccacctcccaggttcaagcaggtctcctgcctcagcctcctaagtagctaggactacaggagcacgccactacactaggataattttgtatttttagtagagacgaggttttaccatgttggtcaggctggtcttgaactcccgacctcaggtgatccgcccatctcagcctcccaaagtgctgggattacaggcgtgagccatcgtgcccggccataataaatttttgaatggccatcctaaattttaggtgcctcattggagtacagagttttgccatagattgtaaattattctagggagatatttttgatgctattgacatttaacccagataattctttgtcatgggagactgtcctgtgcattgtaggatgtttagcagcgttcccagcctcaccccaatagatgccagtggtacctcctcgcccaatttgtgacaaataaaaatgtcttaagatgacgttgcttgaatgtcctctggagggcaaaatctgcggttgagaaccactgctctagggcaagaaggtcttttgtgtttgtattctctcatttcccatacatatgtctcctcaattgtgttattatgtataagaacccagtaatttttacttaattgaaatagtaactttattttaaggcctgattatcttgtattgaaatggtaatttttatgttatagcctgtatgtatcaacaaatatgtaaaaacctggagaggaaatattgtataatccatgtatagtataaataagagttagctttaggtatctgttggatcgattttaaatactatccttagtattccatatgtggctgttacaaagttatagaaacgaagctttgtcaggcgtggtggctcacgcctgtaataccagcactttgggaggccgaggcgggcggatcacctgaggtcaggagctcgagaccaacctgatcaacatggtgaaaccctgtctctactaaaaatacaaaaattagctgggcgtggtggtgcatgcctgtaatcccagctactcagaaggctgaggcatgagaattacttgaacctgggaggtggaggttgcagtgagctgagattatgccattgcgcttcagcctgggggacagagtgagactccatctcaaataaataaacaaacacacaracaaaccaagcttcagttttttctcctgtaaaattgaaataatgtctattttrtggttttatggtaagaaacaaattacatgataaatatggtcagctaagctcagctgagaatcagatgcctttggtgggttgtagtttgatggtactcttctactccattttaacatttctgttatctgattcataaaaggggtttttagggggaaacacctacttgaaatctccctacaatcggcatacagatatatatgaagctttaaaatgcattagagagactccttatagatttatctctatttgccaagaggaacaatggatgaaggaatcagccttattgtgggattctgttttagttaaagagtaggctaagttgcagtaacaaatccacactttaatggctcagttcagtaaagtttatttcctactcacatgatagtccttactgcttcaggtttgttggacattctttcaggaacatgaagctccttctgtctaatgggatcaccatgtacgttgtaagcttcactgttgtcctctggtagaagaggtaaacgtgtaaaaggagtaccactgctttcctaaaagcagtggtctggaagtgggatatttaaattctgctcatattctatttgttcttatttggtgagaacttggtatcatggtcacacctaccccattgaagaatgggagagagtggagttttgggtatatacccaaaggattataaatcatgctactataaagacacatgcacacgtatgtttattttggcactattcacaatagcagagacttggaaccaacccaaatgtccatcagtgatagactggattaagaaaatgtggcacctgtacaccatggaatactatgcagccgtaaaaaaggttgagttcatgtcctttgtagggacatggatgaagctggaaaccatcattctcagcaaactatcgcaaggacagaaaaccaaacaccgcatgttctcactcataggtgggaattgaacaatgaaaacacttggacacaggaaggggaacatcacacaccggggcctgtcatggggtcggggaaggggggagggatagcattagaagatatacctaatgtaaatraggagttaatgggtgcagcacaccatcatggcacatggatacatatgtaacaaacytgcacgttgtgcacatgtacactagaacttaaagtataatgaagaaaatatatattaaaaaaagactcttgctttaaagaaagaggttgctgcctactctcttgacagggatgatagcattgttctctagcatccaggtgtgctgggattcttaacgtcttcgccatcaagatgtggcggtttcctaatgctaccagtggctaggtagtagggaagttttgagttccagctttgattagcacttctctagacccatcagagatgcatcctgatgacttgtaatgaaatgtagaggtcaggagtaatcactggacccttacaagtgctcctttggattttcaagaatactgggagttgtacaattctgccagaacttgtgcttcagcagtttgagcagttagggcttaatgttgttagccaagcaactaggagcttggaattattgacagccagttgaaatgaaaggaataaatatatattcatagagtgatgaagtgaattctggttacttggctgtaaagaggcaggaatagtgcacacagcatatccagccaggtaaagaggaggacaggggcagaatggcttagcaggaaagtagtgttccttgccacatagggaaaatagttcctcaggttttgtaggcttgagcagcagcaaatatttgattataataaaaatggaacttagtattaaattatttaatgaatgatgtgttctattaagagcctttccatgctagagatcttagcatttctggtactgtatgtactattcagagggtacaaactattcacagttccagaaatgttaatatcaaagagcatttgcctatatattaaatttcatactggctggatgctgtggcttacgcctgtaatcccagcactttagggggctgaggcaggaggatcacttgagcttaggagtttgaggccagcctgagcaacacagtgagacactgtctctacaaataatgataataataataataaaaatagctgggcatggtggcacacacctgtagtcctagctgctctggaggctgaggtggaaggattgcttgagtccgggaggtcagggctgccatgagctgtgattgtgccactgcactccagcctgggtaacagagtgagactctagacccatcagagatggcaagaaaaaaaaaatagcttcctttaaatgcagtctgatttcggaacttctatttttctttacaagtttgataattatctctgcttttaaattaaaggaaattcattctttaaattttacttggtctttttggtttctgttactgaattctactcacaatgaatttagtcgaagtctgtgtttctagcgtagttactcaatattgaaaatgtatgttagcaagatggagtagtcccttatgtggttagtaggccttcaggcagtttttttcctttttgccttcacctttagtttaccccaaaatatataatcaaaatatataattttaaaaaattctatatactactgtttttgaaaattataactatttgaaccaggtactattgctataacagataatattttaaaatttaaagataaacaggaggctgtgttaggggagcagtattcttatattgatgttctgcatttagttgcagatgttactgttcataaagatatacaagtaccactgatgttggtattgcacgtagaaagtaggtaaaaatgataaattggagtctgcctgacagaatgcagtctgagagaaaacttttctctttcaatataatctctttacatttggcctaagtttaaggtaacagtgttgcctttcagaattcagcctttctttaaagatatttttcatatcagcatattacatccaaaatacctcatgctcaatattatgttatatttaaaatgagaatcatgcaaacattaatatctgaattaaacataccaaaattaattttattctttcaaatatggaattacaatagagctttctttcacaaggttgatttttagattatcttacagtaaaagcatctgaaaaattttggcttacttagtctttctcggagtttctttttataagggaatcttggcagactgtgctctgttctatgagctactgattgtagggggaaataatgatgctatttacttttgtgattttcttcaaactgaacaatcaagttaaaacctaagataatgtttcaaaagtmatcactatatatgtggtcttatccttttatccttattttctctgtaagtgattccttttctgctcttctgatttcttaatatttttcactttcttcagttaaaatttattaatcacacatttactactaatcaggaattatgaagactggaatttaaaaactactctactggagagaacaactttcagttgaaattcttcatggttgggtgactaaagattccaaaagagagtggtttggatgaatcagcactggcttggaaagggagctcttgaaatctgctccacatttcttatgaatgacttagatgaaggtacacaaaataaatttttagggcatgaaaagttgaaaggaatagctaatatattgagtagagaaataggaatttaacattatcacagtggactgaygtgctatgtcatggcaaataatatgttatttaatgtgaataaatatatatgtctgcattaatgatatataaaatattcacttaatttcgaggaaacagtgcagaaaggttttagttgactgcatgttttatatgagccaacaatatgataaagctggtaaaactgtcaaaataataatggactatagcagttaatagtttctaaatagtttccaagaggcccctggtattagtcagttcttgcactgctgtaaagaaatacctgagactgagtaatttataaagaaaagaggtttaattggctcatggttctacaggcygtacaggaagcatagcggcctctgcttctggggagacctcaggaaacttactgaggtcatggcggaaggtaaagaggaagcaggctcgacttacatgggcagaataggaggaacagggaggggaggtgctacacacttttaaacaaccacataccctgagaactctattatgagaacagcactaggggaatagtgmtaaaccattcatgagaaatcacccccatgatccaatcacctcccaccaggccccacctccaacatgggggattacaatttcacatgatgtttgggcagggacacagatccaaaccatatcaaacctgtactctgttgtctgctctttaggatacctttggagtatttgtttcattctacactttatatattaaggaataattggatatccgtaagatgaacaagatcatgcttttaggaagagatactttatttggagggaatgcatgagaagtctagagaaggacttctcaattctagggaacctgatctggagaaaagatttctgacaatgagcataaaattattccaccttcttatraaaggcaggactaggatcactgagtatatagaaattttagggaagtagattacattaatatgtaatgatgtgaaaagttggaatcactcaatatggattgattgggctgccttcacaaagtgagtcctttccctgtcaagctaaatggcaatttgtctagattattattgtaaagaggggattaatttactagcgggatgggatgacttctctggccccttccattttttttgtatatgtagtaggttttattgaagagttgggaagtttttgtttttgttgtggacccctttgaattcacattattcctcaaagtatgaattgggaaagaggttggtgttggaattgtaacaggcttcatgatacatgcagactcactacccatgccacttgaccatttttaatcttgtgagcctttgtcattttcactgcataagaaattaaccaactgatggttttatttgaaggataggggtttaccgatggggcagtctcattgttttactgatatatatatgggaatataattcctagacattcataaccttaattcagtatggtaaagtttagtcaatttttaattactgtatattcttcccatccatttacacagttcagtggtttccttccttcattcatattccttaaatagtttttgttccayggactatcattttttattatatagtttctctgtccctgctgattgcattagtctagtactagcaaacagagggttatccaaatgtttaagaactaaaccagagtaagatgatatacaagtaatagatacttttctgcaaatttcaccaaatcttttctgtgtagtcattgaagagactcctacctgactgctgttgtagtgggacagattttgatccccagtttagtaacatatacttttttcgttcatttggaaataattagtgcttgtgcttattaattaagaaattatttagtttggtttgctaccagtgcaaaaagaaatttttcagttcacatttaaaaggtagaagtgatttaaaaattattaatattgcagcccttctcaaayctttcacttgatcaacaagtttttagcattttctctttacttttctaactttttgttttgaaataatttcagatttaaagaaagattgtagaaagaattacagataattctcatgtactcataacccagatttcctaaatgaaaaatggaaacattttatcatagttgttttctctgccttcttcttttttctttttgaactatttgagataaagttacagtcatgattatgtttttatccccaaatactcaagtatgcatttcctaaaatcaggaacatggtctaaaacaaccataatgcattgatcaaagtcagaaacttaacattgatacagtacttttatttatttaatctgtatcctttattcaaattagacccgttggcccagtaatgtcctttatgggaaaacaaaagaagtctgatttagaatctgatctaggctcagacattaattacatttagacatcatgtctcccttaatttggaagagttccttattttttcttcgtcttttatgatactgacatattttgaaatgtgtaggccagttaattgataaaatattcataagcttgggtttatctgctctttcctcatgattagctttcaatttatgcagtcttggcaggaatactgtggaagtgtttttgttttcttttcagtgcatcagatctggagacacattataragatttgtccaattattgattatattaactttgatcattttgttaaggtggtttctccactttgccagtttgtcccctatgaagttattattttatcctttaataaatatcttgtgtgaaaatactttgagactttgtaaatatctatttctcatcaaagttaaatgctctagttttagcacctgttgattcttgcatgactgaagcactactgctttaaaaaaagcattactatgatagttgtaaaatgatttttctcatcctgtcacttccgtatttactaattgtcattgtactgtaaggaagaagtttcctttctcatttgcttactgacttatttatttatattagcatgaactcatggattcttatcttaatctatgagttaaaatccattactgtggtttagtgttttgctcgaattatcccagatttggcctattggaaccttttctggatggtttctgtttcctgttgaaaaatctccatgattccttgaattcttctttattctgtggcacaaaaagatattctagactcattgtatacggatctcttcctgtctaggaataatccatttttccaaggagctatagtttcttttatttgaatataatttttagaaaccaggacctgggcacttcatgtgaaaatttataatggattatcattgcttctagttgctcttagtgggcaaacataaaatatatatgtacacacacgaatatatatatayayacacacacacacacacatacacacacacatacatatacatatatatctgtttctgtgttgatctatctatatttaaaaatctacagtgtgtaatgctatttatcattgccacaacttaatgtctacacasaatgataggaagctttatcaaatatgtctttattttgctttcatttgtaaggattattttcactggatatagaattctgaatgaaatctcactagataggcttaataatagaatggatgtaacagaggaaagtgtcagtgaactagaagatagatcattagaaattattgtgtctgaaaagtagagataaaagattgagaaaaaatgaacagagtttcatggacctgctgaataatatcaaaatttatgatgttaatataattagactcttagagaagagagactgacaaggaaaatatgtttgaagaaataatgggtgaaaagtcttgtaaatgaagagaaagtcacatttaatgattcaagaaggtcagtgaacaccagttaggataagtacaaagaaaatctaggtgatttatggtggctcatgtctgtaatcccagtactttgggaggctaaggtgggaggattacttgaggccaggagtttaataatatcctgggcaacatggtgagacccctgcctctacaaaaaataaaaaaaattagggcaggcatggtggtgtgtgcytgtaggcctagctactcaggagactgaggcaagaagatcttttgaacctaggagttcaaggttacagtgaaccatgattgcgctactgcacttcagcttgggcaacagtaagacctaagaccctgtctctaaagaataagaaagaaaatcttgcctagatagattgtaatcaagctgctgaaaccacagatgaaaacaaagtcttaaaacagagaaaaattacttatcatatacaatggaataatgacttaaatgaccacagatttctcattggaaatcatgggggctagagacagatagatgaagaaaaaaaagttatcaatatcaggaatgaaaagggggatatataatagtactacagacattaaaaggataattagagaatacagcaacagtcttatgccacacatttgacaatgagatgaaataaataaatgttttgaaaatttcaaaaattgccaaaaccggataaaaacattgaaaagctggtaattatagacaaaaatctatcatgaatgtaaatgcaagaatcttaacagaatattagtaaatcaaatgtaataatatataaaaggataatacatgcctaagtagaaggtatcctaagaatacaaggtttatttaacatcctaaagtcaatcagtgtaattaaaaaaagaaatgaatctcattattattttggtagatgcatttaaggcctgtgacaataatccatttattaaagaaaaattaggaaattcttcaaactctgcacacctaggaagaatctgtaactcatatttaatggtgaaagacagaatcttattcccctgagaataagaacaagacaaggatgcctactttcgtccacttcattcagcattgtaatggaggtcccagccattgtaataaggtatgtgttatggattgaatygtgtacctcaagaagttatgttgaagtcctaacctctggtacctttcaatgtattcttatctggaaatagggtctttgcaatgtaatcaagttaaaatgaggccatgctgatttagggtgggtcctaatccaatatgactggtgtccttattagaagagaagagaygcagtgggaagacagccatatgaagatggagacagatactggaattatattscctcaagccaaggaacttctaggacaaccagaagctagaagagggaaggaagaattttttcctagaggctttggagggagcatggcccagtaacaccttaattttggatttctagcctctagaactgcaagataataaatttttgttgttttaaaccaagcagtttgtggtactctctgggaaactgaaatatagcaagtaaaagaaatgaaaggaataaagatggggaaatgagaaataatactgttactgtttacagatgttatgattattacatgaaaatattttaggaaccctataaaacaactactagaactagtaagtgaatcttcataattgcaaactacaaggttaatatactaaaattggtgcattcatttatcctaacagcgtactgttggaaaatgaattttaaaagaatcccgtttataatagcaccaaaaatcataaaatacttrggtataaacaaaacaaagatgtctaagacccctacactgaaaaatacaaaatgttgccaatagaataggagggtagaaactgagaagctgattataaaaactatgtggaagttaaaaaggacctggaataaccaaagaagtttaaaaaaaagaaggttggaggacttatcctacctgatttgaagaactaatataaggctacaataatcaacacattttggtatgatgaaattatacacgatagagaatctaaaagtaggcccacacatatatgatcaattgatttttttaatagatgtacctgttctaagacaaattcttgtggttctctgacatttctacacatcttttgagcaagatgcattggcatgtttgttctagactatctttccaaagacatttgtatagtaaacttgcttgggagattgagatagtgcctttctctgggagaagagtctggatttgttttcttttatttttaaccatgcaacaatagcttattatgtatgggttttaaaggtttcaaaaattatttcctgaatctctccatacacaggcaaaaataaatgtgctatttaacatattggaatgtgcaaacttaatcattgcctagagaagggaaaattatccccaaaacatgcttaaccaggaggctgattcatctgctgactccaagaacatgaagatgaacatgatagacagactgtccaccatctgaatgttcattcamcacccattcattcagtaacccttactcaggcccagatgagcagcacatttcttgccaacaatcattaaatgtccaagaaggctctcgttatcatcttctgcagcagaaatctgggatatgtttcttgtgtatcactagaaaatgtgttggaagaggccaagatggcagatgacatcactaaggctcatgtcgtttggcctggtgacaacacaatctttgggaatattttccacaaagaaatcccagctaaaatcacttttaagtatgactagtatcttgctttccatgacattttccctcaagcgctaacaggagggaggaactggatttgttttctgaccacgatagtaagcataatgtcttcaacttaggcaaagcctgggtagggttgctagcagccactgtgtaagagtgagkgtttgctaagtttatggttcctcagttgtgacactgacccgctgtgtgccagccttcatctgaccttgcttctgcatttccctgtgggcgttggtggttaaggaggaccaatgcaaacatgaagctcttactgcctgacgtgctgagagtaataaggtgctttgtctctgattcaggtgtcttgggtcttctgctggcatgagggaagccattgcgggctaacttgtagcttgcaagtagggtaaaatctcagacccttcatrgttcttgacattaccaaggtaattaaaagggaaaaggaaaatcttttcagaaatggcaccatattaactggatatccatctggaaaacaattaacattaactcttaacttcataccagacataaaaatttgattggatcatagaccaacatgtaaaacttaaaaccatactacttagaaaaaataggctgggcgtggtggctcacgcctgtaatcctagcactttgggaggccaaggcaggcagatcacttgrggttaggagttcgagaccagcctggctaacatggtgaaactccatctctactgaaagtacaaaaattagttgggtgtggtggcaggcgcctgtaatcccagctgaggcacaagaatcaattgaacccatgaggtggaggttgcagtgagcccagatcgcaacactgcactccagcctgggcgatagagcgagactcagtctcaattaaaataaataaataaataaagtaacatataacttaaaatcttcaccgttggggcatgacacagtaaggtcacatcacaaaaaagcaagaattgaagaaaacatttccaaaacatatatcagacaaaggacttgtgtccagaatatataaagtactctttccatttaataataacaggacaatccaattttaaaatagtgggcaaaatttttgaactaatacttgataaaagaaaatacatgaataatcgataaaccataaaaagatgattagcataggttgttatcagagaagtgcaaagtaaaatcacaattttatcttactctacatccattaggatggcaagcatgtggaacaactggaaattatatatatcgctgaagtaaatgtaaaacagtaaacagtttggcaattgcttgaagcattaaacatcccccctcgcccaaaccagccattccactcctagttatttatacaagagaaatgaaaacatgtgcccatacagaaatttgtacatgaatgttgatagcagtttcatttgcaatagccaaaactggaaacaacccaatatccatcaacaggtgaatggagaaacaaactgtatcatacccaaacagtggactcagcagtcaaaaggaacaaatggctatatcattatcatcatcatcatcatcatcatgatgaatttcaaaataattacccttaaagaagccagaccaatagagaaatatttattatataattctacttatatacagttctagaaagtgcaatgaacctgtagtgacataaagcagatcaatgttacctggaaacagggtacagtgagaattggattgtaaagggtctggtagaaatgcttgttatcttaggtgtagtgatggtttcatgggaatatataggtcagaaatcatcaaattgtacagtttacatatccaggtcattgtgaatcaaatgtcaataaaatttaaaacgaagatataaattaaatattttattattttttagaatattcaatttgtaagttcaactttatcatagaaaagagctacatttttgttgttatttatttatttatttgtattatactttaagttctagggtacatgtgcagcacgtgcaggtttgttacataggtatacatgtgccatggtggtttgctgcacccatcaacccgtcatctacattaggtatttctcctactgctatccctcccctagccaccagcccccatcctgtcccccagacaggccccttcttgtgtccatgtgttctcattgttcagctcccacttatgagtgagaacatgtagtgtttggttttctgttcttgtgttagtttgctgagaatgatggtttccagcttcatccatgtccctacaaataacatgaactcatccttttcaaataacatgaactcagccatagctgcatagtattccgtggtgtatatgtgtcacattttctttatccagtctgtcattgmtgggcatttgggttggttccaagtctttgctattgtgaacagtgctgcagtaaacatacgtgtgcatgtgtctttacagtagaatgatttataatcctttgggtatatacccagtaatgggattgctgagtcaaatggtatttctagttctagatccttgaggaatcgccgcactgtcttccacaatggttgaactaatttacactcccaccagtagtgtaaaagcattcctatttctccacatcctctccagcatctgttgtttcctgacattttaatgatcgccattctaactggtgtgagatggtgtctcattgtggttttgatttgcatttctctaatgaccagtgatgatgagcattttttcatgtttkttggccgcataaatgtcttcttttgaaaagtgttcatattctttgctcactttttgatggggttggtttttttttttttcttgtaaatttatttaagttctttctagattctggatattagccctttgtcagatggatagattgcaaaaattttctcccattctgtaggttgcctgttcactctgatgatagtttcttttgctttgaagaagctctagtttaattagatcccatttgtcaattttggcttttgttgccattacttttggtgttttagtcatgaagtctttgcccatgcctgtgtcctgaatggtattgcctagggttacttctagggtttttatggttttaggtcttatgtttaagtctttaatccatcttgagttaatgtttgtataagatgtaaggaaggggtccagtttcagttttttgcatatggctagccagttttcccaacaccatttattaaatagggaatcctttccccattggttgtttttgtgaggtttgtcaaagatcagatggttgtagatgtgtggtgttatttccaagggctctgttctgttccgttggtctatatctctgtttttgtaccagtaccatgctgttttggttactgtagccttgtagtgtagtttgaagttaggtagcgtgatggctccagctttgttctttttgcttaggattgtcttggctatgtgggctgttttttggttccatatgaaatttaaagtagttttttcctaattctgtgaagaaagtcaatggtagcttgatgggaatcacactgaatctataaattactttgggcagtatggccattttcacaatattgattctttcctatccatgagcatggaatgttttccatttgtgtgtgtcctctcttatttccttgagcagtggtttgtagttctccttgaagaggtccttcacatcccttgtaagttatattcctaggtattttattctctttgtagcamttgtgaatgggagttcactcatgacttgcctctctgtttgtctattattgatgtataggaatgcttgtgatttttgcaacttgatttttttatcctgagactttgctcaagttgcttatcagcttaaggagatttggggctgagatgatggagtttgtaaatatacaatatacaattatgtcatctgcaaatagagacaatttgacttcctctattcctatttgaatatcctttatttctttctcttgcctgactgccctggccagaacttccaatactatattgaatagtagtggtaagagagggcatctttgtcttgtgctggttttcaaagggaatgcttccagtttttgcccattcagtatgatattggctatgggtttgtcacaaatagctggtcttattttgagatatgtgccatcaatatctagtttattgrgagtttttagcatgaaggggtgttgaattttattgaaggccttttctgcatctattgaggtaatcatgtggtttttttcattggttctgtttatgtgatggattacatttattgatttgtgtatgttgaaccagacttgcatctcagggatgaagccaacttgatcgtggtggataagctttttgatgtcctgctggatttggtttgccagtattttattgaggattttagcatcaatgttcatcaggaatattggcctgaaattttcttttttgttgtgtctctgccaggttttggtatcaggatgatgctggcctcataaaatgagtttaggagaattccctctttttctatcgtttggaatagtttcagaaggaatggtaccagctcctctttgtacctctggtagaattcggctgtgattctgtctggtcctggactttttttggttggtaggctgttaattactgcctcagttttagaacttgttattggtctattcagtgattcgaattcttccttgtttagacttgggagggtgtatgtgtcgagaaatttattcatttcttctagattttctagtttatttttgtagagttgtttatagtattctctgatggtagtttgtatttctttgggatcagtggtgatatcccctttatcatttttaattgcatctatttgattcttctctcttttcttctttattagtctggctagcggtctattttgttgatcttttcaaaaatgcagctcctggattcattgatttttttgaatggtttttcatgtctctatctccttcagttctgctctcatattaggtatttctcgtcttctgctagcttttgaattatttatttgcccgttgcttttctagttcttttttttgtttgtttgagatggagtcttgctctgttgcccaggctggagtgcagtggcgcgatcttggctcactgcaagctctgcctcctggtttcacgccattctcctgcctccttcctgagtagctgggactacaggcacccatcaccacacctggctaattcttttgtatttttattagagttggagtttcaccgtgttagccaggagggtgttaatctcctgaccctgtgatctgcccgccttggcctcccaaagtgttgggattacaggmgtgagccaccatgcccggccttctctagttcttttaattgtgatgttagggtgtcgattttagatctttcctgctttctcttgtgggcatttagtgctataagtttctctcgaaacactgctttagccgtgtcccagagattctggtatgttgtgtctttgttttcattggtttcgaagaaatgttttctgccctaatttctttgtttacccagtagtcctttagtagcacgttgttcagtttccatgtaattgtgtggttttgagtgagtttcttaatcctgagttctaatttgattgcactgtgatctgagagactgttaagatttccattcttttccatttgctgaggagtgttttacttccaattatgtggtcaattttagagtaagtgtgatgtggtgctcagaatgtatattctgttgatttggggtggagatttctgtagatgtctgttaggtcacttggaccagagctcagttcragtcctgaatatccttsttaattttctgcctccttgaggtgtctgatatacacagtggggtgttaaaatctcccactattattgtgtgggagtctaaatctctttgtaggtctctaagaacttgctatatgaatctgggtgttcctgtagtgggtgcatgtatatttaggataattaggtcttcttgttgcgttgatccctttaccattatataatgcctttctttgtctcatttgatctttgttggtttaaagtctgttttctcttagagtgggatcgcaacctctgctttttttttgttttccatttgcttggtaaatatttcttcatccctttattttgagcctaygtgtatcttagcacatgagataggtctcctgaatacagcacaccgataggttttgagcctttatccaatttgccagtctgtgtcttttaattggggcatttagaccatttacatttaaggttaatattgttatgtgtgaatttgatactgtcattatgatgctagctggttattttgcccattagttgatgcagtttcttcctagtgtcaataggctttgtaatttggtatgtttttgcagtggctcgtatcgattattcctttccaagtttagtgcttccttcaggagmtcttgtaaggcaggcctggttgtgagaaaatctctcagcctttgcttgtctgtgaaggattttatttctcctttgcgtatgaagcttagtttggctgggtatgaaattctgggttgaaaatcctttttttttttgagatggagtctcgctgtcacctggcttgagtgcaatggcatgatctcagctcactgcaacctctgcctcctgggttcaagcaattctcctgcctcagcctcccgagtagttgagattacaggtggtcaccaccatgtctggctaatttttgtatttttagtagagacggggtttcaccatgttggccaggctgttcttgaactcctgacctcgtgatccaccctcctcagcctcccaaagtgctggaattacaggcgtgaaccactgtgcctggcgaaaattcttttctttaagaatgttgaatattggcccccactctcttctggcttgtagggtttctgcagagagattcactgttagcctgatgkgcttgcctttgtgggtaaccygacatttctctctggctgcccttaacattttttcctttatttcaaccttggtgaatctgacgattatgtgtcttgcagttgctcttcttgaggagtaactttttagtattctctgtatttcctgaatttaaatgttggcctgtcttgctaggttgggcaagttctcctggataaratcctgaagagtgttttccgacttggttccattccccctgtcactttcaggtacaccaatcaaccatagatttggtcttttcacatagtcccatatttcttggaggctttattcattccttttcattcctttttctctaatattgtcttcatgctttatttcatyaagttgatcttcaatctcttgataccctttcttcagtttgatcaatttggctattgatacttgtgtataattcacgaagttcttgggctttgcttttcagctccatcagatcatttatgttcttctctaaactggttattctagttagcaaattcctctgtccttttatcaaggttcttagcttccttgcattgggttagaacatgttcctttagctcagaggagtttgttattacctgtcttctgaagcctatttctgtcagtttgtcaaactcattctccattcagttttgttttcttgctggcaaggagttgtgatcctttggaggaagaggctttctggtgtttggaattttcagccttttcatgctggtttcttctgatctttgtggatttatttacctttggtttttgatgttggtgaccttcagatggggtttctgtgtgcacatcctttttgttgatgttgatgctatttgtttctgtttgttasttttccttctaacagttaggcctctctactgcaggtctgctggagtttgctggaggtctactccagacccagtttacctgggtatcaccagtggaggctgcagatcagcaaagattgctgcctgttccttgctctggaagctttgtccyagaggggcaccctccagatgccagccggagctctcctgtgtgaggtgtctattggtccctgctgtgaggtgtttcccagtcaggagacacaggtgtcagcgacctacttgaggaggtggtctagtctgacccttagtggaactcaaatactgtgctgggagatctgctgctctcttcagagctggcaggcagggacgtttaaatctgctgaagctgcacccacagttgccccttccctgaggtgctctgtcccagggagatgggggttttatttataagcctctgactggggttgctgcctttttttcagagataccctgcccagaatgtgggaatctggagaggcagtctggctacagtggctttgctgaggtgtggaaagctctgcccagctggaacttcccctctgctttgtttacactgtgaggggaaaaccacrtactcaagcctcagcaatggcggacacccctacccccaccaagcttgagtgtcccagttcgacttcagactgctgtgctggtagtgagaatttcaagccagtggatcttagcttgctggactccatagrggtgggatctgctgagctagaccacttggctccctgacttcagccccctttccaagggagtgaatggttctgtcttgctggtgttacaggtgccaccggggtatgaaaaaatactcctgcagctagcttggtgtctgcctaaacagccacccagttttgwgcttgaaacccagggccctggtggcataggcacyggagggaatctcctggtctaaaggttgcaaagaccgtgggaaaagtgtagtatctgggccagaatgcaccattcctcacagcacagtccctcacggcttcccttggctatgggagggagttttctgacctcttgcacttcctgggtgaggtgatgccccaccctgcttcggctcgccccaagtgggctgcacccactgtctaaccagtccccatgagatgagctgtgtacctcggttggaaatgcagaaatcacccacgttctgcgttgatctagctgggtgctgcagaccatagctgttcctattcagctatcttgccagcctctcttgaaaagagctacatttttatagtcatgtgtcacttagcgacggggatacgttctgagagatgcttcaaggtgattttgttgttgtgcaaacatcatggactttatttaaacctaaatgatatagcctgctacacacctaggctatatggtttagtctattgctcttagcaacaaacatgtgcagcatgttactgtactgaatactgttggcagttgtatcacgatggtaagtatttgtatagtttaatatatctaaacatagaagaggtacagtaaaattactgtatggtattataatcttatgggaccaccctcatttttgtggtctattgtcagccaaaacctctttatgctgcatgcctcatgtgactgtatttgatttatgtattttgtttttttgtgctgtggcttcatgaatgacctgcctgtgtatttacttttaggtccattgagtgacatatattcgttttcaggataacataaaattattttcattttattcagcctcacttttctcaaccataaatttagggctgtctcatatcaccaaaggttcttctgtgactaaaattctgtattgtgattatggataaatgagtctttcaggattcagaatcacctcagaagacaatactgtagagaaatcaagtatatttaatcatacaactcatgtgtaatccttttagagaatattttgatgattttagatcaatttagtaatgcaaagttggacaaacagaaagcagctgcccaaagatgaaaactcagcctagaataactgatatttctaatcaggggtataaatgaaatatgagaaatatgaaattttctttcataaaaatgaattcatattgcttactatatatttggaattagaatagcaatctcaaatgctctgctgaagggaaatttaaaaattaacacaacacattttattaatatattgttcatgtaattgcatatattaacatgtaatctaggtaagttttattagaaatcgtgtgatggaataaatattaggtaacattttagggctagaggaaataatgtgtgttcacttggctgaatagaatgtggagcataagtggggaagtttttgaaaaagtgctttttatgaagtttaaagttcttagaatgtgcatatgttttactctattatgcttgttacgtaaagaacatcctatttaatacatacaaacaaattccatagacagatgttccctggtgacagaaattaaacacctacagaagttgtttgtagcagggctgcattgacataatagccctctttgagtggagcctaaagcaggaagatagcttaactgattgaaccttgtggtttcactctttagacctgcttggacaaacaaggaggtcagtgtgaaaagtctatttgcagattggtctcagaagaaattctcagaagtgatttttttttaaagccaaggaaaatagaactcctgtttttggtgcatatgtcacagctgagcctttctgtttgaagagcttcatttaataatttttgccttttggagtgtaggygctagactatatcctagacactgtagcattgataaatgttaacatacagaggccgcgtatattctttgcaccaaatactttccttgttcacactgttctgtcacaaatctttttcacagggtgaggaagtgttttatgggaggccaagctactttttaaaagatggtatgaaaacatgaattgaaatgtattattgktattgktattattgktgkgtagtaagtcctaacttaatggaaatttttgtgttctggaactgtaagcaagttttgagtccattggaagtagaccagattttgatttataaaaaatatttggaaaaacaattagagaaattgtgattgagataattgattccaggcaatagcttatgatgttaaaattctgtgcaattacatagaatgtatattaaaatattgctcaactgtttaaccatcagtgaatgaagggagcccagaaggtctgtttagtcttaagtaattacagaagacaacttgtgtgttgtaaagtgatttttccacttaataactttggtaaagaactattagggataggagacttatatcatgctactgctggaattattgtaattaatttttaaatgggaattttatctaataaatcccagggaagaaaattttattttgaagcatgtctttcctatcacactcattattggctttttggaaaattattttagacatgtgtttgatttcatatttctgatgcatatcttagtgaatcaaaactgacatacattgccgttttagttggcatttactttactaaatgattggtacatttactaagtttacatgttattgttttaaagcgacagcaggcttaacttgagcatcatggctgttgcaggtactagggctctcgcctttgcagtaggatgaatatggtaatgacagtgcaagagagattccaaagacgtatatctcatcgctaactctattttagccctttgagctcgtcctttagttagaattttaagtttctctagggtacttcttaggcttcttttgctgtgcacagtgccctctcttaattaacagcagagtaatattgggcaaatgtctgagagcatcaatatcctcatctgtgaaatagtgttaataacatatatcacagtgtagctggtcagatccaaatgagaaatatttagaaagatttttaataagtaaacaagtgtttagtaaaacacttttwaaaaacatctttcaaatgttatcttagttcactttaattagcaagttgaatcaaactgacagtctctttggcatttggtggtgttctagatagccagtagttactattccgttaagttcctctgagactgtagagaaaaactgtacattttgatatgttttgttgaaaaacatttttgtaatcttttaattttttttttaattttgcacagattgagatcagggaaagagactgacatatacttttagatgtctgatttcctagaggcaaatattttggactgagttttcctgtccaagtgttagctctgaagttcttaccattataatgacaacaaagaaaaaagaggtggtaaccccaaaaagaacagggagcaacgttgcctacctacatgcataaagctgccagtaatttgatcgactcaaccaaagagatagaaaaatttgaagtcagatccactaaatctcttactcttcctttagaaggcataaagtatatttcacccacatagcgtttacccaagggtgatattccaaatatttaacaacctatgtggcataggcaccaaggattcaggactggaacagcatactgggcctgccctttcctcctggggtttcgctctttagttgtggagttgtggggaatwtagggcaggtggcttattcagggattctgggagaggagactgggaacctcgtgtgggaaaggggtagttgggccctctattaaacagcagctgatggccaagtagggcagaaacccatgtgtgactattgaawatcaaccttgcgtttacctgaatgtgtctacccaaaactggattcataatactggttttcaattttgtcttatggaaacttgttcttccttttgtttactttaatcagttgtaggagatagttgaaggaataacttaatataacatttaattcctaacgttggcagctgaatgtataacttagatgtaacattaaatttctaacatttttaggaaggtatacagaaagcgttacctctaataagtaaaaatataagttctgggaaaattatttaaagaaaccctatttggaatcctttcataaagtgataattttaatttatcttgggcataatattggatctttaataaaatctttgctgtaaaatcagtattatagaaactggctaggcacagtggctaatgcctgtaatccgagtactttaggagtttcaggtgggtgggatcaccttaggtcaggagttcaagaccagcctgaccaacatggtgaaatgccgtttctactaaaaatatcaaaattaactaggcctgatggtgtacacctgtaatcccaggtactcaggaggctgaggcagacgaatcacttgaacctgggaggcggaggctgcagtgagctaagattgcatcactgcactgcagcctgggcaagagagtgagatttggtgattcagtttcaaaaaaaaaaaaaaaagaaaagtcaatatagaaccttaaatagtatatagtttttgaaggactaattcatatgtaattatggaaatgggaagataaccttaaattatttcaactagactggtccaagtcatctgtagtcagtcagtcagtcactcagctagtaaatgcctgaggcaaaacctcggatttctgtttcctrttatttctactgtaccctatctgtattcagaagtgatggtctattttataatctgtctgcttcaaatcactttggcaaccattatgatatatagccttttgagatatgtagcatggattttattgtttctgtttgaaatttggggaaactgagtcccagaatttcctggttttaggtcttatttcacttgtcatgctggtggatgtcaaagatgcagtttwtcaccattcctgtgtagctagccaaaggtatccatccgtgcttctcttggttgcataaaattatggtgagagttagtagatggtgcaggttcatggacgatttctcaaaatgcattttatgaaaacatgtcacagagagagaaaacttgatacttgtgtttttactaagacataatctttttttttttaaattgaatgagaaactgagatctagaggagcaagctcactattcaggaagatttactcatcaaactaagggtaggaatagtaaaactaattgaatcatttcccccaaatctacccttatctaaagcttatttcttcagctttagctggtcaatttctagaccaatgcccccacttccctgtaaccttctctggcaaaagcaatatatcttattatattctaccccacaatggtgagtctgactctagaacaacaaaatggggaaaatctgaatctagaagttccatttttcaggagaatctttattttgggctatatagcctgtgttgtctggaaaattgtcactgagttcttttagtacaattaagacagtctgctatattacaaaatatatacaaaagtgtgtaaaactgtcttatattgtgtataattacgagtaattataaaataaacacctgtgtaaaccacctcctacattaagaagtagaatattgtcttcacctcagaagtctctaattcttagaggtaaccactgttcctgatttaacagtaatcattctgttacctttaaaataatattatttaatgcattcctaaatagtagtagtataccttactctttaatttttaattttttaatttttttattttgagacagagtcttgctctgtcgcctgggctggagtgtagtggcatgctgttggctcactgcaaactctgcctcctggattcacgccattctcttgcctcagcctcccgagtagctggaactacaggcacccgccaccatgcctggctaattttttttttttttttttttttttagtagagacgggttttcaccgtgttagccaggatggtctcgatctcctgacctcgtgatccgcccgccttggcctcccaaagtgctgggattacaggcatgagccaccgctcctggcctaattttttatttttaagtatgtgttcaagtcctttgtctatttttcattctagtgagctatcttttcttatcagtttgtacaatttatatatgtagtttgactggaaacctaattgcttctatgggtcacagtgtcctgtctcattctgcaccatgtcttttcactcttcattatgttttctgttgagcaaaagttttttttcaatttagccaaatttatcagttatttccttgatggttagtgctttttgtgtgtcattttagaaatctttcccacctcaaggtcatgaagatttttctcctgtatcctaaaagttttatattttgcttgtgttcacattaagtcctgaaaacttacctgaagttgatttttgtgtgtgtcagagaaggatccaattccatttttttttccatatggacatctagtggtctcaatattgtcattgaaaagtctgtcctttttctgcttctatgaagtgtgccagttttgtcttaaatcaatgattcatatatgtatgggtctgtttctaggtttttctggtctgtcccatttgtcttttgtttttgtgatgctatataccaatgctgcactatcttcattgctatttatttataataaatattcatatctcataaagttcttacacattgttcttcaaaattgccttgttttttattcttggccttttgcgtttgcatataaatttgagaatcagtcagtttccacagaaacttttttgtgaatttagactgggataacatttagtccatggtaatttggagaaaactgtcatctttatatttactcttcaatccatataaatagtgtatattttcatttatccaggtctttttaaatgtctcaataacattttatgaagttatctttagagatttttgtatgtcctttgctagctgtagtcccatttagcaagatttctggtatacaagattaaaataaaaattagttatatctatataatatcaataaacataataacatttttaaaatacagcattaattaaaaaaatattctaagcaatacaatagcatttattctaaatatatttaaaattaaggtgtaaatttctcacacatcgtgttttgtcctttgtttcttktttgagactacaacctctgcctcccaggttcaggtgattctcatgcctcagcytcccgaatagctggaattacagccagctaattttcacatttttagtagacacagggtttcaccacgttggtccagctggtctcgaactcctgacttcaattggtctgccagcctcagcctcccaaagtgcagggattacaggcatgagccaccacacccggtcgtattttgtcctttgaactctaaaagtttatggtatttgagtctacaaatacagtagtgctgcatttaccaattatttgtacatttgtatcaattattcagaattatggaatattctagtttgagaagtaagagatacttgattttatagtgttaatagcaagaaaaaatrctttactttcttgcctatatttttgtttaatctttttaacaaccttaagagtagagcattatgatttctgttctatagcagatgagacctaaatgcagggatgttaattaatttgcacaatatcacagggctagaaagttgtgagtaccatgatctgaaccaggctgtgtttaacaccaacatccatgatgttttcactataatattttgccacatatcaataactcctgagctcagtgcagtatttcagcatggggatggtaattgattatgataatgagaaatctgaagcatcaaaagactaattaatattcagtttattctgttttattaggcgtaaaagagggtactacatttttcagatttctattcaaaacattaaaatcaaagtttaagcctgctgagcttcaattaatgattcaaattaattaaaaatatttttcctatagtaaagagaacatataatgcatgaatgtagtactcattaatgctatatatttgttaaaatagaaaaatgttttatatttaaataytccacattgtacatagagcccaattttttagcataggaaaaaatgtgaaattttagcttatatttatatatcttttctccttctgtcagtgactgccaccttgccaaatctgtgggagttttatgatctgttatcctctgagatctgtggattcatttaacattttgctgtgattttattggttttggaatcaagaaccaaaatctgaatatagttcactattcatataacaagatttaaggatgtttagtttttaaaagttcttttggtccatattagatttatttctgtttgactaataagtagatggaggaaaaagaatcaaacactgcatatggtttctggaggtatgttttaataacaaaatcaagtctggtcaatgaaagctttcagaaaatggttttataaaaaaaccttgcattctttttagatcaagagcagttttcccccaaaccttaatgtcagtcgtacgattttcttcttcttattttctgttctccatttttgcttatttgttgaaaacattttttagctatgtggagacttgcctgaatgctgtctcctatttaggtagaggccaataagatgatagctggaaaagcttcgattgtctrtcatgaagaccaggatggaataaaagaaaaataagtaatgcagttgtgatattctgcagtatacttcggctctcttaataagatcatgctgtaagcagtgtcttttaactgaagcttgcaacctgttggtgggtcatgaagtagattttaaacattgcaattagcattttatttaatgaatagacatagaatagcatggaaatttaagagtgactatagacttaagagaattgtaaataggacaagtaaaatagaaaaattaatgtatcacacataaaaaggggattttcatgaaactttagtattagttccacagacacacagatacatcaaatagcgtgtgagtcaggatttagtccaggaaacaaaaattacatttatttaaaacaggaagatatttaatacaagagaatttgatgcttataaaatagttggaagatctaagatatgagttctaggctgttcttgctggaatgactttagggagtacagaaatgatccacccaagagccagttatagctaatatggttgctgcaactgtgwgttatgaatatactcctcttgctgcaatccagtaatcaggaagccagagttacactgctaatgctgtagtcacaattgcctcttgacacccagaaaattggaaagtgccacaaaaagcactgctaacaccttgcatttctttatctttgtttgcagttaaaacagtygaaaggatgtaggaaaatggcttctgcttcgcttctgtgttcattatcttagatgaattgcttctaatttgcagaagcgaattctcatccagaatttgaactgcaagagaaatgttttattattgacctctccagtgatctagactgagggtaggagggcagataagagaatccatacacactatccaactcagttcatcaatttgatttctcaccactcacactcactcttccattcatgcttaagtttccaaatggcaacactagtggtgaaaacatgctgctgtcgttcatacacaggaaaagtagttcacttctcctccaaagtgagtgagagcaaagtcactgtacccagtggagagacttttctatcccatagagatacatactgaagtattcgcatattgtctgggatttgctttaaagtactctggaaaaaaaagagggggagggagagatgagacttcatggcagaaatgttgataattattgagaatcaattatgagcatatagtggtccattatttttctctgtttttgtatatgttggaaaatttccattattagtaatggaaattttatatataaatgtatctgcttttctttaactgaaaaaaattgagataactatacaaagaatattgattctccttgttttctgaaatttttaaattagtgattacattcataaatataaagcattgtcactcttggcctgttattttaaaatgaaaatgtcacctggagttatgataataattattaggaccacatgtgttatgaccaaaagtgatttcatatctattttaatgaattaggattagaggagttaaataatcaacttagtacatctgaaaggttcatggctgaatcttcttactctaaataccaggtttgcactattgtaatatccttaagttgctctctatcattagcacctttgaatatgctctattcatacattttctttccttagcccttgttgagaatacaaatctgaaagaatgctgtgtgtgtgcgtgcgtgcgcgcgtgtgtgtgtgcgtgcacacacgtgcactttaacactggattaatataaaaattagatattgagtctcccagtttcagttctgacattttragatcaaggaagttgttaatcttggctaggtgtggtggctcacacctgtaatcccaacactttgggaggccaaggcaggaggattgtttgagcccaggagtttgagaccagcctgggcaatatagggaaaccttgttctacaaaataatttaaaaaaaaaaaaaaaagctaagtgtggtggcaagtgcctgtaatcccagctactcagaaggctgaggtaggaagattgcttgagcccaggagtttgaggctgtagtgagctgtgattgtgtcattgcactccagcctgggtgacagaacaagaccatgtcttaaaaaaaaaaaagacgttattattcacatcgttagaacaagaaaaaactggacaaactgaaaaactagtgacttttcttggaccctgaagcagatatttgaggttayagggcaaaccccctccctgaaatctggagacaggtgcctccagagagtctcagccaagatctatttacctggagaagaagctgctagagtcataaactggtaggaacagtttaaatggcaattttgataaattgctgaagactaagtattcagcagggtgtgacttagaaactcctacctacctccccaccagtgttcatgggctttacctataaggaaccccaccagtttctcacagatgatctgagaatgattccctcatggccctggtgggagaagtggacaagtaatcatcctaaaatgtacccagagcctttttttaataaaatgtccacactccagggtgaaagactgtatcagagccttgtgctgcagccatgggagtaggatattactgcctgggccctgtagccttcctgcttcactgaaggaattggaaaaaacaattcatgaaaaaacttgtaaaggtcacaggctagagacaaagactcactaaaagacattctgtaatctctgattaaacagaggtttagtataatcagagattatagaatgctactccttgcccccatttcactatcacactggcacgtctccagtttaataacagcagatgacagctgaaagaacttcaagacacaaattccctccgaggaagagtacttaaagaaacccatagttaaaagggaagatgaaaacaagggcactgcagaaattttatacctctagcaccctacagcaaacgttagacagcccaacacatagccagcagaacataaatcctcataccaaaagcccatgtacctcattcctatttcccattataacatgtccactttcaacaaaaacttataaggcatgccaaaggcaagaaagaacacagtctgaagagacaaagccatcatcagagcccttatcatagatgacacagaggttggaattataagacaggcagtttaaaataactgattaatatattaaggactctaatttaagaagtagacaacatgcaagcacagatgggctatgtaagaatggagtcgaaaactcgaataaaaaattaaaaggaggccaggcacagtggcttatgcctgtaatccagcactttgggaggctgaggcaggcagatcacttcaggtcaggagttcaagaccaggctggccaacatggtgaaaccccgtctctactttttagttgggcttggtggtgtgtgcctataatcccagctactctggaggctgaggcaggagaattgcttgaatctgggaggcagaggttgcagtgagccaagatcatgccactgtactccagcctgggcgacagagggagactacatctgaaaaaaaaaaaaaagtattaaaaggaaatgctataaatcaaagacactgtaacagaaatgaagaatgccttcagtgtatcaatagacttgataaggatgaggaaagaataaataagtttgaaaataggtcaatagaagcttcccaaattgaaatgtaagggaaaaaaggaatgaaggaaaaaaaaaatcagaatagagcatctaagaactgtggatcaatttttaaaggtgtgacatacccataattggaataacaggaggagaaagagataaaggagaaaaatatttgaagtgataatggctaacaactttctaaaattaatgacagatagaaacccacaaacacaggaagctcagagaataccaggtagcataaatatcaaaacaaacaaaaaccaaataccaacagcccacacctgagcacatcatattcaaactgccaaaaatcaaagacggagaagatcttgaaataagagagacggtggaagatacatctatcctatagaggaacgaggatcagaaaggtggattttgaagcaaggttgcatatattctatgacatgtaattgtaccttcaatttcacatagatgttttaaacacctaccatatagcatgttttatgaaagataatacagataaataagacctaataacttctctctctcccccagtcaaataactaaaatctagtagaagaaagtaaaaaaagtgtataagtaaaaatataacacagattttaaagtatcctagggaggtaccaaaaaaaaaaagtgctataagggatttagaggaggaaaagatagcatggctgagtcagtaacggctccatgcatgatgatgttaaggagttattttacttataagcagccagcatcctttgagaccagcctgggcaatatrgggaaaccttgtttctacaaaaaaaaattaaaaataatacaggatattattttaataataataatacaggatgtactcctgttgcccacaggagttgactcagaacttgacctttgttattttcctctcgtttcttgaaatttgtatcttctcccttactcaggttattttgctttctgttttactgagaaaatagtgatcatagagaacttaggccatctttatctccatcctttcccttgtgccacatctagatttcactaggcacttttcattctctgaagaaattgtttaatctactctcgaattttagttactggcttgtcttgcatgattattttgatgatctgttgaattttttccccaatactgccctcccagcataatatgcattctccatgaaagagattaatcctctctctccctgctgaaaatcctctacagttctcaccttggcctccagaataaaatctacctctttagcctgtctttcaagggccttcttattctgccccaaactatagtttgtgatttctgagaggagatatcccatgaaatattttccaaatttatttgacagaaatatccactttgtatctcctgggtctctaatgttttgcagagtacagtttgggaaatgctgggattgaaggaagaacgtgaacatttgggaaagggaacaggagggaaatgcatgactaaggtcatcttagtagtaatgagcatggagaatagcccagctgcatatgaggttatgacatacattagtagacgaatctcaaaatgctgatttcttctccaaggtttttagaatgatcccctgcgtctgtttgtaatctgcagagactgtcatgcagaaaaataggaggaaaaacctttccgctctgaatctcaggagaaaaaaagattttaatcatgtttctggaaacttgcattggtagaatttaaagtcttccagagagctcagttttatttcatttgttatcatatttcatcttgacaatgtaagtgtagattgtttgacaaatttaagaagaatgtgttttcatttcttatgcatttttgtgcagcttttctatagcctccctaaatactatttgtatttatccaattgtcactctaaaatatgaatgtatacttgttaatgttcctattgcaaaggctgtgcttcgttcagttttcttttatttgtagtttctcgtaactagaaatctcatgcttttctgaaataggaataattgaatatttattgacatgtccttaaggagtactatatcactctgaagtgacttatggcacatcaaaaatattaactatacattattactatacattattttacttattattataatttaaaatttcattatttcctgaaaattttttcagtgagacttccagaacctgtgctggaaggataaatttgagatctatttgcacactaggtggtgcaaatagaagttacaacactttacatggcacctttatttaatcagaggtcaaaatacatggccagtaatgtagtacatccttgggaacaggacattatttgcttcactcactggtggggagagggtcctaccatccatctcgaggcscttgggcaataggttttacttgggaaggtgatgtcagggaaggcaggtagccaggtgtgcttttactgccctcagggagttcctagtctacttgtgcatgaaatagacctatatgtaagcatttaagatgataccaaaaatattccgttttccaggaggtgtggagttgtgagtagacaaggaagaataagcatttaaggaatacgtgatactcatgcatcatgtgcagtgcaatgggtctttttctgaaattttgtctacacaacctaaaattcctacttatgctactatttttaaaaactgatatgttttattagaagagtcagatgacatgtctgtttagaagtagaactttttatatcaaatgaatttaagaatgctatcttatgaccttgtttttgcatgaaggcatctataccatttttcatctcatcaagtgaaaataccaaattttggtaaagttgtacttcatttatgatgccttgaaaaataaaccatacacgtgattcatttattacacatttaggctgttgatagtgtgtcagttttattatgcaaaataatatctttctgttcaacacacctgctcttcacaggtgtatattaatgaggacttcatgatgtgttgatctaaagtaaaacttcttgtcgatgttgaatttagtcaataggttatttttatgctcaagaaaaggtgaaagatatcatcaagctgacaaaatacaatggtttttgtatcatctacatgttaaaataaatttcatgttttgaaataatccacacattgaaataaacagagtttagctgatgactctcactttgaaattttatttttctggtacatctaaaagtatatttttgttaaaaaaaaaagtccctttaagacagattttaggtactccatttgctacacaatttcattaacttagaaccatatttttaaaatgttttctccacacaagtaagatacatayggaaaatttgctactatgcagtccctgtagcatatataaaaaatgaggctgctaaattaggtcttttcttctttaccttctttaaacctacgttattcttttgtgatatttccatcacttaagggaatgagatttcaaattaaattctagagagacttaaattccccttgagttttcttttacttgaggtatgcctatgctatggggtaattagtggtacctcagtaggataatataagcagagtggtaagacatatctgccttgaataactgtgtgagaaaaaacaggcacatttcactaaatacccttgcttgtgctttctataaaattaaaatattttggacagtaataacatacaacacaaatgaataaaaacttgtacatgatgttttgtgtggagtcctgataagtaagcaacaaggaggaagggccccagatggggaagaacagtgaacaactgttctgagagatggctaatcacaaacaacacaagggcacagtgatctcgacctacttctgcaggcacagtgwccttgttctccaggtaccccctctagcatgaccctgtaaaacttccctccagcccctgcatctttgcggacagcccccttctctgctgtgctgcctgtcttacaacatattttcatactttctctaataaatctgcttttctttatctactattgtcttgttaaatttccttactgcctgtgccaccgggcccagatagtcactagctggcaacatttagggaattctaacatcaaattcctctaacgataaactgttaaaacatcatctctagacccagtcttaactttcctcttactggctactccatgccatttgttttgtactctgattcttccagttctgtcctgaaatacctaagcctcttgttcattaattttcttagggtttaaagtacattaatatcagaaataagattagtggatcactccttagtttgatcaagatttaaatccttcttattgcagaagcacaacaatacattggagaytgcttcaaaactcaactgaaaaagagaaaaatcaaaagaagccttaggctaggtgaacaggaaatgaggcagttacagtgttttagttgtttgtcctttatttctggagggggtctgccagtggctgttctaactgctycctcttgcctcagatcttgaaagccacactttatccatcattctcacctatttactaaaaagaatgagccacctgaagggacttccctctactttctcctcctctaccttaactgtggctctttatactcttttcctcctgtgtttcctctgctttatgtaagtaattgaagtttaaaagaaaaaaaatatgaacatttttgcccatgcagtatcatttgcaagatcaggaatattatctcaagtttctaacttgaaagggtctaatgagtctaaaagagaaaaaagctgaaaatgtcttgaaaagtaagggactatacaatcaataagctgatattattaactatttttttcaggatttttttttttttttttgagacagtcttgctctgtcatgcaggctggagttaagtgacacaatcaaacctcactgcagcctcaaactcctgggctcaagcagttcttccaactctgcctcccaaagtgttgagattacaggtgtgagccaccacacccagctaattaaatatatatatatatataatatatatatatttttttgtagagatggaggtgtctcactgtgtggtccaacctggtctggaatgcctgcgctcaagtggtcctccctcctcagcctctcaaagtgctgggatttacagagtgagccactgtgcctgacctcagtctttgattttgacatagtttgacccagtttttgttagtggaataggtttggttttaaaaatttaagtggtttcagtaaagggcaataaaaatgatgaaaataatagaaaatgggttctaggactagagttgaaaaggcttgggtcttcattttgtccttagaaaattaggtaagatgattgactccttttaactccttcaagcatgtgaaataatatatttgttagtggtggcaaatatccgagttactggcagcaaagctatacgaatctatggcaacctcaattcttgcttcctaagaagaaataattcgaccgaggggcatgcagtggaaaaagagaccaaggcaagtttccgagcaggaatggaagtttattaaaatgctttagagcaggaaacaaaggaaagtacacttggaagagacctaaacgggcactttggaggtcaatggtggcgtatgaccttttgatttggagttttatatgttggcatccttacagggccttgtttaccttttcccatctcttagggtgggctgcccgcatgcgcagtggcctgctaacccttgggaggtgagcatgcgcagtgtgtttaagaagttgtacacatgctcacttgaggctttcttccctttttcagtggaatgcccctggaaggtcatactctgccattttgtctcttaatgcacatgcccaagcctacttgcccaattcctgagctgccagttaccaatttcaagtgtttttatctattgtgaaattgcctctttttggcgcctgtgaccaatgatcatttttagagaagtggtgtgtcaactgtgggaccatcacctgatggttgcctgacatttctagtgggcgaggggagccctcttctgccctgctcatgcctaactacctactgtatggttgcctgacatttctagtaggcgaggggagccctcttctgccctgctcatgcctaactacctactgtaatatattgatgcaacaaaaatcaaatggagaaaatgggcttataatggagcaacagaaaatagttaattataatttctgaatttaacgggttattaaacacataccaggctactaaagaaggctgtataattatcagtgttgagtatcattaagattaggtagtatttcttttcttttgtataattatcagtgttgagtatcattaagattaggtagtatttcttttcttttttttttttttttgagacagagtctcgctctgccgcccaggctggagtgcaatggcacaatctcggttccctgcaacctctgactcctgggttcaagcaattctcctgcctcagcctcccgagtagctgggattacaggagtatgtgccaccacgcctggctaatttttgtatttttagtacagatggggtttcaccatgttgacaggctggtcctgaacttcaagttcttggtcttggacttcaagtgatccatctgcctcagtctaccaaaaggctgtgattaccagcatgagccaccatacctggtcaagattaggtagtatttctattaaatgtttcagatattgtattttctaaaagcagataacccgatggcctttggcattgcctaaaaccttttggactctgctatttgataacacggaattgtggaatatcatatgaaactcttatttttctcttctgttgtatttaaattctttcttaatatgcacattttctaagaagatactttttaagagagaaaagatagaggcctgcatgggtaatacttggattgagcccagggaattctctgtcatgcattttagctatggggacatcagctgctacttatttgctactgatttctcacttccttctttttcataccagctttcaattgcttgtttctaaacaatgcgttatctttgattaaattagaccagtaataaaagctcgtgaatccttraatgaaaagcacacattctggtcttcttgaccctgcattccaaaattattctctaatgtttataaccaccttggtagataaagtcttctttttccttctcagagaaacggtttgcagccaactgtgaccactaagctaaatctattgcggtgtttgtaattgaaagctttttgtatgtcttggttgtggtgctgggctctctcctggatttgttgatttcaacaatggagtaattcaggagaacagagagggaccagttagagctctccaggttctgtgtaacacacaccatagttggcagcagctgagatttgcttcatatttatctctaagggcgttgtggtggttccagccccaagattaaagtcagcatgtcatctctttttattatttcgaatggctttttacttttatagtatacatgaataaattttatcagcagggactattaagcagtgtttcggcacaaatgctttagagtacattttttagttgatgtgtactatgccagttatagagagytgtcaatacagtttcagtcttcagtgacaaaatctatcattttctaacttgctagaaacctttctttttagaaattcactttttgagacataatggcttcaattctccaggatctttttctgtctgttttgaatgagcttattgtttattcacagtaaagaatgtttctgatactgctttgttgtaaatatagttgagtgccctagctgacatccttgttgagcccaaaaagactgtttgagtacactttttgtcaggtggtacctttgctgaaactgaagaaggagattttgaagaattttcttgatttcaccagattattttaatggccttaaattttccatttaaatttgcaataacttttgccagttatagagagtgattcattggggaccactttatcttttgcattgtggtatgaggcacagatgtaaaggggacacattcttggggtagctttttctattaggcctttgcagttggaagtactccatatagaaagtgtttgaagtttttacaaaaatgtatgctgtaggctgaacagatagaacaaactataagtataaaaacatgctggttaataaatctttcctgtttttccttagacagaattcagttttatttgtattattaaacaagagtaagactttaattatactttcccaagtagaatatttattttaaaaaggaatagctgttaacagaataagaaaacttcattatatttttaattactcatctaattttatgtaaaatgaaatgtacattaaatggtagtacataaagtccagcataaaactgcctatagtacaaatgttgatatttatttcttgttcactaggatgacaaaaattgagagcattttctccttaatagttagcatctattaagtctaatttatggcttcttgtaattcattcatttatcatttttaagtattcattcaacaaaaagttacataacaaagttttaagataaacaggatcagatcatacttagcctcaaagaagtaatctgagaagtttggatatgaaagataaggaaatactatatgatgagtacaataatagaaatattattatagcagtgtcttggaagagcaagtaattggcttgagtagttaagggtaaattttctggagaaattaacgtatatactggtatttttttttaaccatgacagcgttttgttgttgttgttgttgttgttgttgttgttkttttgagacagagtctcattctgttgcccaggctggagtgcagtggcgcgatcttggctcactgcagccttcgcctcctgggttcaatctattctcctgcctcaacctcccaagtagctgggattacaggtgcctgccaccacgccgagctaattttttgtattttttttagtagaaacggggtttcactatgccggtcaggctggtctcaaactcctgaccttgtgatctgcgcacctcagcctccgaaagtgctgggattacaggtgtgagccaccatgcccggccctatgacagctattatttttaattactgtgtttttattgatataaccatttatataagtgtatctgttatttgaaattatttcagttatatctataaatttacaaatactgagaagtaaaaatgacttgggcatttcaaaatcatgttctacaatgtattgaacagttgaaaaataaagcaaaagagaataaaacaaacacaaacaagcacagggagaagtctggtcagaccctgggctatcatgcttctgtttgtgtgaccactgggtgcttkgttgtagcatcccaaacccacaccatgccggaaagagatatgcataggagtatgtagaaggtcacatgtggaataaacttcatcaacagtcacttccaggctccatatattaaaatttcagggattaagatcagaaggaattgttccaatttgtttattttggagaagaaaggtcaatttttacctccaggggataaaccactaatttgcgaagagattgggttaaaaaaagaggaccccacctacttttaaaaataggctttactttttagagcagttttaggttcatagtaagattgagtggaaagtaaagagaggctccatacataccctggctccttcccagcctctcctactgttaagatcctgccttactgtggtacatttgtttcaatcagtgacactactttgacacatcattatcacctaaagtccatagtttacattggggttcactgttagtgttgtatttttcatgggttttgatatatgtataatgacatatatccacatcatgcactgtggtattattttctggccttaaaaatccactgtgctctgccaattaatcccttcctcctgccaattgctaatgtttttactgtctccctacattttgcccttttcagaatgtactatagttggaattttgtagtatacaacctttccagattgacttctttcacttaaaatgcatctcagtttcctccctgtcttttcatggcttgatagatcatttctttttagctctgaatagtattccattttctgagtataccacagtttatccattcacctgtgggtgctttcaagttttgacagttatgaataagctggtataaacatctgtgtgcagatttttgtgtgcacataatttttcagttcatctggataaataccaaggagtgtgattgctggattgtatggttagagtatatttagttttgtacaaaattgccaaactgtcttccaaagtggctgtaccagcaatgatgagagctcctgttgtatcacgtccttagcagcattcggtattgttagtattttggattttggctattctaatacatgtagtgggtatcatgttgttgttttaatttgcagttccctaatgacatatgtggagcatctkttcatctacttatttaccatgtgtatatcttcattggtgrgatatatctgtttaatcaaattgattgttttgttattgttggcttttaagaatttttaaattactttagataatactcctttatctgatacctcttgtgataggcatatctgaaggatgtgttgccatccttcaagataagaaatataaacaagaggctgggcttggtggctcacacctataatcccagcactttgggagtctgaggcaggtggatcacttgaggtcaagagttccaaaccagcctgaccaatgtggtgataccctgtctctaataaaaatgcaaaattagctgggcgtggtgatgcatgcctgtaattccagctacatgggaggcgaggcaggagaatcgcttgaacctgggaggtggaggttgcagtgagccaagattgtgccattgcactccaccctgggcaacaagagttaaactccatctcaaaagaaataaatacaagcaagaaagcaggctataggagaagatagtttcattataagtgtgttgaatttaaggcattttaattttataagtaggtaaggatatagacatttttaagcatttatatcatagaattttataatattgcatcattaaattttcttcttcctgctggatgtctctaaatgggggtcccatcagtgccaaacttgtttactggcacaagtaaattttaataagtccagcttatcaattctttctttcatggtttgtgcatttgtgttwtatctaaaaagtcatcactatccagagttatctagattttctcctacattgtcttctaggagttttatagttttgcatcttacatttttacatttaagtctgtgattcatttttagttaattcttgggaagggttatggtctgtgtcttggttctttttttttattgattcttttttttttctttcgaatagggatgtccagttattccaggacaatttgttgaaaagactgtcttttctccattgtattgtctttgctcttttgtcaaagatcagtcaagcatatttatatgggtgtgtttctaggctatcgtgtacaattgatctgtttgtcttctttcaccagtacctcactgtcttgattactgtagttttatagtaagtcttgaagttaggtagtgttggtcctccaactttgttcttctccttcagtattgtgttaattattctgggtcttttgtttctccatataaactttagaaccagtttatcaatatccacaaaataactttctgagattttgattgggattatgttgaatccatatatttaattgggaaaaattggcatctttatacatgtcatttcagaaagaggaaatagtatgtataaatttactgaggtatgaaaaagtatactattttctggggttacccagtttgctactattggaacataccattcagagttagaagataaaactggagmggtatttagaaactcaattacaaaagatcctttatgccaaaacaacaaaaaaagtcagccatgaccatcactatttattgaacatctacagaaccagatgcattaaaattttttttttattttaattttttttttttttttgagacagagtctctctctcactcaggctgcagtgcagtggtgtgatctcagctcactgcaacctcctcctccagggttcaagtgattctcctgcctcagcttactgagtagctgggattacaggtgcacaccaccatgcccagctaacttttgtatttttagtagagatggggtttcgccgagttggccaggttggtcttaaactcctgacctcaagtgattcacctgtctcggcctcccaaagtgctgggattataggcaggagccactgtgcctggcccagatgaattttatagtcattgcctctctttactataaggaaataataaacagtcagtaatgggcttaatgtcagggagactacgaactggcttgaaatttaggaagattgttttgccaaacttgttaattggtaaaaagcaagaatgagaaagaaggcaagataagaagctattttagtagttcatataagagattatgatggcctgaagcaagactgtgatagagggaatggagaaaagtggaaggattgaagagttagttagaaggtggcaggaatctaatggttgaaaaggaggagttaagaatcgtacccaggtttctggctggggagccccgtggattgtgttgccatccttcaagataagaaatacaagcaagaaagcaggctataggagaagatagtgagtttcatgacagatgtgttgaattgtaggcattttaatttttgaagtaggtaaggataaggacatgcttaagaatttatgtcatacaattttataatgttaagtcattaaattttcttcttcctgctggatatctctaaatgggagggccttgtcagttcctcatcttctctccaaagccagatttttcttctgtgttcccagttttagttattggcatcaaccaatagtcaggaacttaggacagcaatcttgaagtcattttcaatgttctgtttccctcaccttatgtgtccggtcagttgccaagtgccatcaattctaagtctgcaatatctcttttacctctgctcatttctcttgtcgttgtgtctgctctatatcatgctctcatcatttctaccctggaaaagctcaaaagcctgggattctctgcatgcctctagtctccccttcttccagcctattattgactaagcccccagaacaatcttcctgtgtgataaagcatgctgccttcatggagcctgtttcatttctttgtattaatagtagcattggtgggacgacttccctccatcctcactcaggggaagtttcattaaaatgttgttcacagttagggtctctctgtgttgagatggatgtgaagaaactcattgttaaaagaaaagcmaataaagtgattaaagttttcataaaatcaaatctgaaggaatgtaatagaaatgggttatggctttcatcagtaaggtgttggtatgtgcttgtcagttttttacaaagcagagggaacagggaatagagtgaatgtggaacttgaacctcacactaaggaagtttttgtataattttcccacaatgcaactggctctggggaaatttcattcatgtacacaaaagaagtattgcagcaaaattcaataaggttttaagtaagtttcttaacaccaataaaaataaaaatgctagataacaggaataacaatattggaaactgcgtagaaagcctattcgtagatgtaattttacttttgaactatgatgggagagggggatgaaagtgaagtccaatactcaattttggagagggtgcttacaacttggattcctaatcctgaagagaaggatggcagctcaatacagaatctgtttgtgaggcacttgttacattgctgtatgtggtggtctgtaaagtaggcttacaaggatcttccctcatttaggtttctactgacctcaccaaactttggtctatttgggcagtaggcagtagcttggagaaagggaactgcatgctttggaaagctccctaacaaaattcattatacattgctctatagaagtatatagcgttcagctcagacaggtctattgaagataggaaagatctgaagggcaatcacaaaacaacgtttagcctaaaaagaaagaaatgttaaatcagctaaaataagtatacatagacagtttatgttgagtatacagagaagcatgacattttagaatagatacattgataatattagattagtccactatggcttcctccagtggttccccactgtgttttttttttttttttttctgagagggagtcttgctctcttgcccagctggagtgcagtggcacaatcttggctgactgcaacctctgccttctgggttcaagctattcccctgccttggcctcccgagtagctgagattacaggcgcccaccaccacgcccagctaattttttttttttttgtatttttagtagagacggggtttcaccatgttggtcaggctggtctcaaacttctgacctcaaatgatccatctgccttggcctcccaaagtgctgggattataggtgtgagccaccatgcctggcttttattttggatttaattctatatcattaccgtacrttgtctggaactagggtgaccatttaatttatcattgaaattagaactcttttgagagtaaaaggaagtgctattactgattgtacctggagcacaggtgtgtccagtcctgtcccaggtgaagtagaaggtgtggttactggagctataaggccctatgcgtcctggctccctggtccctgcttgtccctgccacactaactgcttgttttttccatcttccacatctgacctttttctctttcttgactggtctaggtttgtacttgcccccagatgagctcttcttcccagcacattgacatttgtgtttcatagcattgaatagtatttgaaaatttttgttttatatttgtttacttgtttcttcataaaatggaaagtggggactgtgttgatctcattcattaccctacttccagtgcttagcacagggcctatttgtaatgttcaaaaatgttctttgaataaataaaagcaagttaactattttaacttacgtgatcaattcctgatgaattatatgtcatggtgttaaaaacaaagttattttaggaaaaagaaccttggtataggagggagagaaatctatgtattggattaagcattcactgactgtccttccctccttgatacttctatttccaaatctgttaagtggagataatatgtgcattgctcattttgccactattagcataaaataaatgtttgggaaaggactgtgcagagtgttagggggcattttatgactagaagtattattatatattttccattcctctccccagttaaaatattgctattttccaacctccccatttctgttgagaactctagtactgaagttttctgttgagaactctagtactgaagttttctgttgaaaacttcaaaattcttaaccctacccattcttttgttcttgatatggagttaattttataagtcctgttaattcttccttggaaacatctccagtttcagtttttattaccactacttaacacccacccctagtgtcatcacttttttctagattgctatgaaaacatttaacatgtttgttttctcttctccatcgagctcaccaaagacaggttaatcttctttaaaagtgatgtttgccaataacctttagtgatccccatagcttatttgataatatccatatttttaagcctagcctttgactttagtcatgttaattctgcatcatgtacatctccttggtttcttattagtacactcatttctgtctttttcttttgtctctcattctaccccagaatgcccttttgctcaagtaccttgtactctaggaagcgtttcctgacaatacactctaagtttgacctcaacatacgttargaatttcttgttcttattttctctcacataaaccattgcatacctatttgagcttctacctactgagaacctaccatgtgccagaataacatactaataagcattgctaatcaatacagagcaaccccaaataagtattaatccagttatttactaacttgtattgttatttaactgttgtatataaatatgtttccattataaaaatttcaaaagctttcagaaggcaagactcatgtctcatacttctttacttgcatatactattagcaatattaatttctcacttttacttgttaaaatggcatgcatattttacatttcctaaaggctgacatttcttatcatgggcacacttgatacctatggatttgtgtgctaaagaactttaatggtccaagaagttcttatctaaacaattaaattggaatgacaaaagttcagtgaatttggtatttttcttgtaatctttcattattcaggaacaagtttatagacataggatttatgtggtattcaccctgccacccaacagatcaatatgctggtttatcgtcatgcaaagataatttcagtataacactggagtactttgagcagcatagcagatatattttttcttgtagtactggttacttcaaaccctggggctcacagtggtttgaggttaatgaagtgttgcattcttattaaccatggtaatcttatggtgtcacaaaataacaggctttccttgccatatgagtttttcccctgccatatgattttgcagtatttttcagtttgcaaatattgcatgcattgtttgaccatattcccagaagttgctttgtgatagtcaagtttgcctgaagtaatactaatggcatttacagctgtatgtaatatgaattcaactcatgaaagttatcactgatctgtttaaatgaaatattttaactagtatatttttgcaggtatttgctttaggagaagctcctaagaaaaaatgattcaatcttaaaaaggccaaaatctaaatgaatatttatgtttrgacattaattatgtcattctgccagaccagtttttaaaaattatcagacacaccttcactaaactttgttagacaacttcaagttatatataagaatagattaagttattaatgtgatttactgctttaaaaattgttgaattttgatctctctctccatgacaaatgtattatttggagacttcacttagaaaagaaaaagaggaatttatgacttcatcagaagcctcattagggaatatgtttggctttcatgttgagttgtctttttttccttttctttttttctgctgttgtttgttcccaagaaattcacagtctttgaactcacataatttgggggatttcaaatactgtatcattcaaccacagctgttttagatatgccacaaattgtagttctatgaacttgattttttcccctgaacatggagaaaaagcaaataataaagaaaagaaaagggggaaaatttaaattgtctccgtagtaattaaataactcatacagccaaagtgctatattttagtagtaactaccttgtttttaatgtgacatcaaaagctgatggtttgtttctcatttagtgcagatgtgaaatagtctacatctctagaacggtttaaaagaaattatggtcatggtagagagatttaatttgggtctactccatgaacttgaggcattttccccacaaagaactagcagatgaatttaggtacattaaagaaatgattatagacagcttatacaacgtctaaaacttgggaaaccatccctctgtttaattttttaaattcctctcagatctcatttgttaataaccctattcttactcatttttattccttgcacttacccagctttctgcttgggataattttcagtgtgatagaatccacttgactccttcttcctatgccctttcagtatagtattgaagaggaattcattatattgaatgaatgttcttaaatttgtttcacttacttcctctctaataatccattttcttctcagtttgaactttaggtatgggtaatagatcaggaattggggagacctttgttctaaataattggaatgaccatatttgtcaattagagagatatgtagaccaatggttataaaccagagtactagaaattcttgtagaacatcagggaacatgtattctgaagtttgtaactggagagtctgattcagtaagtcagaagtggccctgtgaatgagtactgtaaataatcatcttaaataatactgtaaggattggtcttttgttcctttgtagattgacctcccaaaagttctacctttagttagattgtttagttgaatttataagtaaaaaataatggcttaggctaaattaaaattgttaactggactatttacagatcccttactaggtattagatgttataactgggtaagatagagaatgcaaggaatttcaatatgtttttcctggaaaaaacaaaacaaaacaaaattacacacaagaagatgtacatctgggccgaagatgcttttagagtggcagcttctttgttgtaatttgaaccaagtaaatgagactaaaggggagaatgtaaactgagaagagaagagggctgtggaatcctcaggaagtacagtctttagtgtctggttaaaggagaaagggtctgaaagggagattgtggactagttgctagagaggcaggaagaagacgagaaagatatgtcatgactatcaggccaaaggaaggtttccagaaggaaatagtcaaatgtgctgaagctgttgtaagaggtcaagaaaaatgatacaagaaaattggctttagcaaaggaaagaaaagggatgggagtgggatcgggggtggagcggggtggagtagggagaaggttcttacatcaaagctttagttttcttttcttttcttttctttttttttttgagatgaagtctcgctctgttacccaggctagggtgcagtggcatgatctcaactcactgcaacctctgactccctggttcaagtgattcttctgcctcagcctcccaaatagttgggattrtaggcgtgtgccaccacatccagctaatttttgtatttttagtggagacagggtttcaccatggtggccaggctggtctcgaactcctgacctccagtgatctacccaccttggcctcccaaagtgttgggattacaggcatgagccaccacacccagactcaaagtggtaattttcaaactttagttattcatgtatcacctccatgtgttttttttccatttccaattgccatgctaactatttttcactattttatctttacttttgtaggtattataatttcatggttaaaaaatacaaattttattaaaaggtataggctaagatttattttaccagtcatcccaaacgtcttctacccttctcctcattgattataacagccattcttactagtttcttgtgtatacttttatatttctttttacaaaatcccagagaactcttttaatagctttttagtcctgtgaaaaccccactttttctttattcacattttacggaggctaaccatacaagagaataaccaagtagtaataggttgaagtttctcagcccagactttagaaggccttgagtcagtgcatctgactgtatgatcagtttaatgttaaacatatgtcccaaaatagactagcctgagcatgaaaggtagtcctaaagttcatattttattacttcatttttctgtatctgttatttctagagcataagcagtttgtatgaggttgagcataacagaatgtatgtatgctgagtgtgactttgaaggacaaaaattttgtgatatattagtccctataaaggaacttcgtagctcaatactctaccacctagacttgaattttatttagcttccttcattcctaatgtgtactgtgtcattttgggactgtggaaaccttggattctgatctagaccttgtttcaccccttttgctttcgttttgcaagacttggaggggrgacgggaacatcaaggactctgaaaaatgtgtggttgaggtgttttgcctcagatgttgggaggggttaaggtgcgggagaagatacaggctgagagagactgagcagacaacttggcagcagtcctggaagtgaaaacactcctggaaatagactggtgattctctgaagtctaccccatccccagttctcccacacagcagaggttgtctgactctgaaacaccagctctgtaagtaccatagtgccttcactctaatggagctatagccctgcctttcataggctgagacttacttaggaaactgaaatctaaggtatccaggttcttgccacacagttttgagaggctgacaagtaagtgtcttgagttgactgaacatcctgtgctggacctctccgacagtggaagcttgagtcagccatgctttagcaagggggtggggcagatttggggatttgtataaatcaactttatggaaccagggattaaggtacaggttaggatttgaacttggaatgaactaataaagagtagatatgtaaaagaaaggtgaagtgaccatgacccatcacccaggctgtgcctccttcaccagtgccaaataagagggtcttttatgagtaggactgtaaactgaggtctgctgtttatataaattagatgatggaatcagtcttggttagttagatagcacagttgaaaatgtaaggtccgaagaccccaaactttcccccataagttacaactggatttagatgctgacatcatctagatatggttttgcagccttaagaagttggcacttttactcgacccaaaccttactgagtcaggttgtcagaggggtgggcagtatgacctgattggctatagggatttatattccagtttagaaaagattttaataaaatatgcttgtgccatgtggcagcaaattcacatgcacataacctgactatacagtctccagacaaggcctctggaatgaatgtaagtattccgttaatcccagtataactcacactatgaatgtacaaatgttaccgtgggagctagcactagtttaaggggtagatgacccaggaaagttgcgagccagtgtattgtgactgtgatatggactgttggtggagtacataaatagaacattacctctgaccctgtatgtgygtgtataaattgattacaacagaatcccatagtaacatggaatttaagaaaatcatttgtgttataaggggactcctaagtccagataatcaaaaacaaaacacctgggattttctgaacttcttgccttcctgggcttgtactgggactcaatataatgtcacccatatgaagttctctatggaaatctataggaagtttaaaaatacgtgtatgagctaacatctataaaaatgttaagtgaataggcaaaaattttgtaagtgatattctaattgcagtttggaatgctatcacttataaaataattctttaacaataccataggtctttacaatataacttgttatcattctttgaatgatgtgcaaagagctatggcgctggacgcggtggctcatgcctattaccccagcacttcaggaggccaaggcaggcaaattgcttgagcccargagtttgagaccaggctgggcaacgtagggagactccatctctacaaaaaatacagaaactagtcagatgtggtggtgcacacccgtggtctcagctacttgggaggttgaggtgggaggattgcttgagcccaggaggtcatgsctgtagtgrgccatgattgtgccactgccctccagctgggtgacagaatgagaccctgtgtcgaatgaatgaatgaaaataaagagccatggctttgtctgtgtttgcaacataatacagactaatgttagtcttacccaagatacaataaaactttattaacacacagcaatattcctgaaaatggcttgtgaattaatggtttttaaaataaaagtgagatattaggctaatgaagatataatttgctgaaaatatcttagtgacttgaacaaacttgtatgaccctgacaagatgttatattagggccccaaattctttttaaattaaaccactcaggcagtgtaattgaggagaatttctttaacttgcatcctctggtaattgtttctgttcttattttcctttggcaattgtgtagatgttgaagatggtggagtgactcctctgcacagctggcagggtgcttgcagtcaggagcatgcattaggtggcccttgagggtgagtggagcaatctgcctgagactgttcattattgtaaagttttggaaaccagtgtcttcagattcacactcacccttgcttgtatgaagtcacatgacagttcacatttgagatggcataagaagggcattaacttcccaaattccctgtgcatcagtgtgaaagagaacccaaaatgtcctgtgcaggtctttcttgctccttcaagtggaagtagttcagttccatagattagggaatttttttttttttttttttagatggagtctcactctgtcacccaggctggagtacagtggtgcagtctcagctcactgcaccctcagcctcctgagccagctgggactacaggtgtgtgccaccacacctggcttatttttgtatttttagtagagatggggttttgccatgttggccaggctggtcttgaactcctgacctcaggtgatctgcccgcctcggcctcccaaagtgctgggattacaggtgtgagccaccgcacccggccaagggggatttttttttctcctttcagtttagttgccctaagtatgattataaaactatactttttctttaccctgccccacttttttctgcttctatgttttaaaaaaaaaatagccataacaggctttgctgccatagagcacttacatatccatgtttcttctattatgaaaggaggagtgttgcttggtagcagtagcggctgtgggtgttagatggcagatgggggactgcagggttgcagctgcagtcctgcaaatattgttaaaataaacttccattggaaattgactggtcaaatagagtgttgtgatgaagcagagctgaaagtctaatgtgaaaaagaggaaaagcatgtatctgagccatgtaaacttttatgcagaccagtattgatgtgatttcttggcagggaattggtgggctgtaagtctgagaggactcaagggaatgactggagaaaagtatcactaatagagtattttgatggaagagaaaacaattcctttatttattgtaagaatgtttcatgtcacaaactaatcttgtgtgaccctgtatatgtgccttactcaattaaaggtacatttggtggagggaatggctcacacctgtaataccagcaatttaataggaggctgaggcaggaggattgcttgagtccagcagtttaagatcagcctgggcatcatagttagaccccatctctacaaaacattaaaaaaattagctcggtgtggcagcacatgcctgttatcccagctacttgggaatttgagacaagagaatcacttgagcccaggcggtcaagtctgcagtgagctgtgattgtgccactgtactccagcctgggcaacagagcaagacttttttaaaaaaaaawtttaaataaaataaaggtgcatcttacctttatcttctcatttgctgcagattcttacatgtgtatgtgatgaaatttggatgtgataggtttgcatattggatgctactttggcgtgcacttgtacactataaacagttttcttgaaactgcaaaagggccaaatgaatgtggatgattctcatcaggagagttgcggaaatttgtggggatgtgttttctaatgtagttgagtctgagacgtattcataatgaaatacattatttaacataaattatagtcttattttttctttatattactcagagcataatacttgttttgaaattatgtgtgggggcaggttttaccatgttaattcacttcaagtttgtaaagagagccttataaatttactataaaaatggggacttttgagatccacttatcttggtaatagttaactaggacttcttaaattgtttaactctgtacattcagaagaatttcttgtatcatttaaactgtagtactgttatttgctgttatttaagttctgtaaagtcacagaaaacactgaatcagtgcatatagaaccattgttgtttgcaaaatatggcattaggtccctgccagcctctggtcacattttcatcagtaaatcattatataaccatgtttcacgtgtgtttctttttaaagacactttaatgtacatttttgattcattaactttgaactcatggctagtatactgctatagctcatacctgaatgaagcttatttgatacgaatattttctctataaggtacatcacgagtattttctccgtaaggcacatcacaaccttcttgcacttaggaacactagacagcactttggcactgtgcataggagatattctcaacagcaaaatcaccaacaaaaagcacaaacttacaaaaagtatggcactaagtggagtgaagaaaggacatttgcttacagaataagagctgaaaaatgaaggaaaagtgcaccttatttgacctcagctgggaacgtgcccattgggcaactcaaagtttttgtcactctgacctgtcagcaaatgccaaaaaagcyctacagatttgaggtaacaaataagttttagcaagtgggcaacttttcaaatattgaaatccacgaataatgagaattgactacaagtagttttgccaaaaattgtaaattatggaataacctgtgtagtcacttaaatgcttgcagaatctggagaattaatgaraacttttgatgtggtataacatattaaaatgactttactgtaacatctttgatttaaataatgaaattaaccacatttgtataatgtcttataaaatttttatagtacttcaggtacataattaatttgctctgtagttgaaaaactatgattctgacagattaagtaagtgacttaccactgttgacctgcctaatatgttgtggaaatgaaactggagcccaagtgtttttattttttatttatttattttttctttcagacatgatctcactctgtcactgaggctagagtgcagtggcatgctcatagctcactgcagcctcgacctcctgggctcaaacaattttcccacatcagcctcctgagtagctgtgactacaggtgtgcaccaccacacctggtgaatttttaaaattttgcatagagacatagtcttgctgtgatgcccaggctggtcttgaactcctggccccaagcaatcctcccatgggcctcccaaagtactaggattacaggcgtgagccactgcacctcgccccaagttgctttcatttttaattcactcttaatttttcacctttttctagatagctagttcagaattattctagatatatacatcttagtaagtatggtgatttaaaattactttggacaactttaagtttactttttttaaaaaaggaattttcaagattgttaggtacctgcctgttttcaggggctttgatgacttattccaagaaaatggaattgtctgttgtgactggagtcatcactggattaagctgacaataaactactgttattcttcaagaaacatccatcttctgcacagaccaaagtagtgatttaatttgagtgcacagctcrgttgtactttgtcttgggatgtgaaaagccagaaagaatgtcactcccatagtgatatcactcccacagaacaataaggataaagacagataatctacacaatttcaatttttttaacctactagacagctgagattgataacatctaggtagtctaaaattcaaggaaaaaaaataggcttttccatgtggagaagagaaataagcactggctcatgtggtcactactttttcatcctacaaagagattcactagttaataagcctaggcaagggcacagtactccaatcaactttatagaaatgtattgttatggtccaaattgtgtccctacccccaagttcatgtgttaaagtcccaaaccccagcacctcagaatgtgactgaatttggacacggtgaagttaaaatgaggccttttggattggctgtcatacaatctgactggtgtccttataagaataggaaatttggacatacttagcggtatttgcacagaggaaacactgtgtggatacaaaaggtgactagaccgcaagcctaggagagaggcctcagaagaaacctaccctgccaacaccttgatcttgcattcttgcacttccagcctgcctaactgtgagaagataagtttctgtttaagtcatccagactgtggtattttgttatggcagccctagtaaactaatattttagcactcttaaagaattaagtacgtagagccaaacatgtaagataacccaaaggaaaaatgggagtagaagagaatggagataatgtaggaaggagaagtaaactttaaaaatattataattaatagaagagaagatactatatgtagaaggaataaagttttctaataaagtgatattcagaggacaaaaggacattaaaaggagagtggacattttaagatgtcttacatttttgaagataaagttaggagaatttcccaatgaagtagaaatagtagatatggagaataggagagaaaaattatacagtagaagataatcaatccaggaggtccaacatccaactaatacacagaaacttagagaacagaggaaaaggaagtgaaattatcaagcaagtaatactgagattgtcctagagctagacgtragtgaatattgagatagaaagccttattaaatgtgcaataaagaagaaaggaattttcaccaagacatgtcatttagaaattcttatgcaccagagataaggagaacttgaaaactttcaggggaaacaacaggccacgttaatggttgggaaatctggatggtatcggatttctccgttttaacaaagaaaggagaaaacagagcaatgccttaaaaattctgaggaaaagtaattttcatcttagaattctataccaaaattatcaatcatatgcatgagtagaataaagatatttttatacatacagtgtcttaaagatatgttttgtctgctgtttctcagaaagctactggagttgtgtaccatgaaattcagggaattaataaatgaagaaggaaaatgtggaatccaggaaatgggatccagcagagagatgtgaagggaattcccacaatgactgtgaagtttaggctaatagttggctcagtgcctagagagtttatagtccagattaaaacagtcagaagactccaggacagtgtctaaggaaaacaaacaagcatgaagctaatatattatctgaggcgatacactggcgggaaggaagttttatagtccttttggaatgcctagggctgaattagtgaatgtacaccaaaaagttattcaaaaaacaaagacagtttataactttatagttaacaaaaatttgtgtgagaaagaagagatacttatatacatgaagtagctcaggtataaacaacttttatgataataataacacagtcatccctcagtgtctgtgggggataggttccagattccccacggataccaaaatccatggatgctcaactcatgtatggcaaagtattttttttttcttttctaagtgctgaggtttgagagaatttctccaagaagctcataaatacagcagtgcccaatcaggtggtctacagcttcagtaacacacctgtgtatacccaggtaactactggtcagctacaaatggaagttcagtaaaagcaattccacaaaggaccaaatttctatctaggcctcagatctggctatctggctagatcctggttaaaactggatatgtggaaaattacagtcaaactatgaaacagccccacccttatctcccttcactgactctcttttcggactcagctcgcctgcacccaggtgaaataaacatccttgttgctaaaggaacaaaaacaaacaaccaaaaaaaaactggatatgtggcctagccctccagcaaactcctaaaatattgcaaacctcagcgcctattaagaagtaacgactgttagcaagaattgggagacaagaagtgacattcggccaggcgtggtggctcacgcctgtaatcccagcactttgggaggccgaggtgggcagatcatttgagatcaggagtttgagaccagcctggccaacatggtgaaagcccatctctactaaaaatacaaaaattagctgggcgtggtggcacacgcctgtagtcccagctacttgggaggctgaggcaggagaattgcttgaacctgggaggtggagattgcggtgagccgrgatcgcaccattacactccagcctgggtgacagagcaagactcttgtctcaagaaaaaaaaaaaaaaaaaaaaaaagacaaacaaaacacaaaaagcaaaagtgacattcatcttaacttccaaatagcctgggttagttttatgcctcttttaatgatgaagaaactgagggtcagagagccttaagtttataggtagaaaatgtcagagccagccccaaactcaggtctctggcttcccttccctagtcatgtctaccacccttcaaaaattgagcttatgctctcagcatccctgtggtggatagtgggctgtaggaccaaggaaggctagaagaagatgttggtctacacacttgagtggagatggtgaagaggggacctaggcccagcagtcaggtacttgcttttgtaaccacccaatgagttcaccttgcccactgcttagacagagcagatttctcaagacaagggaattacaatagagaaagagtaattcatgcagagccggctgtgcaggagactggagtttattactacccaaatcagtctcctaaaatggcatagtatttgcatataacccacacacgtcctcctgtctactttaaaccatctctagattacttataatacctaatgtgatgtaaatgctgtgtaaatagttgttatagtatattgtttaaggaataatgacaagaaaaaaagcctgtacatgctcagtacaaatgcagccatctgcagaactcatggatatgaagggctgtctacctaatgattttcccaacatgtgaggaggatagtgtgtgtatgactgccttaaaggagggatggaggacaagaatcagaaatgtggagggggagggcagaggattacactttgttatataacaaacctaagtgtttggcttttaaacttctataattatattcttttggaaaaatattaatactagtaaaggaagtagggctacactttagatagagtacattcagaagggagggcagttaaaatggaaggagagggaaggaggagtataggttgggtttgaagtactttagggagagagagaagaaaggaaaaatcaggacactgttgagacactccacgggtaccccagtggaggttatgtatatacatattaataaatattaatatgccccaaccattgtatttgtttgcagttacttgctccccagtcagcttgtgttcttttcagtgttgacacttgaagttagattagtagcagtcagggttctccacctatatgctgtgtttttcttgttaggtgcctgccatttcttgaaagccctttatgtttctaaggacttgtttttctttttcatgagaatgttcttgtcagagaccaagcgaagagacagccaagggggaagagagtaaagtgaaccattacatcttactgtatgtgtatgtcctttagcttcatgttacttagcttactgtatgtcctttagcttcatgttgtcaatgtaggaaatactactatatgctgttyatgttgttagcacacagtaaactgatctcttcttactctttgagcctacaaccataaaattcccttctatttcttattgtcttcaagcatttttaaaaaatatacatgattccctttgtgggtgcaactattatgttattgcaagaaagacatttcctagccctacttacagaaaatctgtgcatatcacaggtttccaggctattggcttacttggttttctttgttaaccttgatgtaacattccagtggcacctgattttgtctagaaatcattcccaagtgggtaaacatcatatatgtaacctcacccttgtaagcctgctttctttccctgtatgtcatggaaaaatttctgtgttaattggaggtggtttctggcctaattatgtttgaaaaaaaattgtcgaatggagatacatcttaagaaagagatgttgaaataattgcttgagtaaacatagatcaccatgaccttgtaatagtttcccttgaaattatttagtgaaagcaaatttaggcaattactgaaaaccagtgatcaaggaaggaaataaacagctttttttgtttgttttctatttcataggactatacagagcaccccacttaaatgactaatactaaaatttaaatttcaattattttttaaatctctggtatatatatatatatatacacacacacacayatatatataaggtgtttttgcttatgaagtaagacttttgtcagaattcatgtacttgtaaaattctaagttcaggatcataagaagtgagactttttgtgattatttggagcattttgtcagattatgctttcaatttccccattttagagtcattatctaattctactttataggtatttagtaactttgttctttcaagagtattatgaagtcattatatgtattctatcatatggaaagagaatattagtgaacaatgacttctactttgagactttgaacaccaagagaggcaggcctcagatgatcaaggtaatgttaattggctaaaaaaattgaggaatattttttgtgagaatatcaaggggaaaaagaggagacagggacatttatttatgattcatatcaaactggaaggtagttttcaattgtgactatacactaaagattgtcacttgattcacatgtattcaggrctyataaaactaagtcaycatacttagaaatggtttcatgctatcacggtgtctgtcagaattagcaggcaatatctcattataggaaattttaagtatattagtgattttttwaaaaatgtaaaattttgagattttaggatttggagaataactacctgagcccatcctctttgttgtgaattagcaatgggacagaagtatttgtaatatagtgagagaaactaggaaacaagctcactagggtgatattgaggccatgtaatacagaataatctatttcgggagttccttgcaaaggtataatagtaccagatctttaggaatgttttagtttttaaattttacttttcctagatacaatatctagttgaaattttttttatgtggcagttctaggagtactgtggatgcgtgggaaaagaggaatgtgaaaagcttagctcaacttaccttccacttttatttcttttaaatgtcacaaaatagagtttacaaaaatgttagctatctggggtcattttgaatagctgattatctagtagttttaaaattaaaagaaaatgttttattataaaagaaagaatatgcttagtaaaatttaaatctgtattatttaatgttacattatgaaatacattaagktaattattttaatataaaagcawgtttgttttagaaaatacagaaataaactttttttgtagcyccactacccagtgttaattattacactattacgatttgaaattggatttccaggctatttccctatgaagacatatgcttttattttctaaaagatcgtattttatctacctttttgtagtcttttgcctactttatatcatatttaaaagagcagcccattttattaaatattgttctgtggtataattttaatggctgcttactgttatattacataagtgaaccataatgtcatgtttaatttaaatgaacaaattctattttattaactaggtttattataaaagaaatatgtatattcatgttaaatccataatatattaaccaaacttctcttttgttacttacttctttttaaagggaaactgttctttttattttcttatttattataaactcatatttgtataatacacatagcttttgccttactaaatatataatattatataataatatataatataatatatattataaaaattaataatattgtattatataatatatattatatataataatataagttatattattatataatattattatttgtgagaatatcaaggggaaaaagaggagacagggacatttatttatgattcatctcaaactggaaggtagttttcaattgtgactatacactaaagattgtcacttgattcacatgtattcaggactcataaaactaaktcaccatacttagaaatggtttcatgctattacggtgtctgtcagaattagsaggcaatatctcattataggaaattttaagtatattagtgattttttaaaaaatgtaaaattttgaaattttataatatataatatattataaaatatatattatatattatattacatattatatattatgtaatataatatataatatattatatgtatatttattacatataatataatatataatattatattaaatatatatattwaatatatatatttatatattatatttataattattatatataatwattattatatatataatwattattatatataataatataagttatataatataatataatattatataatataccatatatagcatatatgtgcaatatatattatatattgcatatatattatatatattatatattataatatgttatatataatataataataatattattattattattattttgagacagagtctcactctcttgcccaggctggagtgcactggtgcaatcttggctcactgtgagctccgcttcctgagttcaagcgattctactgccttatcctcctgagtttctgggattataggcatccaccaccacacccagctaatttttgtattttttgtagagacagggtttcaccatgttggccaggctggtctcaaactcctgaccgcaggtgatccacctgcctcggtctctcaaagtggtgagattacaggcatgagccactctgcctggcctacttttatatttcagggtttatattatgaatttatattgttttaattatagctacatgtaaagctaccggaatatgtagaacatagcataagagtaactttggatttgactctggtatagttgttttagaacttactttcttgaaagacttcttgccaagggcttgctttttaatgattttgcctgtctcttttataacttaataacacatttgcagctacctttctctaaaattaattgatgcttatcccaattgttttattttttacctaatttctacacaattagtttcttttgattttgcactgttattcaatgcaatacctgaaakaaataagttttttttttttttttttttttgtcaaggctcacacaccagaagaactaatgataaatattctttgtaatcttctagaaattttagatgcatatataaatacatatatatataaataaatactgtttttttgcttttttggtagagacagtcttgctgtgttgcctaggttggtctttaactcctgggcccaagcaatcctcctgcctcagcctcccaaagtgctgagattatagtcataagccatggaacccagcccataacttctttaaacaaaaaatattatacaagcatgttcacactcacacacgctattaggcaacatgaattttcattttaagatatgttgtaagaatgatgaatgaggttagaagcmcagtatcttcagctatgctgcttggaattgaaccccaattcccacgtttactatgtgtgacatcttgggaaagttatttcacatcttaatgtgtctcagtttcctcatgcttagcgtggtgaacaatacaaatgtctatctcatagagttgatgtgagctttcagtaaacttgtgtatgaaaagtacttagttattggcaaaatagagtcattgtatttagccgttacctttttatgtaagagaatataaatttattctaatatttttagactatcccatcttaatattactataatttattgatcccccattacaagccatcgtgttatttccctattttatattattgaaacaatgctgcaaagaccgtctttattattaggattttgtacttgtgaagtaaatatataggatgaagtcctagaagtataattcctgtgtcaaagactacattgcttttttttgtttttttttttkttgttgttttttttgagacggagtttctctcttgttgcccaggctggagtgcaatggcgcgatcttggctcaccccaacctctgcctcccaggttcaagtgattctgctgcctcagcctcccgaataggtgggattacagacatgcgccaccacgcccagctaattttgtatttttagtagagatggggtttctccatgttggtcaggctggtctcaaacttccaacctcaggtgatccacccgtctcggcctcccaaagtgctgggattacaggcgtgatccatcgtgcccggcccaaagactacatatttgaagtttccatgggtgttgctaaattgtccttcaggtttgtgagattgcttttctcctcctactctctccaatactaagtatcacttaatttttaagttttaataatatgataggtgatgaatgctaatttttgttttaagatatattgtaagtggagttgaatatttatttatatttttgagacatttgtatttttttctcatgaactacatgtccatgtaattggttcatttttctattggtttatcaatgtttttcatattgcttttgaaagaacactttgttgtaaaataaccattagctagttcatttgtgccatgaataattttctctgtttattattgacttctcttcctttatagtcatatagattgttccaatttttatgttttcagattcttatatttgttattttgttattgcttctgagtattatgtcattcttcaaaatatctttgccaacacaggatcacatttaaaaagattcactaatctgttcctagatcctcktgtaattttatttttacctttaaatcttagatctactaaaaatgtaggggaggaaaaaaaagtcatcttctgccctcttaagttcagagtctagaacccaggaatcaaactaaagacattaccaggaagaaaaacattcacttaatacatctgcatgggagttcatgacgaaatgtgactcagggaggtggttagaatttggggcttatataccaacttaacaaaaggtgataaagtatggagaggtaggctgggcatggtggctcatgcctgtaaagtaatcccagcactttgggaggctgaggcaggcggatcacaatgtcaggggatcaagaccatcctggctaacacggtgaaaccccgtctctactaaaaatacaaaaaaaattakcctggtgtggtggcgggtgcctgtagtcccagctactcaggaggctgargcaggagagtggtgtgaacctgggagtcagaggttgcagtgagccgagatcgcgccactgcactccagcctgggcgacagagcgagactccatctcaaaaaaaaatgtatggagaggtagctagacaaaggaaaggggtttgggrcttctgtggggcagagcaatgggtaacttgtgggaaagtaactagaaaatgtatagtaattaagagttgtttactaagatttgttttgcagattaggggtcgtctttctgatatggaagaggagaacaccttcacaaatggaaaaatatgtcatctttacgaaaggaaatttatgtcctggttttgtgtttatttttcatacagatcgggtctcactctgttgcccagtctagtctcaaactcctgggctgatgtgatcctcccaccttggcctccgaaagtgctgggattagaggtgtgagccaccgcactcagcctatgtcctagttttagacagaatgttgcaggtcacagaacaattgcctttagttaaacacagttcttagtctaaagtggcatattttgcaatggcctactctgattcccttcacagactcacatggtgaaagtaattatgtgaggatctagctttatttttcttcataaggttagcataatttcctaataccatttattgtataatccaccttctcttcattattttgacatattttrtatctcataaaccaaagttttatatatttgaatttggatctttctggactctctgtttcatcaatctgtctactcctacactagtaataacaattattgtatgtttacaaaactttaaattttctcttatatctagctgctctcccccaatactatttttattaaaaawtttttagtttgttagtgtgtactttttccaggcaaacttaaacttttttgtcatatttcaaaataaaaatagtatttgttcattattttgtgagaatccattggagtttctgagttcagtaggacttaataccttaaatagaacttaattcctgaggtaatcagaaatgagatattttctttcattttattttctctcattattgkatatatatgaaaatggctttaggttatgtttactagttttataacctgacttcttagttacactgctaatcttttccagtttattttttagttatattctttacaaattatagttttatctctttctttccaacgtttatgccttcattccaatgtttataccttttattttttttcttgtctgatttcacagaatgattcctttcaaataatgccattttacttttaaccttttagaatgactttattcaaaataagccacttgtgtaaatatagagttggcttttgatttttaatttagtctgaaattttctttccctcaaatatctgacttcagtaagcaatgattgttatgagataaatgtttgctcttaattatatcaacttctttttatttttttgtttctartaatcactttgttttctggttttcgctttgtggtctgtgtctttgttactttcacttaagtagtgatcttcaaacagttaatttatataatctgtgatttttaaaaatcagtagacttttaccgacatgttagtgaatatgaggatcttagtttacttccatttttttaatcccttgacttccccctcatctttttgacttttgttattttactgagttaaaagataatttttaagagaaaggaaaaatgtatctcttatacagatttaagagtgaatgcacattaaaggatttctttccatagtataatatgagggaactgtagaggaggaaaaaataatttttcctatatcctctgcattgttagctgcccccccaataacaaagacagattaacaagaaaaaacaaacaaacagaagtttattaatatgtacacctcttgtatataagggaggtatgtaagaaataatggtaaatctcaaagagatagctaggattcagatttaaataacatcttcagctaaaaacgaagaaaggttgtgtgtgaggccagttgtggggaggtgaccaggaaaagcatggtgaagagtaaggtttgttatgcagatttgagtcagtgccttctccattgataggagtctcttatgatttagtaattcttcatttcctgccacagagggagatactcttacaaatggagcttttcttcatagatctaagtttcccttacaaaacagtatcttctactctgttttttttytttttaattatacttttaagttttagggtacatgtgcacaacgtgcaggttagttacatatgtatacatgtgccatgctggtgtgctgtacccattaactcatcatttagcattaggtrtatctcctaaagctatccctcccccctccccccaccccacatcagtccccagagtgtgatgttccccttcctgtgtccatgtgttctcactgttcaattcccacctatgagtgagaatatgcggtgtttggttttttgttcttgtgatagtttactgacaatgatgatttccaatttcatccatgtccctacaaaggacatgaactcatcattttttatggctgcatagtattccatggtatatatgtgccacattttcttaatccagtctatcattgttggacatttgggttggttccaagtctttgctattgtgaatagtgccgcaataaacatacgtgtgcatgtgtctttatagcagcattatttatagtcctttgggtatatacccagtaatgggatggctgggtcaaatggtatttctagttctagatccctgaggaatcgccacactgacttccacaagggttgaactagtttacagtcccaacaacagtgtaaaagtgttctatttctccacatcctctccagcaactgttgtttcctgactttttaatgattgccattctaactggtgtgagatgctatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggtttgcgaaaattttctcccattttgtaggttgcctgttcactctgatggtagtttcttttgctgtgcagaagctctttagtttaatgagatcccatttgtcaattttggcttttgttgccattgcttttggtgttttggacatgaagtccttgcccatgcctatgtcctgaatggtaatgcctaggttttcttctagcgtatttatggttttaggtctaacgtttaagtctttaatccgtcttgaattaatttttgtataaggtgtaaggaagggatccagtttcagctttctacatatggctagccagttttcctagcaccatttattaaatagggaatcctttccccatttcttgtttttctcaggtttgtcaaagatcagatagttgtagatatgcggcattatttctgagggctctgttctgttccattgatctatatctctgttttggtaccagtaccatgctgttttggttactgtagcctggtagaagttgactctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatccaaaaatcctcaataaaatactggcaaactgaatccagcagcacatcaaaaggcttatccaccatgatcaagtgggcttcatccctgggatgcaaggctggttcaatatatgcaaatcaataaatgtaatccggcatataaacagaaccaaagacaaaaaccgcatgattatctcaatagatgcagaaaaggcctttgacaaaattcaacaacgcttcatgctaaaaactcaataaattaggtattgatgggacgtatctcaaaataataagagctatctatgacaaacccacagccaatatcatactgaatgggcaaaaactggaagcatttcctttgaaaactggcacaagacagggatgccctctctcaccactcctattcaacatagtgttggaagttctggccagggcaattaggcaggagaaggaaataaagggcattcaattaggaaaagaggaagtcaaattgtccctgtttgcagatgacatgattgtatagctagaaaacccccattgtcttagcccaaaatctccttaagctgataagcaacttcagcaaagtctcaggatacaaaatcaatgtgcaaaaatcacaagcattcttatacaccaataasagacaaacagagagccaaatcatgagtgaactcccattcacaattgcttcaaagagaataaaatacctaggaatccaacttacaagggacgtgaaggacctcttcaaggagaactacaaaccactgctcagtgaaataaaagaggatacaaagaaatggaagaacattccatgctcatgggtaggaagaatcaatatcatgaaaatggccatactgcccaaggtaatttatagattcaatgccatctccatcaaactaccaatgactttcttcacagaattggaaaaaactactttaaagttcatatggaaccaaaaaagagcccgcatcgccaagtcaatcctaagccaaaagaacaaagctggaggcatcacgctacctgacttcaaactatacttctactctgtttttagagcttctcatgtgtccgctgtttctcaaaataatcaatatgcaaaagaggcatgttttagggtggcattctggtctcctacagtcatatttttgggtggcatattctggtttcctacagaacgaagtagatgttataacaggttcagagaaagtcaaaacagcagagatttatatgagataaagaaatgtccagatgacttgcacatggaacaaaactatttttccatatggggtaagatgtcaattaaaacattatcaggcaggtcaatttacatatctgcttgttaactattgtttacaaagagttgagaaaaagctcaaagacaaagaataagactagaatcaattaattcagaagggtatgtagcttcatctattcctaacaaagcttaaaatcaagacctgaatggatcaaactttctgcataatttaaccacatcccagaaaaaaaagcttaaggatatttgtagaaacacaaaaatagccagcagtaacagggtaaaattcacaatatttcacattcattcagaaatttccaggcatgcaaagaggcagggactttaaaaagagcataacaaggagaaaaatcaatcaaaattgaccctgaaatgacataaatggaagaattagtatacaagaatattaaaatagttattttaactgtgttccatatgttttgaggtgctagagaaaaacgtattaggaagagatatggaaactatgaaaaaggtccaaatcaaacttctagagataagcactataatgaaaaatgagatgaaaaatgtactggatggaattaactgtgcattagacagtgaacaaatgaaggtaagtgaaatttaagatacagctatagaaactttccaaaattaaacagagagaataaaaatgactggggaggaactccctgaaaggtgcattagtaaaccatgaggtaacttaagtggccaaatatgtagtgacatcagcgggaatggtgggataaggcactctggaaatgctcctcttcataaaagcaatactggcaaaatggtcagtcaccttttttcagaattttggaaattaaccaaagtcttgctacaattatgaagcatttaaggaaaatgaccataagctctgtaagaacagcaaatttagtgggattttaatttgctctattacctttaccttctcccctgcccccaacaaacttcccagtgccatgatagccttgaaaccaacagcctgaaatcacggtgaaaaccaccaccttggcagccacttcagggggcttatagtattggattgccttaraaatcccattttcattgaattgtcattgtttgacctgtgtggtgattgtctggataaccccactcacaaagattatttttatttgacctgactcagtgctaacacgttgtttttttggggcgaggtgtgaaagaggggtgtttgtcataaatacttgctttacgtttctgctgtcttactagtagatagcagttaaaacgaaaaatagggctaaccaaaaaacttaataggagaagctggggaattagatgttcatatgaggtttgaaggaagttctgacacattcttgggaattcagaagacttacatgcatgtgtagagctgtgagcatgctcggaaaatacctaagaaggccctcaccttaggctgaccttgaggctctgtgtaagccagaagtggaggctaaggcagagttgtctgctgcctggtgcacatttaaagtgtagagggtagagacctggtgtgatgggtgattcctgtaatcccagcactttgggaggccaagtcaggagaactgctagaggcttggagtgggagaccagcctgggcaacatagcgagacactgtctctacaaaaaaatttaaaatgagcatggcatgggggcgtgtgcctgtaattccagctacctgggaggctgaggtgggaggatggcttgagccctggattttgaggctacagtgagctatgatcatgccactgcaccccagcctgggtgatcctgtctcttaaaaaagaaaaaaagtgtagggtggaagggatttctttttttttttttttttttttttgagacggagtcttgctctgttgcccaggcgaactcggctcactgcaagctccacctcctgggttcacgccattctcctgcctcagcctcccaagtagctgggactacaggcgcccaccaccacgcccggctaattttttgtatttttagaagagacggggtttcaccgtgttagccaggatggtctcaatctcctgacctcatgatccgcccacctcggcctcccaaagtgctgggattacaggcgtgagccactgcgcccagccgggatttcttttctcacccattgcaaggttcatggctgtggtcccataacaaaagacatattaacaagagaaaagcatatatattttgtatatattttatgtgatataggagccttcaggaatgaagacccagagaaacaggtaaatctgtgtatttttatggacagtcatgcagaactatgattggaggacaaaagggtatgatctaatgataataaactaggggaacttggcaatgtctgttttttcagattcttcttcttgtccctgtgtgacattccttgcccccggtatagggcaagacacctgtcacattacattcttcaagggagaagggagggagaaggttacacagtaacctaggtcttatggcctgtttcagggaggaatgtgaggaggggaaggttcaagtggcctcttgcttctgctgtttcctcaacttccaaggtgccatattttggggtagcatgtcttgaactttgtcaaaagtgtaccttaacacttcagagctctgctgcaaagactaggaaacatagtggttccaggtggttccaggtcgttccagcttagctaactgctaagctaatcaagcagagatttcggaggctccgtaccacagggaatatagactttagtgtagaagtctctaaacaaacaatctcaaccacctccacaataaaacagcagcaagaaatatatttgtaattgggttccaaaaagtagatgagggatgaaaaaatatttgaagaaataatgctgaaaaattgctgaattgggtgaaaacactaagttcacagatccaaggagttcaatgaacccaaccacaagaaaaatgaaaactacaccaagttgcaatcataatcacattgcttaaaatcagtgaatatgagaaattttgaaagtagccagagacaaagggaacattgcacagaaaggaataaaaataaagacgacagcagatttcttatcaggaatattgtatgctagaaaacaaggcaaagacatctttttaaagttcttaaaaaattgttcatacttagatagcatgtatatgccatagrcatcagtttattaaaatagaaaagaacaatgtgttaccacttaccagtgagctaacacaaaatttaatgcccatgttgaaagaaaagtttagggaaaaattctgagttattggatgtagacagagaagtcagtctgttgctatttacataaggatgatatacctaagggcagagaacttagaaggacatgatgaaataaaaattaactttaatagtgaaatcttgaaaaaataggctaaacgtcactaagaaattatttttgccaagttttatctttacacatttttattataaaggattttgaacatagaacatatagtatgacaacttgggtacccaccatttagctttgtaaaattttaatttttttcatgcttgctttgtatttttctatttaaagaaatataatattacagacttagatttccacagtgttcactccctaatataaaatcgttttgtagcccttcccagaagtaatcactcttttgaatttggtgcttttagttaccaagcattttatattcttttacaacatattgtacttgttataaatggtgtcagataaatatactttgttgaatttttttattttgagatgtgtctttattgatacatgagccatagcccacttagttgtaatctatatagttagtacatgtattctattgtatgaatagtacagaatttgtaatcattttcttgttatggacattaagattgtttataattcatcaccatcgcaaaccatgctgcagtgagtatccttgtgcacgtttacataggcacatgagcaagtgtttctctgtgttgtgtgtctccatgtgaactagccaggttttaggttcgtatatgtatctttaccgttagtgtctgttgtcacattacttatcactgggccatacccaccctcacatgatttactagttcctgtttttccacattctcacccatactcggcctctccaatggatgtaaaatggaattcagtgttttaatttatattgcctattactagtaaagtaggaccctatgtcatgtgtttattaaccattagattttccttttctgtgaatgatgtgtttatatcttagccccatttttttgtttgatttttatttctcttatttatatgaatttgagagctgtctcataaaaagaggaaaacaagagatgagatcccactgtgtcgcccaggctaacccaaacttctggacttagcgattctcccatctcggcctctcagagcgctaggattataggcatgagccactgcgctcagcaaaaaagaaaaaaaaatttttggttttttttttttttttttgagtcttgctctgtcacccaggctgagtacagtggcacgatctcggctcactgcaacctccgcctgctgggttcaagcgattctcctgcctcagcttcctgagtagctgggattacagatgctcaccacaatgcctggctaatttttgtattttyagtagtgacggggtttcgccatattggccaggctggtctccaactcctgacctcaagtgatccacctgccttggcctcccaaagtgctgagattacaggcatgagccactgcacccagcccaaaaatacattgtgaatagcattttattagtatattctctcagtttataacttgtattttcacttggtatatgtttccttataatacaggagttttaaattttaatactatcataatggttaatgtttgatttctttttgttttaaaaatcttcctaagaccataaacattttcttgtgtaatttcatctaaaggttttaagagtttgcttttcagtttgtcttcaatacactaatccacttggaatttattttctgtatgacgtgaggtagggatataatttaatgtgttttttttctttttttaaatttattttattttatgtaagtaaccaattcctctcccccaaattttttccaaaataatattaaaatttaaaatagttctaaatttgtaggaaacctgcaaagatagtacagagaattcctatatactccacacccagtttcctcaattgttaacatcttatgttagaatagttttaaaatagactgtagtacatattgctctacacattgtagaagtggtttttatttttacaacaaaacattagggaattttagtttaggatttttatgtcttaacacatattttataggtagtttaaatcaaaacagggtgattgtgtcataaactttgacacaaatataagtaagcattttacctaaaaaagatttggggtgactgtgttataaattttgacacaaatataaataagtgttttacctgaaaaagatttggagaagaatcttaacttggcaaatgatgttttagtctgttgcctttttattgccaaaatatcttgaatttccttgcaacatttacagctatagagtttgttgattactaactaaggggactttgtagtcagttctaaattctagaatggggaaacagggaataaaggtttttcttaaaacctactcctagttttgctgcactaggccaagcactcttttgtttacttttattcttttctactgcacttcactgataaaatatgtatactaaaatttggagactcaaaagggggcatgtagcactcatatttgaaatttagtccaagatcagtgaaaatcacatcaaggaagatagtgaacataacttataaagtagttgctagtttagacaagaagtcagtgaaattcatgaaaatgctattttggttcagaaaagagagtttaggtcgggagcaagtggctcacacctgtaatcctagcactttgggaggctgaggagggaggatctctccagccctggagtttgagaccagcctgagcaacatagtgagacactgtctcaaaaaataagacaagtaaataaaagatggattttctaaaaaaaagaaagagagagagaaagccaaaagcataaggctgacccattttactgagtgttcaaattatggtaatttcattctgagaagccacctaacacacttagtgtagttgcgctacgattgtgaatctgccttctgtaatagtttctcactctttaagacacagaaataaacataatttagatatgggtgtatagcactcagatgtttacttttatctcatgagaattgctaacccgttttagatttctctttctctaatcaaatagtctcaatgttttatataaagataaatacttcagttttaagaattgtagcttactagaagtattagtctctataattttaaactacaaataaagtaaattttcttcattcacagtactatggaatctctaatatgggtcagtgtttttgctgggtcatgggcgtaatgcttgaagaactccctctgatggggaaaaagtgaaacatgatgaaatattgatagtaaaaggatagatgtctacatttaaccttgaaggataagtagttttttggatggataagaagaatcatgggccgggtgccgctggctcacgcctttaatcccagcactttgggaggtcgaggcgagtagatcacgaggtcaggagttcaagaccagcctagccaagatggtgaaaccttgtctctactaaaactacaaaaattagctgggtgcggtggcaggcgtctgtaatcccagctactcaggaggcagaagcaggaaaatctcttgatcctgggcggcagaggttgcagtgagccgagatcgtgccactgcactccagcctaggtgacagagtgagactccatctcaaaaaaaagagagagagaaaaaaaaaaaaaggaatcatgaaagggaattctgttcactttaagtagcttgagatcttgagatttctggagataccagtaagagtgtgtcagagagaagatgggaaataagaattttaaaaaataaaatcttgcaagatacactatattgtttgagctttattctgtggcttataagaagctcttggagggtttaaaaattgaaaccaagaaaaagaaatgttggctctttaatcagagtagaatcctaataaacaatttggtatgattagagtggtacttgagtagtagctgagaattgggatgtaatagtcaatataatttatcaatgagaagagcattcatcacctgggagaagaggaaagaaactcaagcttttaaagaaggtggaatatattggacctcaacctctgatttaaaatatatggtggtacccttataggagactccattttttttttaaaggaccatggtgttcagtattatgtgctttctaacattgaatttggaaagtttcactgaagttcatggcactgggaaaaccaccatgcaatcagggcagtttaaagatagtagaggaaaaatcacacccgtgattgcaaatgcttgtgttaactgaatattgttttggaagttggaagttcgagaagcctattgaacaatattttttttctctgactaattctgaactacttgagaggtaagacaaaagttagagctgtagagatcaaagtatccagttaaatactaggtaggaggttgttacacaggcccagtttcttgtacctaagggaccagccagacaagtaaatcacttttgcctggggtgatgtgagtaagtgggaggacctggaggcatacactaatggatatctcttcccttgaaaaataaagctgggaaaaggtgattgcttgtcttttagtcagtatttactgctgagactggaaaacattaatgcagtgataatttgctactctcaaatagcaggtttattgtaggtacagttttggaatttcaaagctgaacgtgatcttggagatcatttacttaactcccctcgtttttacagatgaggaagatgtgggcctaaaaaggtcaacttacttaagataacacaagtggaagagcagatcttctgagtcaccatgccaacgtctatttataagtaggaatgctaatgcattgctttttcaatagaaaattaagtgaaatttctcatttctattttcttatatagaaaaccaaaatatgagaatcttaaacacaataaagcaaattagtactccagctactttacaatgactactaccacttttacacatttcttttcaaatgctttttaatgcatacaatttatatgtgaggtgtaactgcagcatccaaattggaatacaagagggctccatctctttcatgtgaaaggactcattttgctgcttgtcttttttatagagaaccattctgaaagaatacaaggtagatatatcaagaatactctgtatctggaatttttttctaacataagctttgaatagctgtgtgaatgtgtacttctttccttgaatctaaaataagattagaccagatatggcaaatacgtttcttttgtccttcccttaaattgatytcatagttaactgctttggagattctgggaagatggctgcacttgcctcacattcttcacctggataatccaccacagggagcggagtcccatgccttgtggttcttttcatccctacttaggtaattgctcagctcccattgggttataacattctgcaactgtatattttagaagctcgtttttttttttctgaattaaactaacttataatattactgagttttacataaagttttattctttagactaatcaatatgctagaaccatctatagatgtaactcagggaactagttcttctgttgtcatatgacagattattccacacaaacacacatactaaaaaagccattgtgaactaagctcaggaaatttcaactgaagcatggtattattattattatgtttctcagcatgagcagtagttttccagaccctcagccaaatgtctgaaagaagataaagtacagtggactttcctataacatagtctgagaattaaaatcaaagtgtcccagtaactaagctgtcttaaatgggaagtgagatcttagattccctttgttattaaggatcaagtctttggtggtttttagtatttaaggtcaacactcactaatcctttttttgaggggtgaatgacagcttaactgcaaagcatagtttcagtttactgcctggcaaatacaagcttattaaaaaaaaacgcctgattttattttgcatttgaaatttatagaatacaaggtctttttgtatcatagtctcatcattgtaaacatcagttatcactaagtaaatgaacactggaagtgctattaacatatattttaagttaatatatagacaaatttgcttttatagtgtatggaaagacttatgcccattgatcattcatggttttgtaatgagcgtttttaagataacatttaccaaagctctatattttaataatccagaaaactataaagaaaataaaaaatcagccaggcacgatggctcaagcctgtaatctcagcactttggaggccaaggtaggcagatcacctgaggtctggagtttctgaccagcctggtcaacatagtgaaacaccatctctactaaaaatgcacaaattagccaggtrtggtggtgtgcacatataatcccagctacttgggaggctaaggcaggagactcgcttgaacccaggagccagaggttacagtaagcygagatcaccccactgtactccagcctcggcaacagagtgagactccatctcaaaaaaagaaaaagaaaaaaatcattcataatcttagcatccagaaattatgatgtctatatgtatttacataattgggatcatgtatgtacatactgatgtagttttataatcttttcacataccaaatatttgaatattttctgtgtcactgaataaccttatagagcatgatttttaggatacatctataagaatcagtatattccatcatatcaatgtaccacttctttaacccttcctttttgacatttagatggcttccaagtttttcctcttttaaatttttattttcttctttaagttctgttggacttgattttttttactttttaaagtaatgttgtgattaatgtcagtgtgcagaaatatttctgtatatctgtgatttcattaaactgttagaatctgttaggtcagcttatactaaagttttcaatatttttgtcycccagaaagttatgcctgttaaaattttattcacagtgtattagagtgagttggtctgtctctttgccttgttttaactcttttttttttttttttttttttttgagacagagtcttgctctgtcacccaggctggagtgcagtggcacaatctcacctcaccgcaacctctgcctacagagttcaagtgattcctctgcctcagtctcccaagtagctgggattataagcacatgacaccacgcccagctaatttttgtatttttagtagagatggggttttgctatgttggctaggctggtcttgaactcctgacctcaagtgatctgcccgtcttggcctcccaaagtgctgggattacaggcgtgagccaccatgaccagccttaaatctttgtagatgaaaaattacttatgtaatttaatttgcatttctttagttactagtaagtttgaatctctacccccttcaatttatggccctttgcagttgtgggggcagggcatgtgttgtttattctatgtaggggtgcttattttagttttggcatttggtgcgttaataatgcttttttttttttttcaaactaaagctgtgtggcaaggagagaaaagcatggttttttaattcatggacttgtatttcgttgtcacttatgtatttcctgtgtgtctttgggccaactgtctgtcatctgtgagcctgaagttgactgacctgccaaaaaagatgattatgagatttaaatgagacacctatcccagaagaatcactcgatggtagctgcacttctccttttcctcacctcctcattatcacctacctgttatttctctctttaggcatttttgaacagaattgaaggaaaaygccattcargtctgctatttgcctgtaaacagagtggatacaatctcactgaccacccaatagtcactgttaaaatcttttcaattcttatgatgacagctgatggatatacttttacattatatttagtgagaaaggagtggaaagagagccagcactggaacaggcacagccatcagaggagcagctttttcttgtctgtatcttatactacacgctttttttttttttttgattaaagactagttctctgtgttgcatttttatgccaactttagctgctgccagaatcttggatgccctaaataccagtgcttacagtggaagccagcagggtgkaccagacagtgaaaaagattcctttgctcatgttgtcagcttatctgaaatcttgaacagctgtttgaatgaatgaatgaagtacatattaaagggagttacagaacttccaaaagaactgcttttatcaggcagactccctgtaagcacctgttgagtagatcctctgtcaggcacaatgccaaattttggagatacagtggaagtaagacactagtcctgtgctgaagatggcagatttaaacaagaaaatagcattaacaaatgaaatgcrgcatataagtacgaaaggactacaggtgttctagacaagaggatagtcatctaatattggaggatattgtcataggaaagttccaagatattcaagaaattgagacctataatttggaagaggttttggtttcttccaaagtgagagagtgaggcttaattctctcctgtattaaactgtgttgctataattgctttgtctatgtcagggtgacttgtaagaagcaaatggacatttgagtgcaactacacttttgtttaagacatatggcatatgtatttaccttcccgatatcaatatggcaggtggagatgacatgccatgccaacaggttttggtagacttgagttcttatacatgggatgatgttttgttttattttgttttgtttttttggctcgggagaggacaggcaccaacagatagactttctcaggatagaccaccatgactagaatgcaaaactgtaaaagtgactgctatattttaatcagcaaatctgccacagttgtgggacattaaagccctaattgaccctacatcacctaaagataggtgctgcactcaaggctgcaaagggagccaaccacttttatatatttacatatttaaatccattctccagcaacaattgaaatacttgtaagcattttaattcttcctgccggctctgtatttcaacctgaggacccaaataatacaatttcatccacaacagtaaagctaattacmcttgactgtagcatttctaatacaattttattttagcatttcaaaatacatttgaaaagtaaattatgagttcttccaaactagattctctacttagtcacattaaaatgatcaaaaaatggaaacattataaaattttttgccaggaaaaacctacccatcaaaaggagagaagtctttttttatattgtctaccatatgatacaaaaattaattttggtaatattaacaaatgttccttttttggtaatacttsattcctgacataaacattacatctatgttattaagtcatgtcttctagaatacagcctgaactatgcataagacttctttgttttgaagttataaattttattattatccttttgtgagtttttgcctctcacaggtcacttttcttttgttcagaagtggttctgatttaaggcaccaaccttaaatgtttcactgacaattattaaagacacattgcttctaaaacattgtactgtgaacattaagtgatagaaagataagactctgcctcactccaaagcggctgatttatttgaataaaaactgtagtcacagataaatacaatatatagcataatgtaataaatctataggagagaccaacaaatatgaaagaaagcttagcaaacatataacaaaatagtaacaatttttggatgataggatgagtgaaaggaagagtagtgctaagtgaaggctggccatgtatgctggagccagatcttagaagactttggatgtctttctgcatgtttgaactatattctccaggtaatatggagaaacttaggaggactttttatgcccttctccatctccattagaaagtaatacttgctcattatacagaattyggaaagtacaaaaaagtatacaaaagaaatgtaaaatcattcgtaaattcattctctctcctctgtcactctactccatcccgtcttccagtgctgtttcctgacccacagtgatgtgattagagccacgctttaggaatggcacctagatgtggtgtatcataagttgcaggataacttattaggaatcttagtgtgcagagggaataggaaggagtgagtagaacaagaatccttttaaagatagaaacaggctgggcatggtggctcacacctgtaatcccagcactttgggaggccaaggcacgtggatcatttgaggtcaggagtttgagaccagcctggctaacatggtgaaattctgtctctactaaaaatacaaaaattagccgggcatggtggcatgcgcctgtaatcccagctacttgggaggctgaggcaggagaatcgcttgaacctgggaggcagaggttccaatgagctgagatcacaccactgcactccagcctgggcgacagagggagactgcgtctcaaaaaaaaaaaaaaaaaaaaaaaaaaggaacaaaaggcgatttttactgatttcatgtgggtgtgtaggaggagaagaggaagtttggttgtgtgattgactgccctttcaagcccctgtggccaaaaggatcctgttgtcctcaaacatgagaaaccttacagaagacagaatgggagacactataattttgctttggggtactttaaatctgaggtgctatcaagtcacctaactggtccagaagtatgaactgtcyatacagaatcaggaacccaggtaggaggtacagatgattgctgcatttgattttttgcttacagagcattcacctatttattttaataaagaaattaccagtttttctagtgtgttcttttatgtggatggtttctgaggctgtggtgacaactgatttaagaagcctatttacaaaaccatcagttctattaaaagatacatgaggtcaaagttagtgtgattcaaggtcagtgatccccagatttgaccattaatcctatactaacggaagtgatggcagcttttacttcaaaaacactaagaataatgagataacactgtcctcgacatgttttaacaaagatagttgattatcttgtttcctgtaaaggatttccaccctctgagtttttccaataagtaaggggaacatgagacagataccatttgtagatttagctgtatattgacattttcagtcatgatccagaattggtcaattacatatgactgcagttcctggagaagtctaaatggaagggacaatctgtaaggaaatggagtctttcctgctttttcagggtaacatgattattttttaacatggatcacagctgcccagaatgcagtaaagattttttgtgagtctaatcttaggtttacaagctcagccttgtaccacagcatcagtgtcctcatgtatatatgcattccctaacaattagttgtttgtgcttcaatcttgttttgaaggtttttttttcccaccatgtgatgtctggcctcagcttgaagagtttaaaaattaagcatattttactcctgacctttacagaaattaaaatttttggttgtactgtgtaggtctcagtgctagaaatgcttgctaaaacagtttttttaaacctctatcagcatttgaagcagtttgagattgtagaaaattgtgcaacctttgttttattatttgactcttacagatagtgctaaacctcaagtatgaattctctttatatgagaccagaacactgtggaaatacaggattttarataggcctttacaatgcatatattttacataatttcaccctaaaaatgtaacatgtatttggcaaaggaagggcttttgttgctgtcattctccctcatgtgttcctcttgtgcctgactgactctgcagggggaactttagttctcaggaccttggtttgctcatggccttctgagattgatgctgcctttcctctttttgctcttgttgcaaggacagtgcaatcatattcttgccttccttcttctgttgcacaaatgactggcccccctcaccaggatcacttggaraaaaatctcttagtattctgagagggcctagactcccactgagtcctccaaaaggactgaagatagaggtttcctagagcktctggctcctctctttctttttagtgctggttctctctaatcttctttgtaaactcccattctctgaaagacaaatgcttttagggactctgcatggcatgtggattttactcacaaaaactgtgtcccagagctcccctacctatttttctaccatctcttcctgttcattcactgctgtatgtagccttggccatgttggcttacttcctgtcctgttattgggttcttctgtcttactcctaccttgcacatgctactcttcttctcagaatgccttccacacatactacccccaacccgccttatgtttgctcacgctaaccattgcaggctgaagtctttgctttcggggtcacttgggaaatcctttcttgctcacctctcttcccaggtaggtttagatgtctctactgtgtgctcccatagcatggcccacatccctttattacggcccttatgttggttacaatgacaggtctgagattaataaagtttttatttttttccttttttttcctgtcacccagtctggagtgcagtggtgcgatcttgtcttactgcaaccgcctcccagattcaagcgattctcctgcctcaccctcctgagtagctgggattacaggcacctgccactacgcccagctaatttttttgtatttttagtagagaaggggtttcaccatgttggccaggctggtcctgaactcctgatctcaggtgatgcgcccaccttggcctcccaaattgctgtgattacaggtgtgagccaccgtgtctagcctcataaggtattttcaatactgagcatagtgccaaccagtgagctggtgcttaataaggatttgaagtaagaatcaatggctcaaaagagagagaaagtatgaagtgtaatttctgtatctgcagtcagcattcacaggctcagtagtttgagaaacctgtatttcctgctttgactttttcactatttcttaagtgctactgttcttttagtctctaaatcaaaaccatttcacatcgagatatgatacatacatatgtgtatacgtatgtgtatatttgaaaccaaaagttttgaagtacaatatgtcctcttactacttataatgaatgctgatgtttttctattctatcctttttaattttacttttctcaatgctcttcatgacctattagattgattcacaacctccttaggtcacagtcagcactttgaaaactactgctctaaattactgtaccttttctatgaggaagagtkgaactgttggtgtatcagtcagggtcaaccaaagaagcaccgccagtagaagataacattttaagagatttaccaccaggaattggtttatgcatatgttgagtctggctatgaaggtctgaaatctgtagggcaggcagtgaagatgggaggctggaagcctcaagcataagttgaagctgctgtcacaggcagaatttcttttatcktcaggaaacttcagctctgctcttcaggcctttcaactgattcagtgaggcccacccagattatttaggataatttcccttacttaaagtcaactgattttgaactttaatcgcatctacagaataccttcaaagtgacacttggattgatgtttgattaaataactgggaattgtagcctagtcatgttgacatatggaaggatcaccatagctttgtgcagtggcagtatcacagcaaatgaggtttatcctaggcgtgattatagctaattgaagacttttcccaatatcccgctgtgaggacttacaatacagtcggcattaacattttttggcagtctttatggagactgaataaaaataaataaataaaaaataaatgtaaaaaaaaaaaagaccatcatagtactgtgaagagcctggtcatcatccttttttatgtaaggagtaggaatccattttagtttgcccaccactttatatcacattccttttttcctctgcactaatgttaaccttcttaagatcctcacccacttatttggcctcatccgtgttttggcattctcttccaccaccctgggtaaatgtatgtacggttcctgggagttttacagaggtccttgtgttgagagcccctttcactttagcccgcagttgtttctgatgacctccttgaatgaacagttaagttcctttcaaggctgtttcattctgtttccaggtaaaatttggggcttgaggtactcttcccaaggtactcaagacctcagagtttaatgtttgcttttcatgatastctttaccccactctcccttccattcagaggtccagtcacccctgggggattttcatgggagagtgtaaacttctgtactggagaagcttaaaagtctcactttccattttcacgctcaagagaagctctcaaaccctctttggtgtgcccggcatccccttatccccatttcccctctgtaatctcaccatgtgtgcacacacatacaccttgtattggtcctctccatctgttttcttatttagacaatttagactaattttcctccatgggcttttagaaacacagtgctggcagttgtagtaaaagaagcaggaaggaccaactgctgagacacatgctagaacaaaaattgatttactaacttaacttgctgcatctgtaaaagagtgtttacttcttggaatgaggagtaagttatttcatctaggagactgtccactgcccccaaatggttgccaattgggttaattagttaaatgtttctgtgatgaggacacctgtccagtggaaactggaccaaggccaccaatttatttcatgctggccaccagttgtcagttagcaaaacatacrtctccagtttaaaactctggctgaactgaaagagaacattgctaatttctcatggatagttcaattgtttacaataaattgaaaaatactgaggaaaacatgaacatcagtggaatttcccagttctctgttaaaaaactcgctaatttaggtttaattgtcttagaatttgtccaaattcaggatgagctaagtttacatttatgaaggatttttttccctgattactttaatggcataaactatttttacaggaagaacttatttttaaggcttttctaggcaatactataccttaaaatttattaaaaatcaatgaaaaataatgtatagtaaccagtaagtcataaatagaagatggaaaaaagaccaaccattgcttgaaagtattcagtctcactagaataaaaatgaaaattaaaataaaaaaatacttttcaagtattttaacaacacatatttgccaataaatggtaccaattatgattgaattctatgttgtcaaaagcaagagacttaatcttatttcattaatatttctatatgtgtgaccttaataaaactctgcttatcttgaaatattatttcactaaaaatcttcatatatatgaaaatttaacttttcatatatgtgttacatatatattttacttatatatgtgtgtgtatgcatgtgtgtgtatgtgtgtgcatgtatgtatatgtaaaactttccacaaagtcaactgtagctattttaaatttgaggagtcgtggtggctcatgcctgtaatcccagcactttcggaggccgaggtgggaggattgtttgaccccgggagtttgagaccagcctgggcaacatagcaagaccctgtctctattaaaaataataataaataatttaaaaatttagagagtttgcatcctctgtatttgaggtggttggtgctattgataatacaaaaatacatacttgattttatcatggacttttgtatatgtttgaatatgaatatgttggggatacaacaatttactccaaataatataagaagaatactatggagatatgaattgagaggacttagtaagcagcgtaagttgtgttttccagtatctttaccacatacttctgaagactattttgctcacgccttcttttgtccttagataagaactgattctgaaaactatccctctttgtattgcataagggaagaaacacatgagaggtaggtaatatggaagatatgatggatgccactataagcagccatgcctaggttaccacagccttgtgtgaggaaaagctgggaagaagatctatgaccaccttggatggaaggtggtattcagtccccttcctgaggcccctaggcttttggaactgggcttagagcagaagaacagaaaatagggccttgacttgagattaatgcttttgacacatccccaggttctttgtctgatttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctctttgtctgatttattgtcattaatgttttcacttaaaatgaggtgaaacgttcttagttatattaatctcttggccccaaatcttgtgtttttaaaccaagacaggatctttgcaatccatagtaatagtgagcaagtgattcttttagatggtagcctggttaacataggctagtttatattgcattactaaatgatcctaatatcttctaacagatgtttacttctcactgatgttacatgtccatgttaggtcaaagggaagctccttgtattcagtatagtcactaaggtacttaaacttgtccatttccatcatacgtactttccagattccagaaatataagaagaaaaaaacactgaaaggtcttgcctccgcagtaaaatggctcagtcaagaagtgacacacaccaccactgcccagaacccattggcgagaattatttacatagccccaccccaaggcaacaaagggtaaagaaagaaaataccctttctacccagaaggagaactggaaatactgcttagcggcactaacatcttcataaatagactagtttacctttctttgggctagctcacatggattacagaagtgagcttactatttatatgaacaaatataaattgacctttactttctctttttttcccrtagttttgcaagaaaaaacttacttttatgatttttacatgtattaatctttacatttccttttcctcctttttgtacattaactgctgaattcagagtttgagtcattatgtggatttttggttgttaaggagagcatccrgcctgttaatgctctcaaatggggtatccctcagaaacctctccttgcaaaagtagcttatggatattatcttttacctgggtagaggggtttcagctgccttgctgacctatatttagtggagggcagtagactaagtgttttggtttggcatttataatgcctattagatgatttagatatgagaatgaaactagcagagtggtaaaattaactaaaagcttaactatctaaaaaacataataatatcttctagatagaaatatgggtcccagattatccattcctsaaatgctctataggattgtgtatttatgtggcaatattaaaaaacgtggaacagataacttgctataaataagccacaacttagaattcatgcttttagttaacttaccatcaaatgtaggtatgaatagttgaagacttgtcatcagagacacatagtgataagaattttgattaggtttcagagtcgcgattgaccctagaatccagcagcctcagtatcataatcgatcctaccttcttgcacataaaagcctgagctcagaaaggcccagtgagttggccaagcccacagcgtgtggcagcacaagttctcattgaccgctgccttacatgtgggccccatgcagtttcccctcaatattctttcctactgcagtcctagctaggttggctttttcttttctaagctaggagtttaagtatggaaataatgatattatccttatgaaatgctttaacttgtcaaaagtgtctctgtaacttgtaggtgttgtaaatctgcggtcttatttctacttacttgtaaggaagtcatattcctgactaccttgtcaaataccaaaaagttcagttttgcagccagagaatatcctgtttgaaagactttgtgatgactcattttatgggtcaacgttggtrggccacagtacccagatatgtgggtaaacattattctagagtctatgaagtatcttttagatgagatgaacatttaaagcagtgggctaaagcagattaccttccttaacgtggattggcctcatcaaattcattgaagaccttcatagaagaagactgacttccatcagagaagaggggattctgccagcagactgtctttggacttgaactgcaacattagttctttcctgggtctctggcctgcaggcctaccctgcagattttggatttgctagtccctactgtcatatgagacaattccttaaaatcaattttaatataaatatatakagtatgtataaaaaacacatataaagatattaattctatttttctggaaaaccttgacaaacgtaggcttccttgtgttgccgtttgaactagcatgctctctacctcccattatatagagtatgtttggttttttttcacttcttttttttttttttttttgagacagtctcgctctgttgcccaggctggagtctggagtgcagtggtgcgatcttggctcactgcaagctccgcctcctgggttcatgccattctcccgcctcagcctcctgagtagctgggactacaggcacctgccatcacgcccagctaatttttttgtatttttagtagagacggggtttcaccgtgttagccaggttggtctagatctcctgacctggtgatccgcctgcctcggcctcccaaagtgctgggattacaggcgtgagcccccacgcccagcccaacttcttgttctttagtaatccattaaaacactaggcttacaattagtgaaatgtactttttgtcctaatagactttgtcttatatatagcatgtgtattgtcctctgaacttctcgtgtaaaaatatgaaaaaccgtgggaactctctttacccttttctgccttactccctagattggttggtaaagagataatttgtgtaaagtgctatattgtctataatttaaagtactttggcatatataacataatatttatgggagtaactttgttttaggaccctttagttaattttctaggtatttcaatcatgaatccacacactaggattagtaagttattatttgaaagacactgattagaagcctgcacccagatattggtactttaaatctacacaagacaatgtattaacgttaagtatgctacaaataattggtgaaatgaatgatgttgaagatacaggggttagcyttagaaatattttatgtaactagactttgggtcaggcgaggcttgcagattaacagcttttggartaataacctaactagtactccatttgatcctgttttgtggtatgtaggattctggtgagtgatccacttagaaggttaaatgtatcctactgtagaatgtagttgcaactgctytaagtaaacctttcacacaggctacttttcaaaatgacttttaaggacagaaatctgggattttagagttttatgagataggcctatgagtctgttttttgcaccttccagttaagcaatgtttttacatgagcagaatttagtttgaaatttcttttcattgtaacatactccttatgttaaaagcttgcagaggagtagactaaagccctcagctgtttacatctttggagactaccagtgtttaccctaaattgtctgatgattataaactccagtttggcttacttcattttgcagcaagcacctaacatactcccgggcacacactggacaatcartacactagataattctacctattgtcgatcagtgaactaaccttaatttgggggaagaaaaggaaagttgagattatacattgctctaaagctattagaatcctcctttgtgaggcttgccaggttggtttttggaatgttaatatgtggctatcttctccaggcttattgttagtttcaatttagagcttattttgcagagccactgaaatcatgtgaaggtgagtcagggttctgccaaggaagcttgtgatgagtgtaacctgtttgtggaagcatgtgaatgtttggcttatctccaggagcacactttgctagccatcatctgaaactcagcatgctaggacctggaacatttttcatctttgatgtgtcaggaagattttacagaacctggaccatagcctgaactgagaccgtgtggaagcattgtgggagattccttccagtcagtatttatagaatatgctgaatttatttagacctgcattgattaaagaaaatgtgtcataaagaagtgaaggaaataagtttttttcttattgttgaaaatgtattgctgctgttttgaaaaagtgttgtggttcaaactactgaaaatgtatataagataatgattctagttgaaatcttaaaataagctaatttttactttatttgcttttcatagccttgggttgttcgttcagaaatgtccttgctaaccgtgtttgtaaacttgttacccctgaaagcctgtctctgctgtgaagcagtggatgaggtcttgttttgtttcctttgatcgagaaaccagaatatcacttattggctctgaaacaagaagtcttaaatttaaacatcttttgtttacttttctcagtgaaataaaacaggaacaatgtgaaggtagcttgaactacaaaaatacatatatcttgttggtgttgaacattaggrctcagaatgctgttggcctttagagttttttgtgttgctggaataccaggaggartcatgctctgattattatctgattaattatccatttttttgtagagcaattaaggttaataaaaataatagaactattgtaagaaaatggaaagaatcaagwtcatgtagatgaaagggcttcctggtcagagaaaacacagaaagcctggcaggccatgagccattgtgtaatgacagtgcattgctctagacataggtggggattttggcagcctaatctatgttctaatactaagtcagttatgcagatttttgcttaaagggcattaaacatcctagtgggtgatatattcaaaacatgtttatgaaagagagtatgaggctgggctcatgcctataatcccagtactttgggagaccaaggtggaaggatcgtttgaggccaagagatcaagaccagcctgtgcaatatggtgagaccccaatctctattaaaaatgtttttaaatttaatttaaaaaaagagagtatgatatgggtagtaggtatcaggggaaatattatccctcatattaccctgagaaagcttttcctctcccctcattgaaccaagcataattacatggactatttcattttattttcctaatactcttatggggataggcattattataaaaaccattttgtaaataaggagactgcgccttagcatggttttacaacttggcaagtgctacatagctagggaatttagggggctttaaattaggttaaaattgggaccataccaattggggatcgtatgaattgggaatatctttctctttatctgcagcatgctcttcagcttaacgatgtatgtatctyggggtcttccatgtcagtagagagatatacatctcttcaatcactgcattgaattacatatttgtatatatcatgatttagcaagccattttctctactggtggacaattaggcaatttcctgctttgggctattacagatagtgctgtaatgaacttcttttgaaatacatctttgtacacatttgcaagtatttctgtaaacacttaaatgtgacatgattatgtaaaagacatttacatttaaaatattgataactactttctagttatgctttcctcttcaaaagtatcctttttttctatatcctcacaaacactggatgttgtagtcttttttttgtttgtttttttgagtcttattatgtcacccaggcttgagtgcaatggcatgattttagctcactgcaacctctgcctcccaggttcaagcaattctgccacagcctcccgaggtgcacrccaccacgcccagttaattgttgtatttttagtagagatggggtttcgccatgttggccagactggtttcaagcccctgacctcaagtgatcggccctcctagatctcacaaaatgctgggattacaggcatgagccactgtgtcctgcctggatgtggtagtctttaaaaaaaatctattcttatggatgaatgcatagtatctccttgttttaatttgcatttgcttaatttttaataaagctgaacatctttatatcattaattggacattagtatttcttctttgttcaattctcaatttcctttacctacttatacatgcaattgtttgagttgataaagccctttatatattaggaatattcatgtttcatcttaatatttggtcatactttctgctaatctgtgacttttcttctaacttcattatggtatattttattgcctagaagtttttgggctttatttttaatcaaattatttatttcctttagaacttctaggatctgtgaatttctttctaacctgttagctaaacattgtcccaaattttcttttggcactttttatatatgtatatatttttgttctgaattgtatttttctttgtgatataaataggaatgtttttcagataggtatctaattcttttcataatttattaaatagaccactctaatttgaatagaaaaggagtggaacagaatagaatataaaaatgratctatcccagagctcaaactatattgccttaataagcgaagttttattatgtgttttgatatccactagggcctgattctacccttattctttttcaaactgcttgttagttttcacgaaaaatgtaggtaggattttattttttattgtcttgaattcataaattaacttagggtaaactgatatttacagttatttagaaatgtggatgtctttataatattaaggattttaatccagsgaaataatatggcattgcactttcttcagggctttttgtactcatcacttagttttatagagagaaaaatgcttgtacatttatggttggtaattactaagtgttttattgttttgatcattttgttgtattttctaagtttttgtatataggtattgagttttaaaagttacatcgctttactgaactcttattagttctaatactttttctgttaaagctcttggattttccaagtaatcagttgtttaatctgcaaataacgacttctggcttttctttttcaataatttgcagtgttttctgcatgcctacttaatttacaagcctataagtaagctgaagatgaagagtgtattacattattttctttttctttttcttttcttttctttttcgtttcttttctttttytttttyttttttttttttttgagacagtctcgctctgtcacccaggctggagtgcagtggcgcgggagctcactgcaatctccgcctcctgggttcatgccattctcctgcttcagcctccctagtagctgggactacaggtgcctgccaccacacccggctaattttttgtatttttagtggagatggggtttcaccgtgttagcgaggacagtctggatctcctgacctcatgatctgcccacctcggcctcccaaaatgctgagattaaagaatgaaatggtggcatagtcatctgattgctagatgtctcaaaaattatacacagtatcattttccaatatgcagtcttactgttttaggtttgttttatttaatttcagaatactctcaaatgaactttataaactagcccgaatagggaagaacattctgatatcagagtgtttgggatcctgaaaaaaaaaatgttgggaaggagttatttatttgaaacagttatttcatacttactttatatatagacacacgcatacatatttatttacttactagtattagtgaaattgagtgatgttccagaatgaatactgtttaaaccattgttttgcagtcataaaccgggacctattagcagaagtagagaagtggtaaatattaatgaataatttccagtcatatctgccagtgatttccgggacgcatgagacccaggcccagctaactgttattttgtgtgtaaagcttgcttctataggcattttccattgcagtacactcaactatcaatgttttccaaaaaactatagatatgtgtatgtgtgtgtatatatattttggtctagggtcttatatttgaaatatatattccttctcttctgcagtcaaatatgtgaatttctgtttattcttcaagactcaggtcaaatatctttgccttcacaacttctttaccttctcaggaaaataaaaacaaaatagttggtatatgctgcttttatatcagttaccacattattttgtaggtgcttattttgatttctgtgtccttcctaaactgtaagctactagaaactattccttctccagtgcctagcacaatgtcaaacatgagtttagaactgtaaaatattgttgaatgaataaatgtgaataagtgattactaaaaatataagaggaagtgaargatcaaaagagctgtctaagagaaagttgtaagtatgacaatgtaagaagaatattaggccaggcatagtagcttaagctggtaatcccagcactttgggaggccaagatgggaggattgcttgagcctgggaattcwagaccagcatgggcaatatagtgagacctcgcctctaaaaaaaaattttttttaattagctgagtgtgatggcatgtgcctgtaatcctagctactcaggaggctacagtgggagaattacttgagctcagaaagcagaagctacagtgagcctactactgcactccagcttggagtgcagagcaagaccctatctcaatgaaaaaaaaaagaagaagaaaagaaaaagaaaaatattagcatgggaaacatgctaatatttatgaatattatgaaaagataaataaaagcactaaccctatactatggaaatgtgcattttgatgcagtaaggtttactatggtgaagaaacatggtagagaccaaatagggatccaagtggcatgaggctatgaaaacatgttgaaagtcaagaagaaaacagtacccactcaggtacaaatcctacaaatgatactatttaagaagcatgtaccattaggagctacattatatctgcttctatatatgcgtatgtatttttggtttataggttaccatatatagaatataggaattacttgttttccaataatacaaatgtaaagtgtccatagaacagcagggccagctttgtaggaaatagacatgatttctttagtctttggccttcttttctgccttctgtttctactgcatctttttataaatattattttaaaatctaatcctagattttatgatttttgggggagcacagtttctttaggcacagtttagatgcataataattattgaattttattgaaaatgccagtgtctgttatgtatattaattggacttgatgaattatacatttatttctttcatatattttttcctgtattaagagagggattggacaactacttcagttccttttaagataaacatttcagcagaaataaggacaatcaagtttcttatggctatatctgaaggccacatttagttgtcttttaaatgatgtaggtaagaaataaacagcttcaatatcctgtttgctgtacagccctttagcgatattttcataataatttcataaaagtttcaatgagaattcaatttaaatgtatatgcaagtaaaatgagggatgacaaacaagagcccaggacagtgttagaatggaggtcaggttcagtgatcttatgattgagacagcattataatactgacaccctgctacttcagggctagtataggtcataccatgaaacaggttcagtgtaggtatttgcttaggtagcttcaagatggtttaccttagttttattgggaaacagcagagcgttccagctaatatgattcattctgattctataaaaggcgataaatattgctattcacataatgtgttctgaggctactttgtctcttaaatgattaaaagtggtactatcgcttacacattttaaaaattagtaagttacttttatactgactcaattttccttttcttaacatctcaattgattttaaagacaaaacagttgtttagaagaaattcatcacatgaatgtttaaacttacatagttttggatacctggcaggtttttttttttttctgtattatcatcttgttggcctcttactacaggttttcaacacatactccaatgaagactatgacaggagaaatgacgaagttgaccctgtggctgcttcagctgagtatgaacttgaaaaacgtgtagaaaagctggaacttttcccagtggagctagagaaaggttcgtgagtgctacagtgttaatatcattatgttgctatgttaataatacagrattatttttccaaaatgtagccttttttctaaggattggataaaattttaattctaacagaggatcttatttattaagtttcaaaaatagttgatatggattctgagtagatggtggattgaaagttttactcccaactgaaacccatctatcttagctggctgcgatggtggttaggatcagggaggtataagtgaggcctaatgctttgttggtattcctggaaagggctgctacagctgagagcccagaaagagctggtatatgagagcttggggcagatggtcgctttcttttgttttggtggataattggaaaattatggagatttttaataaaggcggtagaatccaaggaaatttaaatagtagggctacatcctctccccctctgaggggagaaggttgaaagagagcagggagaagagggagcagaaaggcttccttctgatttctctcccaggaatgacaccctgcctactgtagtaactgctgacccgtgggatcagagattaccaggtaagatgtaagatgggcacccaagaactgaactgtcactcagtgaacagagaaataacacctctgagagagctttgaaaaaaaaaagagtagaacaaacagatgatgacttgaataacaagaaaaaaagaaacaaaaacctacccaaggatactcaagcatggcttaaaaaaagacatttgcaaattatgcctctaacaaaggactaatattcagaatctatgtggaactcaaatactcaacaacaacaacaacaaaaagaaagaaacccattaataagtgggcaaaggacacgaacaggtatttcttaaaagaagacttacaagcagtcaacaaacatgaaaaaacactccacatcactaatcatcagagaaatggaaatcaaaaccacaatgagacaccatctcacaccagtcagaacagctattattaataagtcaaaaacagcagatgttagcaaggatgcagagaaaagaaaatggttagatactgttgggggaaatgtaaatcagtacaatctctggaaaacagtgtggagatttctcaaataattgaacatagaactatcatttgaccaagcactcccactactgaatatctccccaaaggaaaagaaatggtatcaaaaagagacttgtgcttgtatgtttaacagaatactatycaatggaaatagtcttggaaatagcaaagtcatggaatcaacctaagtattcatcaatagatgactggataaagaaaatggggcatgtatacactatggactactgtgcagctataagaaagaatgaaatcatgtcttttgcagcaacatggttggagctggaggccattatccctacatgaaataactcagaaacacagagttatttgctgcatgttctcacttataagtgagagctaaacagtgggtacacatcaacatacagagcagagtaatagacactggggactccaaaagtttacgagggtgggagggggatggggcttgacaaataaccacttgcgcacaatgcgaactattcaggtaaaggttacactaaaagcccagactcaccactatgtaatatatccatatagcacacctgcacatgtactcccctgaatttatacagatttaaaaaaagacgttcttgagcaacttagcaacaagaacaaatttcttgattttgaaatgaaaaatttcaccggaagaattgaaaaggatagttattgttgagacttaagttggcgatctagaagatgacgtttgagagatattccaaaaagaattctcaaatgacagagcaaaaatccaagaaaaatcatgaaagagtcccaatatataagttgtaggcaacagaagagaaaaacgacaatggagaaggacagactaataataatcatagaagaaaaatttcttgtccttaaaaagaagatctgaggcttatattaggaagaacttatccatttatgagtgagagggctaaataaccccaaactgatcccacacttaggcatagcctgggaaaaaatcctaatattcaaagataaagtgaaagagcttaaaaaattccaggccaaaaaatacccaaccaaacaaacaagcaaatatacttgcaaaggcaaaataattagactagcatcagactgtaacactagaagcagggagatgtagaaataattttacatgccactgagggtaaaaaggatggtgatccaagaatcccatatccatcccagaaagcatttacctatcctggtgaaagaaagacatctgctgctatctaaggatttaaagaacacattgcctacatactttatctgagtaattcactgtccaatttagcagggagggagtgaaacaaagagcagcttgttcaaaacagcaagggcaaggaaaaaagaggtgaaaactatgaagtattaaacatacaattgcttaaatgaaaaagtatgaagaatactagtcatattacaccaaacatgactgatggattactcctgttaaaagacactttcatttggagttaaagtgaattaaagagtaatgcttacatttttcatacattttaaaacataaaagccattcttagttcattggccatacaaacacagctgggccatcatattacttattttggtagtagcaaaaaaacaagaccaatccaaatattcatcaatggtagaaagggtctataaattgtagcatatctaggcaataaaatattactcagcagcgaaaatggaggtgccacacttcatgcagcagtatgtatgattcttaacatgatatcgagggaaagtaaaaatagcaaaccacagaagaaaccatttagtgtaatataattgcatttacttacatttcaaaccaaaaaaattaaatagcatattgttttgggatacacaaatgagtagtttttaaaaagtagtattaaaaagtagggaatgattaacacaatgtttagtataatggtcactgaggaaagagttgctgtgtcagggagggatatatagtggcttttgtgatgtcgrtaatattctgtgtctttgtacatggatgtttgttttatttttatgctttaaacataatgttttgtagataaatattaaactcatttgtatgttgccatatttcatactaaaaattaaactagaaggtaaccaaatcaaatacaattattggagatttcaatatatttctttcagaactggacagatttatggacagaaaacaaaaatcaaggagtgggttaatataatgaactctatttcaagctgtattttaaaagaaaaagttttatcctttggaaaaatgttaaaggttcctttaatatgagaatttggaaattacataatacattcctaggtagatgtttgattgaagagaaaattataactcatatcccaaaccatcgtggaaaggattaaacttaaaaagtccgtctcaaaaaaaaaaaaaaaargtctgtagcacacagcaaaacctttactcagaggaaaagctatatccttgatttctttctttaaaataaaaaacttgaaaagcaaaaaatggacctgtcttagaaatcaggaaaagtaaaccaaataaatcaaacaaactagcaaggaagagtagtatatgtaaaaacactattaataacatagaaaagaaaatctagtaaaataaggtaatacaaatccttttcattgaatacatctataaaatatatcaatcataatactgagtggagaaaattgaaagtaaacttatgcaaattaggaatggaagaaaaatatatagtgttactataaaagatcagtcagtcactgcatttctttgtcaaatgaggtgaatgcccagaaataatttatgtcctaacaaaatttgaattaccagaatcaactttagtaaaatagactaattgctatagaagaaactagaatgataactacagataaaacattaaaatgtcatcacaaccagatgattctattgtacctttaaagaatgcataaagccagtgttaaactattttagatcatagataataaaggaaaactcttcatttcattgaaataccatataagtttatacccaaaactaatatgctacaaaaaagattgctataatacaactacaattgtgaatatatattttaaaatgctaaatgaaataaaatatcaaatatagaaatagttgaagagaaaaggccaggtgcggtggctcatgtctataatcccagcactttgggaggctgagatgggcggatcacgaaatcaggaggctgagaccatcctggctaacacatgaaacctcatctctactaaaaataaaaaaaattagcccggcgtggtggcacgtgcctgtagtcccagctactcaggaggctgaggcagaagaattgcttgaacctgggaggtggaggttgcagtgagccgagaccacascactgcactccagcctgggtgacagaacaagactctgtctcaaaaaaaaaaaaaaaaagaaagaaagactcattaggatcaaatggagttttagatacaaggatatagagtggttcattattcaaagattcatccacatacaatttaaaggaaaagcccttaaattttttaaatttcatgtcaaattgktatgaaaagatgtcaatttggtaacatttaccactttaaagaaagactgtaaattaacacatgatggaagctgcctaaatttatgcaaactataaatttacaatacctacagagaattctaattctaaattgagtaaacactaaagatattttaattaaaaccagaaatcaaatttgtaatgccctttaaatgaaatgaccagtataaataacagcaaataaaagatgaaaagcatcatcttttgctgatatattcatatccatatctatctagaaaaccaaattgattcaatattagatttggtaaaataatttgtggaggaagaggttacattcaagatatgtataaaaatcaattttttctatgtaatcacattaagaatttagaaatgaaaatgggaaaaatattttatttacagtagcaccaaaacaacaaaatatttattactaagaaaaacatgaaatttatctagataaaataataacatctttttgaaagtcatttctatttgaaagcaaattgaaagacaaaccatattcttggacaagaaggctccaaatagaactgccaacaaagttgggttgggagaggagaattgcaaaaaacagtattaaatttttttggtaaaatttaagtctggagaaatacagacttaagtatgaaaaggaatatgaatgacttaattttccaaatatctaaatataatgtaaagcttttgtaatcagaacaaattgtattcaaatggcaattgatcagtggaacaaaatagaaaatccagaaaaagatgttagtatgtgtgagaatttaatatatgacacacatgatatttcagcttagaagtaattatgtgctttataaattgttctggcataactgagaatctatctagaagaatctaaagttggataccttcattacagcataggtaaaaataaataactctacatgggttaaataataacatattaaagatgttgtaaagaaaatttaaatgactgcatatatcatctaggcttgtggcaggagagtcttaaccaaaatgggaaaccagaagttagaaaataagctttgggctccatagtatgacaatagtgtcttccataataacatagtccctctgtctttgccgtcattttatggctgttttgccttrgtgctttgcctgtccctaggaatgtatggagaggaagacagggtgcagctgggttctcgatgggtcagccacaggaataataagtggcctttaaggatgaggttccagacttcactcagagaaagctgtatgtaaataagatgctggagaacatcagtcttctggtctctgtgcgttgattgtgctctttcttgtattgcccttcagtcatcatgttgtccttgtaagtaatttgcattagaattgaggatggcttgagttaatattgctttttctgcaactggattttcagctctgcaaatctgagtaattttccagttaaaagcaatgagaggagcaatggaaggaagaaagagaattctaccaagacctgwgtctaggcagagaaaatggatttagaaaccaagaagtaattttcactcaagatagttgcaggaagaaattatttaatggtgtgacagtatggagatttcacatttgagaggagccttttgtacggtaatgagtatgggaaagtttgactcacagctctacattggcttgacatgtgataagttatactgaagagaaaccctgtgagtataatgaaagtgagcaagaattcagccagaatactaatacatatatacaccagagatttcatacaggagagaaattctatggtatttttctgcatggaagaggctacattgatcatctcttaaacaacacaagagcaatacactaaggggaaaaacttacatggatgtaaacactatgggaaggctttcagcaatcattcatccttcatcagtgtgaaaaaaaattcattttcttgagaaaccctatgaatgtgacgaatgtcaataagaattcagctatccgctaaccttatacacacaagagaattcatggtgggagagagaaaaaccctatgcatgtaaccagtgtgggagagccttcagcacacatctaaccttcatgtacacaacaaatctctgtgtacgaagattttaaagtttctgtggcgaaactttaaaactataatgaatgtagaaaatctttaacaagataaatcctcttgatgaaatcagtctttataccagagaaacaatttgaataaataggagaaatcacatgtatataaacttaataaatgtaatgaatgaggaaagtcttcagagattatttatgttagtcagcattaaagttttcacactaaagagacacctatgcttagaatcaatgtggaagtgccttcagctggggtttgcatcaggcagctcatccaggggaaacactgtaaagattcctctagcataccactgagcaaacaaatcacacttttgccaagtgacatcttttaaaacatatgtagaataaagatataagattgtcaggtgtacttggaaatacttcaggcataagttggttataagtagtaatgtatgagataaaccttcatccgaagaatactaattacaagaatcctggccaggcctggtgactcatatccataataccagcactttgggaggctgaggcaggagattgcttgagcccaggaggttgagaccagcctgggcaacatggtgaaaccctgtctgtacaaaaaaaaaaamaaaaacacaaaaaattacccagatgtggtggcacatggctatagttccagcacctcggaggctgaggtgggaggatcaccagaacccaggaggttgaggctgcagtgagccatgatggcgccactgcactccagcctgatcaacagagtgagaccttgtctcaaacaaaaaaaaaaaaagaagaagaagaaagaaaaacagaaaaaatgcttaagaaagtgaaggttattgctgaaaagtcttttaaaagtgtcattctgttgagtatatggaccaatatttctttaataatccatcactgttgattagttagtrtttttatgctgctagtaaagcatgattacaaagactttgaggctatcagaaaataaccttgaactttaactaaaacatgtggcacgcaaaatagtgtatcttttatatattcacagaaaggacaaatggaaatatggataaacgtgatttgtaagtgaattaaaaaaaaaagtcacacagtattgttcataggaccagtaaaatggaaataaaaatgtgaatacagaatggttggatacattatgataccatctcaccatgaaatattattcagtcattagaaataatttagagatatggacattgaggacattgatatccatgacttatcttttttttagacagggtctcgcagtgttgcccatggtggagcactgtggcatgatctcagctcactgcaacatctgcctcccagactcaggtgatcctcccacgtcagcccccaaacagctgggactacaggtgtgccccaccatgcccagctaatttttctatttgtagtagagacagggtttcaccctgttgcccaggcttgtcttgaactcctgggctcaagggattctcccacctcagcctcccaaagtgatgggattacagacgtgagccactgtgcccaggcgcttcattggtttttaaaaagtaagcagtaaagagaagtaggtataatctcatttgtgtaagcaaataagaaggaaaaacaagctatatatacatatatatacattcatatatgtctaagtatatgtatatattatagttgttgatgagtatatattcttgggtatagaagcacagaggaaagtactcaaatatactatctttttttttttttttttttgagatggagtctcgctttgtcacccagggtggagtgcaatggcacaatcttggctcactgcaacctccgcctcctgggttcaaacgattctcctgcctcaacctcccaagtagctgggactacaagtgcctgcccccacacccggctaactttttgtatttttagtagagacaggctttcaccatgttgccaggctggtcttgaactcctggcctcaagccatccacctgcctcagcctcccaaagttctgggattgctagcatgagccaccatgcccagccacatgtactatcttattaacatgaataaayaagtaaagaagaaaagaccatataaatgaaggaggaattccagatatgttatgatcagatttatttaaaattatatgtttgaatatgtgtactcttacgcctaaaataattcattgcattatttagagaatctaggttttaaggcagagtgactattcaataatcaarttgttaccttttcttgagaccacagtgaattaccaacagtagtagtaaaatgatgctaaatgcatgagccttttggaggatctcattagatacccttactgcgtagcttagaaaagaattctgctaaagcaagcatgttattgtcctatccataaggaaaaataaaattagaaacagcaagtaggtctcaccagctaattgcagactagtgtaaaacttaagttgtttcacctcccccctttttttctttttaatagatgaggatggtcttggtataagtattattggaatgggtgttggagcagatgctggacttgaaaagctgggaatattygtcaagacagtaacagaaggtggtgctgctcaacgggatggcaggtaaattaaggactgttgttaataacttaaaatctttagagaactttcctggaagtttccttcagttgtagctttttgcttttgtttgttgattttttaggatagaatttcaggtttctcagatgtgaaaatctttaaacacttgaattattttctgatatgcaggcaaaatatctgctttctttaatatatattaggtaaatgagtgggcagatctatcagtctatacctgtctttatccattcatctatctggtgggaagtgggcagaaacatgggtgtatatagttgtaaatgtgtgctatggaggtcagcacatagtttcacttcagaaatattgaaagaaatgataatagttctggcatcttaaaaaatgacacatgtagatggtaagttaggaactctaattctgtattgatggtaattctgaaggtcagtgtttctccaaatatatttatgtaaaaacacaggttcttgggtgcacctaaacctgtagaattaaaatctccagtagaggggtctggcagtctgcaccttggataattctagtacacagcagagcatccagattatcactgttttgtcttagctttcataatctcaagctatttgtctgtctgtctrtctatctatctatctatctatctatctatctatctatctatctatctatcttaggcgaagattttgattaaccctcatacttggctctgatatatcaggttgaggctagaagcagaaggtggtgtcttagtttgttttgtgctgctatggcagaatacctgagactgggtaatttataatgaacataaatttatatggctcatggttctggaggctgggaagtccaagattaaggggccacatctgatgaggaccctccagctgagtcatcccgtggcaaaaggtgcaaaggccaagtgagagagagcaagaaggggcaaaacttgcttttataacaaacccactctcaaagaaataaatccacttccatgataatgacattgatctatttgtgaggccagtgccctatgacctaatcaccttttaaaggtctaacctctcaacactgttgcgttaaggatcgttttcaacatataacattcaaaccatagcagttggcaatataataaaagtagacccaaatatacgactgctaaattcaaagrrttattatgttgttttatgtacatttaatgaatagctttaaatttttttatgtttaagtatgtatcatttgaccatcttatcaagaaataataaagcatgttggaaagaatttgtgaatctgtgaggagacccagagcaccattttttttttttttttttgagatggcatctcattgtgttgcctaagctggagtacagtggcatgatctctgctcactgcagcctctgcttcccaggttcaagtgattctcctgcctcagccttctgagtagctgggaccacaggtgtggaccaccacgcccagctaatttttgtatttttagtagagacggggtttcaccatgttggtcagaatggcctcgaactcctgacctcaagtgacccacctgccttggcctcccaaagtgctaggattacgggtgtgagccaccttgcctggcccattgtttctgttttaatcctaaaaatgcatactgatacccacagatagttctcaaagagagctaaattgatttatgtaaatacaaaaccacaccttatatcttcttttccatgaggttagggataacatcttagttggtagccttgtttgtattcatatagcacttagcataatgctttgcatagagaaggtttgaaataaatcttttgagtgaacattcagctgtctacatttaaaacaaagaatgtggaatatgactatcttgtgtccyaaattaacttattaacagtcttcctccttttcagagtagttaaggaaataacctctttgcccctttaataaattatatataatgatagtagtatttccagttattaatttaccacctttcttccaagagagctaaaacttgtttgtaaaatatacctcatttcttattaagtttgatgaaaattttaagatcatgggaaataatgctacagttagtattcaaacatgcttaattgttatgaaccatccagaaagccaaaccaaagtacaacttgattaaaagaagaaaaagtcagaatattttgcattaatagccatgtaacagatgtcctgaaaaaaaaaagaaagaaaaataaaattttgcatttagtagttaaccagttcctgttgttctaaacatagacatatttatttttccttcaatcattttaaaattaggtttgctttctattaacctatttactaattatttattcttctacatagtttcattatttataactacattagaactctgctttaccagtcccagtgtacatttatttcctcagtccttttaaatgagtattttcctagtatactaatcctgttgttgttataataggtgcttaataaatgcctcagtgaatatattaagacatgtaacttgggccaggcgaggtggcttatgcctgtaatcccagcactttgggaggctgaggcaggtggatcacctgaggtccggagttcgagaccagcctggccaacatggtgaaaccccatctctactaaaaatacaaaaattagctgggcgtggtagtgggcgcctctaatcccagctacctgggagactgaggcgggagaatcgcttgaacctgggaggtagaggtggcagtgagccaagattgtgccattgagctccagcctgggggacagaatgagactcagtctcaaaaacaaaaaacaaaaaaaaacttcatgtgatgtaatggatagaatctttaagaaaatgtaactaggagccttcattccattccctctacttatcatctggggatattcaacaaattacttaattttcatgttatctacatcgcaggttgtggtaagcattaactaagtttgtgtgaataaccttccatagtgctattcatatatatgaaactgttcttgaaccaagtaagagtaagcttgaaacttaataaaaaaaatagttattatgggagaagcctcatggaaaactattaaaggtgtacaacataagtacagaatcaaaattttagaggtcagagaaactttagagtttttataatcaatacattttcttgtctattaataagaaaattgagggtggttgtatatgtgcatatgtgtgtgggtgtcagaaaatgacaaaataaaattattattacacttacaacagatttatatcttttaaattattatttccaccactactggtgtgttcatttgcacagtgtttactgtttactgatgtttactatttaaaaggtatcaacatacaaaagtgcagttcctctagtcaataatacattttaagttatgtacacttactgatatagaaaaatattccattaaggatttacaaaatagtgtgattaatatgatgcccttcttgtgtagggtatatattctatttcttcttttctctctctttgttcctttttgtccttatctctcagtcattctctttcttaaaaaacctaaaattaatatatacaaaagtgttgaatggctctagtgtatgggttttttaaaattttggctgatatagaatatctaattttgtagagaatatataccacttgtgtatagtttctgaattaaaactaaaaatgataagattttcaccccgaggaaattacttgtcagacctcctttattgacagaattaaagttctgggttagatgttctctaaggtagttccttttagccttgaaaggataagattctgtattattgttttctagctttctagcttgctttagattcttaataactctttctatttaagaaaatttatttcaatttaaactcagatttagtcatacctccttcaaggaatgttaaatgagcagacatgtatacatagaaagttttttttctccccctcctccctccttcctgcccccacaagaagccttttcattgtgatcgtttgtattcctgtttaaatggcttgtaaactctcaccacattttgagtagtttaaaaaatttgccgtgggtatttatcctcctgagtttatccagtatagttaaatagttaaaaagttttgacccttccttattctttgatattatctcttacattcaaaattttcttttgtcaagcttttcatgtgtgtactttatcctatgatgccttaaacttacagggtgctcaataaatatttgttgaatgagtgaatccttgtgctttagtcactttttattttttatttttagaggcgaggtctcactgtgttgcccaggctgacctcaaactcttgggctcaagtgaactccccacctcagcctcccaagtaactgggagtataagcgagtgccacagtgcggggcttttagtcacttttgaaacctttacttgggcttatcatttttctctgttttggttttgtgctaccttccttttacagagtagcttttaatttagttgaatgatatgatagccatttctatttcctgtttctaaatttttagtaaaataatattaaatacattgactattagtttttgttgtcataaatgtaatttttgggattgcacagaggacactttcacacactaatgattttccagtcctcattcatgattccataaagcaaaattagtttcataaaaacaattcaaaatgctgaattgtagagtaaatcacatggatggtaactgacaaaggatgttaataatgctgtgctaaattagaggcaaattaaaagtccattttggacacackttgtttttgggtcctgtttttgtttcacaagcttttgctcatcatcattttcaatcactgtccttttcaattttattggaagagataccacatatgaaattaaggttctatgtagtttatcctcattcaagtttggtttttaaatgattttaattgttttttttcacatcttttgggtaataccaacatatacaatagattaaagagtcctattcttttgcttatcctgcagcaaattcaccccctcttaggacccatctttgcctgaagtacccttcagcctaagagaaccctggatggaaacttgttttaattgaatctgtcatggtcccctattcgatggtttcctctctgtgcacacactctcatgttagtcttctaataaaatattttgcctattcaccccttagatttgggctattactgctttgatatgtattttcacaattttcacatacatttaaaacttcagtatctagcattttgaggaagatctctgttgacctaagtacattaatgttgctccagctggtctccctgtcattcttctttggtggctttgttgacaaaagccccgtgaggtagggttattttttttcccttcccagaaacactgtgtcaataagtaactatccagtaacattaaacaaaccctagaaaaatccaatttatgtattttcattacccttatccctattgattctggttttcagattaagaattgcaggatctcagcaatatcacagtgagactgaagagcagtagtgttgtgcacttttgtttatggtaagcacatggaaactattgaggaactggccaggatgagatagtttttacaaactagccaggtatgttcccataaattccattccagtcgacagtatttccaggggaaacaggctatttcctctgctatcctggaaaactttggaaagtttagataatccatagaactggttattctttgtagtctgggatggtctgatacagaactctgtctaggtattcttttgtttttaaccactgagagtcttcccttgtcttttctgtgcttttcattacagctaagatttaagagagattatcagtgttactgttctgtgaggttgcatctaaaagttgtcttctcatgagataaaagatacaagcaaagtgggtgttagacaccagaaaatttttcccgtcacagtaaccatttttgtatttaatactctgctggctcatgttctagggagttgtaggagcaatctatagtgggaataaacctgaaccactgcctttttcatccattattcccctcatctctcacccaaccctctttacctctctttcctcttctcctcatttttagtttcttgaacttatctccaccttaatcatcacagtttacctccataaaaaggtaaattgaaaagcccgttatatagcaaactccatagaactccacttctcttcctccctccctctctcactctttttaaaaacgttaaagatggtttttatttcctcatttttttaattatcagattttcaaattttttctttaatgaatgtatcactttgaaatgagaaaaaaatttaaatggacacccttttgatgaaaatgataatcaaatagcatgaagctttctttgtcccccttaatgttttcagtattaaggtagacaggaagaactatgtagaatcagtattttagtcataggattcctctttttcacattgatctctgatctctgaatgcaaagagcaaatccagccgaaagtctatcgttactgtttctgttgcatggaatactttgcatcttgtatctcttctgtcttctttttttctttcttttttttttttaaacttttattttagattcaggaggtatatgtgcacttttgttaactgggtatattgtgtcatgctaaggtgtggggtatgaatgatctcatcacccaggtactgatcatagtacccaatagttaatttttcaacccttgtctccctctcttgctctcccctctattagttcccagtttcgcttgttgccatctttatgtccatgattacccaggatttagctcccacttataagtgagaatatgcagtatttggttttctgttactgcattagtttgcttaggatgatggcctccagtttcatccttgttgctgtgaaggacatgatttcattcttttttataggtgtatagtattctatggtgcatatgtgccacatttttctctgtctagtccactgttagtggacacctaggttggttctgtgtctttgctgtsattaatagatttgcagtgaacatgtaagtgcatgtgtctttctggtaaaatgatttgttttcttttggatatctacccagtaatgggattgctggattgaatggtacttctgtgttctttgagaaatctttaaactgcctgccacagtgactgaactaatttgtatgcccaccaacagcgtgtaagcattcccttttctccacagcctcaccagcatctgttgttttgactttttaataatagccatactgattggtgtgaaataatatctcattgaggttttgatttgcatttccctggtgattagtgatatggagcattttttaatatgtttgttggctgcttgtatgccctctattgagaagtgctgtttatgtcttttgcccatttttaaattgggttatttgtttttcacttgttcagttgtttaagttctttgtagattctgggtattcgacttttgtcagatgcatagtttgcaaatattttctcccattctgtagcttgtctgtttactctgttgataatttattttgctgtgcagaatctctttagtttaattaggtcccactcatcaatttttcttttcttttctgttttgttttctgttcgtttgtttgtttgtttgtttgttttgagatggagtttcgcttttgttgcccaggctagagtgcaatggtgcgatcttggctcactgcaacctctgcctcctgggttcaagcgattctcctgcctcagccttctgagtagctggaattacaggcacgtgccaccacgcctggctaatttttgtatttttagtagagacagggtttctaccatgttggtcagactggtctcaaactcctgacctcaggtgatccacccgcctcggcctcccaaagtgctgggcttacaggcatgagccatcatgcccggccttttgttgcaatttcttttgaagacttagtcataaattctctcccaaggccaatgtcctgaatggtgtttcctaggttttcgtctatgattcttatagtttgaggtcttacgtttaaatctttaatccatctggagttaaatttttatatacagtgaaagctaggggtccagttgcattcttctgagcatgactagttagctatcctagcactatttattgcatagggagtcctttctccattgcttatttttgtcaattttgtcaaagattagatgtctgtaggtgatagagtttggctgtgtccccacccaaatctcatcttgaattgtaagtcccacagttcccacatgttgwgggaggaacctggtgggaggtgattgaattttgggggtggaggcattcctacattattcttgtgatagtgaatgaacctcatgagatctgatgattttaaaaaggagagattctctgcacaagctcttctcttgtctgccgccatgtgagatgtgtcattcaccttctgccatgaacgtgaggcctccccacccacatggaactataagtccaataaacctttttcctgtataaattacccagtctcaggtaggtgtttatcagcagtttgaaaacagactaataccccacagaaaaagtggggtattgctgaaaagacacctgaaaatgtggaagcgactttggaactggacaacaggcagaggttggaacagtttggagggctcagaagaagacaggaaaatgtgggaaaatttggaacttcctagagacttgttgaatggctttgaccaaaatgctgatagtgatatgaacaataaggtccaggctgaggtgtcctcagatggagaagaggaacttgttgggaactggagcaaaggtgattcttgttatgttttagcaaagagactgttgtcattttgcccctaccctagagatctgtggaactttgaacgtgagagagatgatgtaggatatctggcataagaaatttctaagcagcaaaggcttcaagaagtgacttaggtgctgtcaaaggcactcagtttcaaaagggaaacagaataaaagtttggaaaacttgcagcctgacaatgagatagaaaagaaaatcccatttcctgaagtgaaattcaaatcagctgyagaaatttgcacaagtaataagtagctgagtgttaatccccaagacaatgggggaaaatgtctccagggcatatcagaggtcttcagggcagcccctcccatcacaggctgggaggcctagaaggaaaagtggtttcatgggctggtcctagggtccccatgctgcttgcaccctagggacttagtgccctgtttcccagctgttccagccttggctgaaaggggccaaggtagctagcgcttgggctgtggcttcagaggatgcaagccccaagccttggcagcttccatatggtgttgagcctgcaagtgcacaaaagtcaagaattggggtttgagaacctttgcctagatttcagaggacgtatggaaatgcccagatgcccaggcagaagtttgctgcaggggtggggctctcatggagaatctctgatagagcagtgtggaagggaaatgtggggtcagagcccccacacagaattcctactggggcactgcctagtggagctatgagaagagggccactgtcctctagacctcagatgggtacatccactgacagcttgcactctatgcctggaaaagccacagacacttaacaccagcccatgaaagcagctgggagggaggctgtaccctacagagccacaggggtggagcttcccaaaaccacaggaacccacctcttatatcatgtgacctggatgtgagacatggagtcaaaggagatcattttggaactttaagatttgactgccctgctggatttgagacttgcatggggactgtagcctctttgttttggccagtttcttccatttggaacagcagtatttaaccaatgcctgtacccccattatatcaactatctaacttgcttttgattttacaggctcataggcagaagggacttgccttgtctcggatgagatgttgaactgtggacttttgagttaatgctgaaataagttaagactatgggggactgtttggaagrtgtaattggttttgaaatgtcargacatgtgatttggcaggggctggggcagaatgatatggtttggctgtgtcctcacccaaatctcctcttgaattgtaactcccacaattcccatgtcgtgggaggaacctgctaggaagtgattgaattatgggaatgggtctttcctgtgctgttgtcgtgacagtgaatgagtctcacgagataatgatggttttaaaaaggggagtttccctgcagaagctgttctcttgtctgctgccatgtgagatgtgcctttcaccttccgccatgattgtggggccttcccagccatgtggaactgtaagtccaataaacctttttcctttataaattacccaatctttgatatgtcttaatcagcagcatgaaaacagaatggtatggggcattatttctgggttctctattctgttccattggtttatatgtctgtgtttgtaccagtagtatgctgttttggttactgtagcattagagtatagtttgaggttgggcaacgtgatgcctcctgctttgttctttttgcttacgattgctttggctatttcagctctttttaggttctatatgaattttaacttttttttttttttgtctttcaggaggtaggtgctggaatctatctgaatttttaattttatatattttttctagttctatgaaaaatgacattggtagtttgataggactagtgttgaatttgcagattgctttggtcagtatggccattttgctgatattgattcttctaatccatgagcatggaatgtttttccatttgttgttgtcatctataatttcttttagtagtgttttatagttcttcttatagatatctttcactttcttggttagatgtattcctaggtatttcattttgtgtgtgtgttattgtaaatggaattttgttcttgctttagctttcaacatgagtggtattgatgtatagaaatgctactgatttttgtgcattgattttgtctcttaaaactttcctgaagttgtttatcagtttcagaagctttttggtggagtctttagggctttctaggtatagaattatattgtccatgaagatagtttgacttcttcttttcttatttggatgtcttatttctttctcttacctgattgctctggctagaactcccagtactatgttgaataggagtaatgagagtgggcacccttatcttgttccagtttttaaggggaatgctgccagatttctgcccatttggcctaatgttgactgtgggtttatcatagattggttttgttattttgaggtatgtttctttagtgcctagtttcttgaggttttcatcatgaagcaatattagattttatctaaaatttttccctgtctgagaagatcgtatggtttttgtttttaattatgtttatgtggtgaatcatatttattgatttgtatatgttgaaccaactgtcatggcttttgtagttcagtggtgggtgagaaacacacctagcagctcttttcccccacagtttggtgagcaggagggaggattccggtgttacatgaccccttcggtgccgcttcgccagctggaaatctctgcrgccgatgtctctttgctcaggctcactgggttcacgctgctcacccgcccgctgcaggctgcacttggcttgcaccccagtctggatgctgcacccgccacaggatccacacttagtctatggctgggctgggtgtgcagcaacctgcttcggtcttgggtgctggcatctagacaagggtaatgtggtgacacccagaaactcagaggtgccagcaactgttgagccccaagtgctgttacagctctcacccagagagtcccaaggtctgagatccccaagaaatgttataccttcttcgtgttacagatcgtttgctcctgctgcctgcagagtggcaaattctgggttcttgtgccatgaccaagaagaattagatactcagacaccagagactgagtagggcagagaagaattatattgagcgacagaaggagatctctcagcagagaagggacccaagagcaggtagccctctgtgaggctgagtccaggatttttatgggctaataataggaaagtgcatgctgattggtccatgggcctgcctggaaaaagcaccattcaattggttaaaaggcatcaaggaagttctcattccagtcacgggctctatggactggtagctcagttttcagtctttaaactgtctttggcttgtaggtcgggtttcaccagggacctgtccctgtctgcctaggaatttgtctgcctccttatgctgtcattcatagcaaataagtagcagagcctgcctgtatacctaggatatctgactctagtgcttatacttaaataatatattactttatataatgtcattagtttttataatagactttaaggatatattatgcagtcgtattatatatatatatatatatatatatatgcacatcatttatatattgttttacgagtatgttgtttcaagatattggtgaggtaagcatttttacataaaaattattgttcatcattctttgaaatgaattcttaggaccagaagaccatgtccaggtgcattacattttatttgatttcattatttatttatttatttggagacagagtcttgccctgtcacccaggctggagtgcagtggcatgatcttggctcactgcaacctccacctcccgggttcaagcaattctcctgctcccaagtagttgggaccacatgtgcacaccaccatgcctggttgatttttatatttttagtagagacaggttttcaccatgtttcccaggctggtcttgaaccaggcagccatcctcctgcctcagcctcccaaagttctggggttaaggcatgagccacaacactcggccctaggtgcattaaattttaaatgctttaaaaacatatatgtttattgcagcactatttacaatagcaaagacttggaaccaacccaaatgcccatcaacgatagactggataaagaaaatgtggcacataggcaccttggaatactatgcagccataaaaaaagaatgagttcatgtcctttgcagggacatggatgaagctggaagccattgttctcagcaaactaatacaggaacagaaaaccaaacaccacatgttctcacttttaagtgggagttgaacaatgagaatacatggacacagggaggcgaacatcacacactggggcctgttggtgggtgggggtcaaggggagggagaacattaggataaatacctaatgcatgctgggcttaaaacctagatgaaggttgatgggtgcagcaaaccaccatgacacatgtatacctgtataacaaacctgcacattctgcacatgtattcactcttgttgcccagtctagagtgcaatggcgtgatctcggctcaccacaacctctgcctcccaggttcaagtgattctcctgtctcagcctcctgagtagctgggattacggcatgtaccactacgcccagctagttttgtatttttaatagagatggggtttcttcatgttggtcaagctggtctcaaactcccgacctcaggtgatgtacccaccttggccccccaaagtgttgggattacaggcatgagccaccacgcccggcctatgttagactcttgataagtattcaaacacatttgtgagtggaatgattccagtttcaggaaccaattttttttcttggcaaatttccttataactttagtttttaatgtttgttctattacttttcctaaaggcaattttcaataatctctagtctttgtgagggtcatattgccatttactttttttaaaaaacagtattatacgttagggctgatgactttcgttatttggaaaaacactgtgacttctgaatccatctattctcagtcttcttgttgctctcattttgttttatcttcactttaaagagtcagcagcccctcctcttaacatcaacctattttattcatacctttcttagcacacttatagtgttttttatagcttatcacactcctgtgtctctaatgcctgcaacacatatcctgtatatgcatatacacatatttacatgtatgtgtacatgtgcgtatttgtgtatgtgtatggtatccttaaacagagatcatgtcttatttaaatttgtatcccagtaactctctgtccttttgctatagtcaggatcaaattacttttgctaaattactaactggattattcaaccaaaccaatgaagcaagcatattattttccctatttatatttttccagcatttttgctatctttcttctgattagattacttagtcccttcagttgtacttatttcattgcattttatcagaattgacaggatgcttattttcagacattttttgatctagtttgttctttctttatttttgcccattaaggcaattatcaccttagttttcgttcacttctgatcattctatctattgatattgtacaaacctgtattttgcttttatttttttcttcccagtaaatactagctctgtacatatttgatttttaaaacttgttttcaaagtttttttataatctattatttagtattcctcttactcactcttaattttttgccctttaaaaaaatatttgccttctcaagtgctcttgccttattaaagttgcattattaatcctttcacttcatgaaagtatgtgacagtgattatctttctgtttgagagattaagctttcagctttactttttttttttttttttttttttttgctggaaagccacctctgttcatccttcaaatgccatggctcaactttaatttggctttcaaaatacaaagtatattataaattaaatatttgaaagataaagaatttcttcttgcctttatcttccgtatacgtccctaagtccaccaacttgtagtgccatgaaagttgcttggcaggattgccatttgtagtcatttgtcactcagaaacattgatgattattgctatcaaagaatatattgagtacttgttaattccatagcattctattttattttatgcataagttaaaaagaaataaaaggcataatttcatgctttaaggtagtctagaatcaacttataacacaaagtctctgctcctaacacatctttacacaacataataacttttataaagcaatacaactaaatattaaattatgtggttgggcacagtgacatgcacctatagtctcagctaccagggaggccaaggtgggaggattacttgatcccaggagtttgagaccagcctkggcaacatatcaagaccttatttcaaaattaaaatcataaataaataaaatgatgcaagtcgtatataaacatgcacaaagatataaagttaaaaatggtattaaggtcatgtaacatttagtcaggaaagatgttttctagatagtctgagaaaataacattttaaatgatgattggctaggagaatatgtgattgtgggaaagagaatggcatatacataatgatggagaactcagcaggatatttgcttcttttaagtctcattaacaagtgtgtatcagaaatactttcctaatatttgacatcctaacttttgttccatccagaaaataaaaccacaaataaaaggaattctttcttttcctaaaatgtcttaataagattaggaaaacatatttattgctctgggtttagctataagacccaagaagtttgcactctgtctgcttaaagagaccttatacatcaagaaataccacacaatatctggtaatatgtaatgtaagtttgaggtattcagtgatatagaagaggttcaaaggttggaaaagatcataagcttggataggcaggtgacttcaaagagaagttatttgagctggaccttcaagaaaaggcttttgaaagggtagagaaaggacttatgggcaaagtttcataaaagatgcaagtctttttttttaatgtatctttttataatactttaagttctagggtacatgtgcacagcatgcaggtttgttacatatgtatacgtgtgccatgttggtgtgctgcacccattaactcatcatttacattaggtatatctcctaatgctatccctcccccytcccccaaccccacaagagactctggtatgtgatattccccttcctgtgtccaagtgttctcattgttcagttcccacctatgagtaagaacatggggtgtttggttttttgtccttgcgatagtttgctgagaatgatggtttccagcttcatccatgtccctacaaaggacatgaactcaaaaaaaaaaaaaaaaaaaaaagatgcaagtcttttcaragtgtggcttgccttaaagcttttagttaatgtgaggatgttgctggaaaaaaatcaagtcctgttgaaatgaaattaagggttgatggcagtaggatatttggcaggtaaataaatggaaacatacatgatgtttgtaraacaraaggctcactgtcyttcaratgtgaaatttccccatattgatctgtagagtcaaagaaatcccaatcaaactctagcaggttttttgttgttcttgttgtttttggagaaattgacaagattgttctaaaatgcatatggaaatgcaaaggaccaagataacagttctgaaaaagaacaaagttagaggactgaccttatttggtttttcaagacttgctataaagcttcaataatcaggacagtatgccattggtatagaaatatagatcaatgtaatagaaaaaaagtcaggaatagatgaaaacatatagtcagttgactttctttttttcttttttttttttttttgagacggagtcttgctttgtcacccaggctggagtgcagtggcgcratctcggctcactgcgaaccccgcctcccaggttcacaccattctcctgcctcagcttcccaagtagctgggactaaaggtgcccgccatcacacccggctaattttttgtatttttagtagagatggggtttcaccgtattagccaggatggtctcgatctcctgacctcgtgatccgcccgccttggtctcccaaagtgctgggattacaggcatgagccaccgcgcccggccagctgactttcaataaaagtaccatgataattccattggaaaaagtatagccttttcagcaaagtgctagaacaattagatacccatatggagaaataaaaaattggaccacaaaccctgtttcacaccatatacaaagttaattcaaaattaattgtagatctggacataggtctaatattataaaagctctaaaagaatacagaggtgaaaatctttataaaatcatattaaacaaagatttctgagacaggacacaaagtacgaaccatgaaagaaaaaactgagaaattgaacttcattatatccaaattttcgttctttgagaaacacagttaagaactgaaaagcaaagacatagacaaggagaaaatattttcaaatatatataagaacttgtatccagaatatgaagaacactaataatgacaagaagaataaccactgaatgtttaaaatatggacagaagattcaacagccacttcaaagtggaaaacttatgactggccaatagtatgtgaaaatatattcaatgtaatagcaatgcaaattaaactttaatgagatattactgcacacctagtagaatggctaaagataagaatgctaacaatataaagtgctgacatggatacagagaagtgaaacgctcccttatggctagtgggaatgcagaatttcactgccacttaggaaaacagtttggaagttttttttaaagttaaatrtacacttaactttttgatccagcaattccactccaagatattttccaatagaaatgaaaacatatgtctacataaagtcttgcatgtgaatgacaactttattcataatagacaaaatcaggaaacaacttatattagtccattctcacactgctatgaagaaatacccaaggctgggtaattgataaatgaaagcggtttaattgactcacagttcagcatggctggggaggcctcaggaaacttatagtcatggcagaaggcacctcctcacagggcagcaggagagagaatgagtgcagagcgaagggggaagccctatacttataaaaccacctgatctcatgagaacttcctcactatcacgagaacagtatggaggaaaaccagccccatgattcaattacctcctatcgggtccctcccacaacatgtgaggattatgagattacaatttaagatgagattagggtggggacacaaagccaaaccatatcacaactcaaatttctattttgtgcttttgcctcatgtcttctgaatgagacttttgcagaaggtgcaacttcaggaatctgtgattttcaaaattgcttcatgttattctgttgcagtgaggcagtttgggaaccagtgccctagactatcttatccagtaaggtagggacgctgctaattcgtagagtacttttttgcaaatttggaaaaacatgccttttctggaaagatgcagtcttattgatgtatggcctggcagctagaatgaagactgaatttcagctttctttatattccctcatgtgggagctgtagttcattgtttcatgtacattacataaagcaaaacattaaaaaaaaaaaaaaaagaaaaaaaaaaccctgaagctttgactcccaacctcatcatgagtaagcttaatctggcagagtatttaagctagatgagtctggaattagcwagaagactttttgttttttgttttcctttaaagcaaatctctaatactactaccacattgctaccaaaggcattactacttagagctagaggaaaagtagaaagaggctatactggaagaaaataagagaatggctgagtagctcaaagtgaacccagctcttgctacttgctagaaagaaaagaagaaatgaaagtagaagtaggtggttgtagctccattcatttttccactgtaggggagtggagcgtaagctagagagaactagagaaggccatgcttttctaaatttctgggaagaatgactaacaaagggaaaaagtgattatggacctactgtatgagagaacagaacctctgtccctctaaccacatggatcaagtgggagaaggcatatatacagtattctagaatttttaatccactataatatttaatccattaattaattttcaatcaattataattgcttatttcactttatttttttgacagagtcctgttctgttgcccaggctggactgtagtggcataatcttagctcactgcagcctttgcctcctgggttcaagtgattcttttgcctcagcttcccaagtagctgggactacaggcatgccattgtgcccagctaatttttttgtatttttagtatagacggggttttgccatgttggccaggctggtcttgaattcctggtcccaagtggtctacctatctgaggctcctaaagtgctgggattaccggcatgacccaccacaactggccaggagatgagagtagttttagtttttatttttatttttttgagacagagtttcactctatcacccaggctggagtgcagtggcacagtcttggctcactgaaatcctctgcctccaaagctcaagcaatcctcccacctcagcctccagagtaactgggaccactggtgcacactgccacacctggctaatttatttatttattttttttaaagaagtggggcttcgccatgttgcccagtctggtctcgaactcctgggcttaagcaatccgcctgccctgccctcccaaagtgctaggattacaggcttgagccactactcccagccttaattagttttaatgaaaccaccacaataaacaataaaatattcttgaacttaactaacattcctattttctatgggtaaagtatttcagtcttatgcatggtgaaataagggtgaggtgaagtcagataagggacagataataaaaaaatttaaatgtcaaaaatgataatctaggatgaaaataccagaattaggtgaagacccartgctgaagaaacttgaaaactaggccaagtgattagaaatatattttattggaatgatgaagctgatggtgtttcagataaaattgttctctaagatttatttttttacacctttattgatatgtaattcacataccatatagtttactcatttaaagtgtacaattcagtggttttgtgaatattcaagagttatataaccatcacaattcattttagaatttttaccacccaatatttttaccactcaaaaagaaaccccaaatccattaacagtcactttcctttccccccagctctcctctcccttctctgccataggcacaaatctactttctgtctctatacatttggctctcctggccatttcatgtaaatggaatacagtatgtggtcttttgtgactggcttttttttttttaactagagaaacgttttcaaggttcattcatgttgyagcatttatcagtacttaattcatttttattgcaaaataatattccattgacttgataataccacatttagtttattcattttgatattagttgatggatatttgggttgttttcacttttgggctcttaagaataatgctgcaatgaacattcatgtgatagtttttgtgtggacatattttcatttctcttgggaatatatctagtggtagagtttctgggtcatataataactatgtttagccttttgagcaactactagagtggtttcataagcagctgagtcatattacctattcacgagcaatgtatgagggttccaatttctttacatcctcatgagcgcttgtttttakctctttgattattgagtgggtatgaagtatttcattttagttttggtttgcatttccctggtggctaatgatgttgaacatttttttcatgtgcttattggccatttttatatctactttggataaatgaatattcagattctttccccattttaaaattcggttgttttattattgagttagagttttttatgatattctggacagaagtttcttatcagatacataatatgtaaacattttcttttaacttatgagttgccttttcactttcttgatagtttccttagaaacataaaatattttaattttgatraagttcaattcatctagttttttttgtcacttatactttgatctcatatcctagaagactttacatattctgagatcataaagatttactygttcatcttcctctaagagttttgtagtttttagtctttcttatatttaggtctatgatccattttagttaattttgtataaggtgtgaggaagggatatattcatagcttcattcttttccatatggatatttagttttctagcatcattttttgaaaagactagtctttttccattgaatgatcttggcatccttgttgaaaatctgttgatcataaatataagtgtttattatatggacaagattaatttttttaatgagtgatatgcagaatgaatttgaggaacacatagagccaatgataatgagatgagttagaggaagtaccattgtgaaactgtatggacctaaaccagtgaagtttgttgggtgatacatgtaaagagacaaagctgaattattatgtcttcagtatgcattttgtgtatattatgtgttatatatattatttatatttccattataatcattccttctcttttatccaatgacttaatattatgttattatttcatactaactggactgtgtgaaatgaatttgggaacagaggagtctcctgtaagtcttctcagctgtgaaatatccttgaatatcccaaggaattctctgaagattggagtcctggccctctttgttgaatttgatttagcacattagggttagaccaagttacttgtattttatatagctgcccatattattccaatgtacagctctggaccctctggctttttataatcaatttctaatgaactgtcgtatcttcctattagttattagttgcttagctttctggtgtcatttgtgattttcaggtatcatctcttgtttttggtctggtttagtctttattggcattccatagctgccaggccattctgccttgctagaagacaaatattacaatttttttctttttttctacttaaaacctcttagatatcataagaccatagatctcagacttattatactgattggtgagatctgctctcagagtggggcccactgtattttaaacacgtacccccaggtaattctgatatagatggttagaggaactctgctttcgagtgtttctaagccaatttgttattttggttrcaaggatattagaggtgattttattggtatttaccctaccgagtcagtagtgcctaaatcctaacattcagttttcctccttatgaaacccctggcagaggcccatgtgagaaaggaatcttggcttagtaggaggctaagagctaatacattattacctgggctggtacttcctgggcattattatctagcaagtataatagacgcaggtctggtcacatgaattagctaatattttatttgacatttcctagttctacttcctgtcccaaatcgtcttttaatttttaatttgtttttttttcaggcttattgaagtataattaacaagtaaaaattgtgatattttgatgtgcatatacattgtgaaatgagtgtatcattaacatattcatcaagctaattaacatattcatcagctcacatagttaatttcgtgtgtgatgagaacatttaaggtctactctactagtgaattataagtacacaatatgttattgttaactatactcactatgctatacatttggtctccagaatttattcatcttataacagaaagtttctactctttgacaaacctctccccatttgccccactccccccagtccctgataaccagccttctactctgtttttgtgtgtttgactttttgagatgccacatatatatgagatcatgcagaatttgtctgtgtctgacttatttcacttagcataatgtcttccagattcatccatgttattgcaaataataagatttccttttttaaggctgaataatactttatcatgtgtgcgtgtgtaaaatcacattttctttatccatttatccatcaacagacactgggtttttttttccatattttggctattgtgtataatgctgcaatgaacatggaaaatactgattccacatagtgattttatttcctttggatatattcccagaagtagattgctggatcatgtggtagttctagtttaatttttgaggaacctctatgttgttttctattatggaatgtaccgcggcacaataaagtccacatatgacaagcccacagctaacatcatactaacggtgaaaaattgaaaacattacctttaagatcagggataagacacagatactcttgccacttatcaacatagtactggagtcctagcctaataattagacaagaaaaagaagtaaaaggcatccagacgggaagggaagaaggtaaactattcctgttgtagatgacatgacctgattaaagaaaatgctaaagcatgcaccaaaatttgttagaactaataaataaattcagcaaacttgcaggatcaactttactgagtggacaacgtacaaaaatcagctgtattttacacactaacagtgaactacctgaaaaattaagaaaacaatcccatttccaataacatcaaaaagaataaaatactttgtaatatatttaactgaggaagtgaaagatatgcacactgaaaactgtaatacattggtgaaagaaattgaagaagacacaaataaatggaaagatacctcgtgttcatggattggtagaatattgtagaaatgtccgtactagctatcccagatctaaatatgtaataaacatttcaagtattcagggaaataatacaatgccacttctttagaggagatcacctaatatttacaagtagaagagctaagataaaacagaaaagagtacctwctcaccttttcatcactgatgctgtctgcagtgaatatattgttagtggtgaagaccaaactatattaaagtttaagggatgcaaataagcatgagaatgagcatgggaaaccagccccaaaattcagtcttcaagattcattaaaagttaaaaccacaaaaggcagaaaaagaattgaagacaaacgttggaagaaagtacaaaggcaaaaaatagaaaaaaagtagcaaatattgtagatattagtcaatatttgttacttttgaatgtcagtggtttaagtacatcagttaatcactttgaatgtcagtggtttacatgcatctactaaaagacagaaattgctgggcatggcggctcacacctgtaatctcactgctgtcaggccctggtgtgtgatgttcccctccctgtgcccctatgttctcattgttcaacccccacttacgagagagaacatgtggtgtttggttttctgttcctgtgttagtttgctgagaatgatggtttacagcttcatccatgtccctgcaaaggacattaactcatccttttgtatggctgcatagtaatccatggtgtatatattccacattttctttatccagtctatcattgatgggcatttgggttggttccaagtctttgctgttgtgaatagtgctgcagtaaacataagtgtgcatatgtctttacagtagaatgatttatatcctttgggtatataccaagtaatgggattgctaggtcaaatggcatttctagttctagatccttgaggaatctccacactgtctttcacaatggttggacaaatttacattcccaccggcagtgtaaaagcattcctatttctccacatctgctccagcatctgttgtttcccgactttttaatgattgccattcttactggcgtgagatggtatctctttgtggttttgatttgcatttctctaatgaccggtgatgatgagcttgttttcataagttttttggccacataaatgccttcttttgaaaagtgcccgttcatatcctttgcccactttttgatggggttgtttgtttttttcttgtaaatttaagttctttgtagattctggatattagccctttgtcagatggatagattgcaaaaattttctcccattctgtaggttgcctgttcaccctgatgatagtttcttttgctgtgcagaagctctttagtttaattagatcccatttgtgaattttggcttttgttgccattgtttttggtgttttagtcatgaagtctttgctcatgcctatgtcctgaatcatattgcctaggttttcttctagtgtttttatggttttaggtcttacatttaaatctttaatccatcttgagttaatttttgtataaggtgtaaggaagaggtccagtttcagttttctgcatatagctagctagttttctcaacaccatttattaaataggaaatcctttccccattggttgtttttgtgaggtttgtcaaagatcagatggttgtagatgtgtggtgttgtttctgaggcctctgttgtgttccattggcttatatatctgttttggtaccagtatcttgctgttttggttactgcagccttgtagtataatttgaagtcaggtaacatgatgccttcagctttgttgtttttgcttaggattatyttggctatatgggctcttttgtggtttcatatgaaatttaaagtagattttcaaattctatgaagaaagtcaatggtagcttgatgggaatacattgaatctgtaaattactttggacagtatggccattttcatgatattgattcttcctatccatgaacacggaatgtttttccatttgtttgtgtcctctcttatttccttgagcagtcatttgtttttctccttgaagaggtcctccacatcgcttgtaagttgtattcctagatattttattctccttgtagcaattgtgaatgggagttcaatcatgatttggctctctgtttgtctattattggtgtataggaatgcttgtgatttttgcacattgattttgtatcctgagactttgctgaagttgcttaccagcttaaggagtttttggactgagatgatggggttttctaaatatacaatcatgtcatctgcaaacagagacaatttgacttcctctcttcctatttgaatagtctttatttctttctcttgcctgattgccctggctagaacttccaatactgtgttgaataggagtggggagagagggcttccttgtcttgtgtcggtttttaaagggaatgcttgcagcttttgcccattcgatatgatattggctatgggtttgtcataaatagttcttattattttgagagatgtgccatcagtacctagtttattgagtgtttttatcatgaagagktgttgaattttatcgaaggccttttccacatctattgagataatcatgtggtttttgtcattcrttctacttatgtgatggattatgtttattgatttgcatatgttgaaccagccttgcatcccagggatgaagccaacttgatcatgatggataacttttttgatgtgctgctggatttggtttgccagtattttattgaggatttttgcattgatgttcatcagggatattggcctgaaattttctttttttgttgtgaagagtcattttttagaaaatattttgacctcattgaaaatgaaaatagatcatgttaaaaattttgggatgctgtaaaagcagcgctttgagggaaattcatattattgaatgcatatatattagaaaagaagaaagatctaaaatcagctatctaagcatcttcattaggaaactataaaaaggagaggaaattaaatccaaagtaaggagaacaaaagaaataataaaaattagggcagaattcagtgaaattgaaaacaggaaatcagtagagaaagtcagtaacaccaaaagctggttcttagcaaagatcgatatttttgataagcctctaaccaggctaagaaaaaaagagagatgacacaaattagtaatattaaaaatgagagagaamaattcactgtggatggcatgggcactaaaaggacaataaaagaatattatgagcccctctgtgcccacaagtttgacaaccaagatgaaatagaccaattttttccaaggtgtaaatctgtcaaaactttacaagaatcggcaatctgaataggcctatatctagtagagaaattgaatcaatatttaacaaccagctgggcacagcagctcatgcctgtaaactcagcactttgggaggccaagatgggcagatcacttgaagccaggagtttattgccagcctggccaatatggtaaaaccccaattctctaaaaatacaaaaaaaaaaaaaaaaaattaacaaccttcaaaaagagagaacaacacagggccaggtggatttactggtgaattctgcccaacacttaaggaagaaagtgtaccaatcctctcctatctcttccagaatataaaagcaaagataataaatacttcgtgttccattctatgaggccaccagaactctaacaccaaaatcagacaaaaatgttacaagaaaagtaaactatagattaatatctctcatgaacataaatgcaaaaacaaatatatatcaatatgtatattgatatatacaaatatatatcagtaaaatattaacaaatcgagtccaacaacatataaaaggaattatatacagagaccaggtgggatttatcccaggtatagaaggctggttcaacattcaaaagtcaatgaatatagtccatcacatctgcaggctaaagaagaaaaataacatgattatatcagtagatgcagaaaaaagcatttgacaaaaatcatccatttatgagaaaaactctaagtatactaggagtagagcagaattttctcaacttgaaaaaaaatacctacaaaacacctagagctaacattatatttaatagtgagaaactaaaaaactttcctgctaagattaggaactagacaatgatatcctttcttacagttattttctagctaatgcagtaggataagaaaaataaatgaacaatacacagatttggaaggaagaagtaaaagtctttgatcacaatgacatccttgtctatgtataactgttcaaaaatagagtaaaaaacctctgaaaattgataagcaattatagcaaggtttcagaatacaagcttattatacaaaagtcattcattttcctatataacagcaatgagcaagtagaattggaaattaaaaacatattaaaattcatttctgttaacacccctaaaaatgaaatacttaggtataaacctaataaaatctgaagtctgtatgaggaaaactacaaaactgtgatcaaagttttgaaataattaataaatggtaagatattctacattcatggataagaagatgtcagttcttccctacttaatctaaagattcaatgaaatttcaatccaaatttcagcaagttaatttgtgtatatcaacaaattgattctaaagtttatatggaaagacaaaagacacaaaatggccaacttaatatttaagggaaataacaaagttggaggagtgacattagttgacttcaagacttactataaagcttcagtaatcaagactgtgtggtactggcaaaagaatagacaaagagatcagtggaacagaacagaaagcccagaaatagacccacataaatatactcaactgaaccttgcaaaggagcaaaagcaatacattagagaaaatacagtcttttcaacaatagtactggaataactggacatccccctgccaaaaaaaaaaaaaaaaatctgaagaagtaccttacacccttcacaagaattaactcaaaatgaattgcagacctaaatgtaaaatgcaaaagcaaaactcctaaatgacaacacagaatatctaggtaagcttaggtatggcaatgactttttattttttatttttgagacggagtcttgctctgtcgcccaggctggagtgccgtggcacaatctcggctcactgcaacctgtgcctcccaagttcaagcaattctcctgcctcagcctcctgagtagctgggattataggagtgtgccaccgtgcctggctaatttttttgtattttcagtagagacggagtttcaccgtattggccatgctgatctcgaactcctgaccttgttatctgcccgtctgagcccccaaagtgctgggattacaggcatgagccaccgcgtccggctggcaatgattttttagaaacaacaccaaaggcataatctatgaaagaaataattgataagctgcacttcttttaaatcaaaaacttgtgttttgtgataagtagtgttaacggaatgagaagagaagctatagactaggacaaatatttaaaacagataaaactaataaaggactgttatttaaagtatacgaaaagctcttaaaacctaaataataagaaaactataacttgattttaaaatgctcaaaagacctgatcatacgtttcaccaaagaagatatacagaaaacaagtaagcatatgagaagttgtttaatatcatgttatgagagaattgctatttaaaacaataatgagataccactatatacctgttacaatagctaaaattcaaaacactgacaacaaatgctgacaaggatgtagagcaataaggtgtctcattcattgctagtgggaatgcaaaatggtacagccactctgggggacagactgacagttctttaatgaaaataaacacactctcatgatctgacccagctgaaaacttttgtccacacaaaaacttacrcatagatgtttatagcagttttatttataactactccagtttggaagccaccaggatgtcctacactgggtgaatgtaaaaagtgtggtagatccagacattggaatattattcagtgctaaaaagaaatgagctgtcaagccatggaagacatggaagaatgcatatcagtaaatgaaggaagctaatgtgaaaagcctacatactttataattcctattatctgactttcttgcaaatgcaaaactatggagacagtaaaaagatcattgtttgccggggatttggtgggagggagggatgactaagtggagcacagaggatttttttagggcaatgaaaccattctgtatgatactataatggtggatacatgtcatccatcatacatttgtcaaaacccrtagaatgtgcaataccaagagtgaatgcttatgtcagctgtgggctttgaacaataatgatgtgtctttaaaggtttttttttttttctgtaatatgtgaaccactatcatgtaagatgttgatgggttgatggggggagactgtgcatgtgtgcagacaggatctatagagaagctctccaaatttcccacttaattttgttctgaacataaaaaaactctacaaaaggaaagtttattaatttycaaaacaggtaggagaagggtaatgttactgtaggaagctttgcttatttataagtttgtttttattttttacattaataaaggaagtgataatgtcagcacatagtactgagaatctttttttttttttttttttttttttttttgagactgtgtctcactctgtcaccaggctagaatgcagtagcacaatcttggctcactgcaacctccacctcccaggttcaagcaattctcctgcctcaccttcctgagtagctgggactacaggtgcgtgccaccacgtggggctaatttttgtatttttagtagagacggggtttcaccatgttggccaggatggtctccatctyttgacctcgtgatccacccgccttggctttccacagtgctgggattacagaagtgagccactgcgcctggcctgaaaatcattctgatgagaagcataatctcttaaaatcccttaataagagaatgctaaataattccaggtaaattgttattttgatatgtaatctattctatgtttacattaagttaatattttacagtaaagatccatgcattcttctttctaatttatattataaggctttcaaagttgagtgaattgtgtcaaatttttaacccatttacagcttccgttttgtcccatatgttataaatcaaggcaaataaaaattcttatttaaaccttcctctcctcactatgtacgctcaagtttttgtcctcattttgtttctttttaattctggagcaacctttcactttatctgagaactaaaattctgtccyttttcttgaaaaataaacatttatcctattacatcacctacatagttacactttttcttaaaactgtccctgctaaaatagactcagttacccatattaccattgttaattaacttgtatttaaccttctctggtggataggaacttgataataatgcctatcatgcacaagcaatttaggtgactaggaaatatcattctctacagccacacccttttttttttttttttttttctttgaggcagagacagtctcactctgtcctccaggctggagtgcagtggcactatctcagctcactgcaaccttcacctcctgggttcaaaccgattctcctgcctcagcctcccaagtagctgagactacaggcacctgccaccatatccggctaatttttttatttttaatagaggtagagtttcaccatattggccaggctggtctcgaactcctgacctcaaatgattcactcacctcagcctcccaaaatgctgggattacacgcatgagccactgcgcgcccagcctcacatacattatatttatgtcttcaagtgacaagaatgagcacattcattaacatgatataaaatcatggtaacatcgtaacattttaaggtaagaagtagagttgtatattgtaagcgctatgcttgctattcaagatcttgaagttaagtacacaagaatcttagaaatcacatttcagaggacactaaaaaatgtaattattgatataaaacattgttagaatcatgattcagttcagtcaaacagttttacttttttatcattttaagctttaggtatggatatcattagcttatctgatcaatacactattatcagaattttaagaagttcaggttaactagtattttctgaaaacagaaackcaacatccctacaaaattatggagaaaacacagctatgtatttcagacaaaatttttaaatcagtctgatttgtccaaagaatcagtttttagctttaaatttttaaacagtttttaattgataccttatattggtacatatttatgtggtacatgtgatattttcttacatgcatcgaatgaggagaattgttgttagttcttgcttgaaagtttggtagaatttggcattgaagccatccagtcctggacatttctttgttgggagactttattactgagtcaatctcattacttattattgatctgttccagttttttatttcttcctgattcactctcagtaggctatatatgtgtatctagaaatttatccatttcctccaactttccagttcattaagatttagttgcttataatagtctttgatgaacttttgtatttctgtagtattagttgtaatgtctgttttctgtttctgtttctgattttgtttattttgatcttatccttttcttggttgcttttttagtgtccattttgtttaattctagtttttattatatgtttccttctactcatttttagttgtggtttttttctttgtatttttttttatgtagagtttatgggtatcaactttcctcttagcactgcatttgctatctaccataggttttggtaagttgtgtttccattttcatttgtttcaataaatttttatatttgctgcttaatttcatcattgatccagtgtttgttcaggagcatagttttaaattttcttgtatttgtacattttttaaaaagtttctcttgttactggtttttagttatattccattgtggtctgagaagatagttgatgtgatttcattttttaaaaatttgttgaggcttgtcttgtggcttaacacatagtctacaaagattcacttttattgcatgaatttagattcgtaaattaaaatctttctaagctgctagcagatcctttaagaagaattttttccctaaattactagtacatttgaagttttctttagatattactatagattcatgaacttcttatactatgtaaaccaattatatcttagctccttaaaattcagagacttctaaattttatttattaatactcttcttwggaaaatacttcatacagaatgagagagaatgacttctgagttatagcaacacagagaaaattgtagctttaattataacaatctctgcaacagattaagtaatcaaggaaacaccaaaatacactgttcaagatttcaaaggattattttcccttctagtagttataaaatgttttatgaaattatttggatacacaaatagagaaacaaagaatttaaaaaatgcaactctcattccttgtcatgtctcatatgaaggacaagaaatccctttaatcttaacagaggtctttaaagttcagattataaaattacattcccaattattaatgcatgcatggggattatcattatcatcattatcatcttctagtggaaactatatccagaaccaaaatggtgaagaactagaaaagaaaatgaaaaattcaaaatttaaagaaaaaagccaacttgtagtagactagcatcacagcaaaggtacagttctattgccttttttttctttttttctttttttttttttttttttgagacagagtcttgctctttcccccatgtaggagtatagtggcaggatcatggcttacttcagtcttgacctcccagtttcaagaaatccctccacttcagcctcccaagtagctggacaaaaaacacagcacatgccggcacacctggctaatttctgtattttttgtagagatgaggtctcgctatgttgcctatgctgatcttgaactcctgggctcaaacaattctcccaccttggcctcccaaagtgctcgattgtaggcatgagccactgcaccaggactctattgctatttgagaatcactttgaggagaaagaaaagtctctcctcctaaacagctcctgaagtacatttctgtgctatcacagtttggttggctttatgaacccactttagtgtctcagtggatcctccaaaagtataacatgttaaaattcaaagaatttaaatggtgacttttgtaaatataaaaagaaaatatatcaaatattttattccacttcctaattaagtagaggactagtgagattataaatacagttcaaagtgcattttaggaactagtttcttaaagacaagttaatgaattttatcttagaataatatagctaagttacatacaatctatttaatattttacatgacaataaagcattattttggggattatcttttttaatagttgaaaatattagaattttccaggttaaaaatctacaaattaataaagaacttcactatgcctagtgtcacaagattcttgggatattgtttttctggctggtgatgtctttgcccaagtcttgcttaggcccgctgggtttgttctgcctacctggcctggcaggctttacttggctgacactactggcctggatcccatacctgccaagggtaagtcakgcatggagtggcaaggggtgtgtgagggagcatggggttcagccagtgtgcaatcggacatgccggctgctgcaatggggcgggcagttacaggtgctggcacaggcactgactctctgtgaggctgtggccagaccaggtgcactgcaggaagcttccccagctggcaccgggaaatgcagtggcacctggaagcttggagatactaggcaccacaggaccccaaagagggagtcacagccctggctcagggagctcccaggtctgggctgcctgagaaggcacagatcttatctccttctctttgccctcaatgtggcaagcagggggcatgtttcagtcctgtgttatagctcttttagctctgccatttggtaggtcccgagttcttgtcctgcaactaggaagcatgaggtacagagccaagtggaggatgagcgagatgaaggggagctttattgatcaatagaacagcacacaggagacctgcagagggtagctcctttccacagccaggatgttccaatgagagttcagctcctagcagaaaggagaccctggagagggaagctcctcctagcaggcaggtcatctcattgtcttcttagctctcagcagagaggtggccctggagtggattgttccactctgcagctggtagtctcgatgtctctgcaggtttctgaagctctcagcagagaagaggccctagaatggatagcttctctcttctgctggttgttgggacatcttctgctgtcagcagaaagggtagctcttctctgcagctggtcatccatcatctgctctgctctggctgagcctggggcttttataggcctattagaggggaagtgcatgctgatcagtccatgggcagccatgggcagatccaggaaaaaccaccacgagtttgccctccaaatcagcactgccagtcctgtccccaggcttcaggccttctctcagggatctgccctcttctgcccaagtatctgtctgcctccccctgctgttcatggcacatgggcttgaccccgatttgctccaagatgggagcaggtgcccacagcagggagaagccaagcagcgggagcaggcacttctgagcctgcaggggcaggggggccttytcagctccccctctccccccccagagtgcagggatacctgggtctgcagccgcaatatgggctgctcccttgaccctagggaagtggagctcctggtcccccaaaagtamagggaagctccattctgcagccacagctcgggcacctgcagcccttcccaggagggttaggctcctgcctcctccaaggaggcagaggcccaggtctgcagctgcaatttgggcagctgcagctgcacccggggagttcccaccccacctcagaaggagaagggcttacgcttgtcccctgctgcctggagctccatggagcatgtatcctcggcagcacctccctgctgcagtcggcgtgatggcagcggcaggccgtctggagtggctgctgctataactaggatctttaatcagtagtaaacagtgaatcaaataagtaaatttcccttaattatccttatgtggatctgttaatgcattcatatgacattgaaagaatatgttgccctacttttgaccttatttccaagctttgaataacttttcttaacatttgggatcaaaatgtgatttatgccactcttacccaggggtgcttatggtaacactcaaattttctttgaagggaaaagtcaatacgataaagttgtcagttctccccaagggaatctttaaaatcaatatgatttcattaaaactccaacaaatattttcatattacttggtaaataaacccaaaactaattaggaagagcaaaggatcaagaatgactcagacaaatttgaagaaaatgaaccattttaggagaattgccctatgaaatgcaaaaactagttataaagctttattagctaagacaatgtagcattgatgcaaggataaacaaagagataaatagaacctatagggaacctacaaacatgatgatgcacatttgaaaacttgacatatattgcactacttaactctgggggggaaatggactctattaaatgttgtttggccagttgtttatacatttgaaaaaaaataaaattagattgccaacacatattataattttagaaaatttccaggtggataactgcctraatacagaaaatcagaatgttaatgcattttgaagaaaacataggcccaaggcagtggctcacagctgtgatcctagcactttgggatgccaaggcaggaggatcacttgagacgaggagtttgagagcagcctaggcaacatagtgagaccccatcccccacctccccaaaaaaggaagaaaatatagaatctttttataaactttgggcagaaaagtacttcttaaacaaaacacaaaaaaatacctacttacaaatgtggatatactttagaaaattattttcctctaaaccaccatgtttcaaagatatataaaaagacaagctacagatagggtgaaagtatttgcaatatgtttaaggaaatattaatatccaagatatataaagatatctcatttaagttaataagaaaagtcactcaacccaacaacaacagtgtaacaaatgggtaaaagaaatgatttgacaatttgtggaagtagacaggtgacttacaaacatatgaaaaaatgtttaccygcactagtaatcagtgaaatgcaattgaaatcacattgtaatatctttttacagctgtatgattggcagtacttaaaggatctgagcataccaagtattcctgagggcatggagatttgttaatgtctaataaaattgaaaatgcttataatcttttctttgactcaggaattttatttctgggtatatatcctggagaaaactcattcatgtgcataaggaggcatgtatgaagttgactattacagcaatattttattatacctaaattggaaaacaacacaattgtccagctgcaaaataatgaataaatacattttggcatattgataaaagatgatactatatagttgttaaaataaattaggtagaattacagttataatagtcatggttaaatctcaaatgtaatgctgaatgaagcaaactaagttgcaaaaagagaggtatacatcataatttttgaaaataaacgattgtatgtaaattatgcctattcatgcatatatatagatcctgtttcaaaaaatccgtagaaaggtcaaacactttattcttttattattattattagtattatacttcaagttctggggtacatgtgcagaacgtacaggtttgttacataggtatacatgtgccacggttgtttgctatacctgtcaacccatcatttaattagtgtggtgattacctctgtataagcaatgaagagaataaaactagagacaaataataaatgggcttcaacttttctgtaatgtgcttctttagaaaaaatatgactcgggccgaccgtggtggctcacacctgtaatcccagcattttgggaggccgaggcgggaagatcacaaggtcaggagttcaagaccagcctgaccaacatgatgaaaccccatctctactaaaaatacaaaaaaacattagccgggcttggtggtgcatgcctgtaatcccagctattcaggaggctgaggcaggagaatctcttgaacccgggaggcggaggttgtagtgagccaagatcacaccactgcactccagcctgggtgacagagggagacattgtctcaaaaaaaaaaaaargaaagaaagaaagaaagaaaaaatgtgactcaaatatagcacaatgctaggattttataaaggkgagtattgggtacatgaaagtttattatctgtttgactacatttctcatgtttgaagtatttcattatgaagaataaaaatgatatatataaaatakatatagaaatgtaaaagtattatacaataaacagtatcaatacatacaatgctcataaacataagtatgaacacacacaaaaacacttgtatgtatatgtaagtatacagatgcacatgaatgagcattacatatttgaagtatacaccttgaatgggaaggattccctgtaattcctggttaagtttttccttagggaagataggtgtgttgtgagactaggtattaggcccaaarcatatttcatctggatctcttatgttttatgtrcagttattaaggacaaaaatgatataaatatgtaaatatatcatttgcagttatcaatttttgtgataggaatatgtatgtttggtaaactgaatgtctccatttagtattacttgtttctatcctttaaaacagtctttatttttattttttttttcaacttgtatttttgattcagggggtacatgtgcagatttgttacctgggtatattgtgtgaggctgaggtttgggatatgaatgatcctgtcgcctaggtaccaggcatagtacccaatatttagtttttcagcycttgcttccctctcttcctttcccctctagtagtccccagtttctattgttgccgcctttatgtccrtgagttcccaatgtttaacttacacttataagtgagaatgtgcggtatttgattttctgttcctgtgttagtttgcttaggataatggcctccagatgcatccgtgttgctgtaaagggcatgatttcattcttttttatggctacatagtattccacagtgtatatctaccacagtttctttatctcatccaccatttgtggacatttaggttgattccatgtctttgctgttgtgaacagtgctgcagtgaacatgcatgtatcattttggtagaaaggtttgttttcttttgaatatatacccagtaatgggattactggatcacatggtagttctgttttaagttctttgagaaatctttaaactgctttccacagtggctgaactaatttatattcctcccaatagtggataagcattccctcttctccacattcttcccagcatctgtttgttttttttttaactttttagtaatagccattctgactggtgtgagatggtaactcactgcggttttgatttgcatttctctgatgattagtgaagtggagcattgttttatgtttgttggtcatttgtatgtcttcttttgggaaatgtctgtttgtgtcttttgcccagtttttaatggaaatagtctttttaaaacattaagtgtttgactaagatctggggcttctatagtcatccctgggaatccacaggtgattctttgtaagacctcagtggataccaaaatctgccgatgctcaagtctcttacagtatagtatagagatagtatttgcatataacctgtgcacatctttcaaatagtttaaatcgtctctggattacttctaatatgtaatacaatgcaaatgctgtgtagttaagttttttactttgtactttttattgtattactttttttattttttcaaaatattttatatccacaattggttgaatccacaaatgtggaacccactgataacaggaagcagaactgactgtatgtaaaagatagattttggatcaaaaagagtatcttaaaaatcacatattttgtcaactgatttgttggaaatgattattacataaattaattttttatgtaatttatgtgggtaattttttcctctttctaaagaatacaagtcaatgaccagattgtggaagtggatggaatcagcttggtgggtgtgacacagaattttgcagcaacagttctcagaaacaccaagggcaacgtcaggtaaatacgtgccttctaatatacaccatgttgttactttagttgaattttaattttctatagtttaacctgcaaataaatgtaattacaatgacaattttacctgaatagtaaaactttgcttttagttttaaatattttcacctttattwtaattagttcatgaaaatagaatttaaaattacaaatcatagtattttagaaagatacaaaaacaagcacttgtcttcatatctttctaaaatactatggtttccaggaagatataatttctagttaaaacctcaataaatatgaattaggtcccaaatctttttaaggaaaacagttatacaatacttgaaatgattatacatatattcaattttctgtgttttttagacaatcaggttgaataaagataagtatattttttaaatgtatacattcttttaaggaatcagccatgaccaatgtttgatgaattataacttttccaacttaatgcacttagggtgcattttttttggaccttgaaatttatattcaaacttgggattgtgaatattgtatattggaaaacaagtaagaagcagtttagagctagttgaagtcaaggtttgaaatcaggtcttttttttgcttataggttacttatttatcttcagtattgcttatatcatatacttttccatacatcttgtgtaagaaacattaaggaaacattatttagtatgtgtaatgatgaaaatggttgggtgttctcattatcaaaatgaaactgctaaatattctgaaaatattaatgagttaacattgctatacaggcagtaacattaggatattattgcagtatgtctaattttgctgaagcatgatttaagttttagactttaggctttttcaactgtaaatcatcttctaatgctaaagggatgccttaaggaatattacctaaactacttctgtgggcgctatgttgatgtttctagaatatccacagtcctgagaaaagaatgtaaaataattgcaaaactgtgtggtgctctctgagttgtgtgggtgggcccattcagtaaatgtgattgtctttttgaagatcactatgtgttcttaagacagcactttcccatgtctgtatagaacttggttttgaagctgtccattagactttaaagtaaattttaaaatgaaataggtaagatatacattcaactcataagaacatttctcagttggaaaagaatttgtagttacatgaaaccatagccatcccttttttcccctctgttgactgcgtaatcttgtgttattattttcagccttgtacaaatttcaaaagtcttcaaatgtcttcttaactggtctgtctgttttcacattctcacttcctcagtctgctctgttcatcattactctcatggaaggacataattacagtttttaagtaaatgaagggctatcatggaaaaagaaattgaccttattctgcttaactctagtacaggttgagtatcccttatgttaaatgcttgcaaccagaagtgtttccgatttcagattgttttggcatattaaaatatttgcattatatacttagtagttgagcctccctaatgtgaaaattcgaaatctgaaatgctctaatgaatatttcctttgggtgtcatgtcagtgctcaaaaagttctgagtgttctgaacattttggatttcagatattttgatgtgggatgctcaacctgtataaacttccatgtgcaggggttttttttgttttgttttgttttttgtagttgttattttttgagacagagtcttgctctgtcacccaggctggagtgcagtggcgcagtctcaactcattgcaatctctgcctcctgggttcaagcagttctcctgcctcagcctcgcaagtagctggattacaggcatccaccaccacatccagctaattttgtatttttagtagagacagggttttgccctgttggccaggctggtcttgaactcctgacctcaggtaatccacccaccttagcctcccaaagtgctaggatcacaggtgtgagccactgcgcctggccccatgtgcaggtttttgtgtggacataagttttctactgggtaaataccaagcatggagcataattgctatatcatgtggtaagtgtatgtttagttttgcaagaaaccaccaacccatcttcaaactggctataccattttgtattcctatcagcaatgagtgagagttcctattgctccacatccttgccagcatttgttgtcagtgttttggattttgaccattcaaataggtgtatagtggaatctgattgctttaatttccatttacctccattgtccattaatatttacaactggtaatgaaaagtttcatgttaatatgatttgtaatcctttatagtattttctttttttacctcttttggatttttttctcttataattgggcttttgtaatttttatcagactgtaactagatctgtgtttgtttatttggttttgtgaaattctgcttgggattcaatctgaagacttggatttcagaaagtttctattatgctttggttatttgctttatttcttctgcattgtctttggcctctcttctcaaaccagtattaaatggggcttagatttcctgggcrtatcctctagaatcttattttctctcaggatctccatctgtttgaatttttgctagtataagagtttctttaattttctcttccagattaccatggttttttttcttttcttttcttttttttttttttttttttcaggcatggcctattttaactgttccatgctttattctctattttctgtttttatttctagctccattctctcttcctagagcttaagaatagtatatccagcttcctacttgacatcttcatatggcattctaaaaggaacatcaaatttaatatactccaagtattatcctttatttgtgccattccctgtcttctgccccactttcctgctttgcccccttcccccaaaaaactccatgtcacatgacatacaattggctgcttctaccttatcaagtctcagttcaaatatcaattcttcaatgaatgagcttttctcatatttatgttgtccaaactcaaattcactctatctcaattaccatgttttctacatagcattcatttactgatcctcttctgatcctctccacctggttattgactttcttttgsgttttctactgtattgattcctgtctagtctgtatgataatttgaatatgaaagtaatgatctgtgactttttaggctaggttataaaaggcactgtggctttcatcctgctcttttggatcaccagttttagggaaatgtagctgccatatcaggaggctttcaaatacccttttgaagatgcccacacagggaagacgttgggcctaccagcagccagcactaacttaaccagacatgtggggaggcacctttgaagatcttccagccttastaaagcattcagatacctgcagcttcagctaacaactggttgrattttgtgagaatcaccaagccacaattgaacagacaagccttccttgaattcttgactcacagaaactatggaagatagtaactgtttataagttttggggtaatttgtatcagcagctacaacttacacatattttggtacctgaatgtgggctccagtttaacaaaaactgaaaatgtgggagtagctttgggactggactgttagtgaggctggaaggactatgaggagagtattagtaaaagccaaagagatcttacagtgattgctgggagaaaactgatggtctgtgaggaggaagctggtgagggcttaaagaagaaaactataaatgttattgaaaattgggtcaggcgcagtggctcatgcctggaatcccatcattttgggaagctgaggcaggtggatcatctgaggtcaggaattcgagaccagcctggccaacatagtaaaaccccgtctctactaaaaatatacaaaattagccaggtgtggtggcacatgcctgtaatcccagctacttgggaggctgaggcaggagaatcacttgaacctgggaggcagaggttgcagtgagccgagatgcaccattgcactccagcctgggcaacaagagtgaaactccatttcaaaaaaaaaaaaaaaaaagaaagaaaattagaagaaagagtatcttcattatgtaataacagaacatttaacaaaacttacctctagtaatatggaaagtagaatattgactgggacatttaactcataagatttctagccattgttgaaagtgtcactagctgctttttgctgtgtataagtaaaatttatgagaagatagataagctaaaggaagaactgttaaaaataaagcaagttaaacaaactagaaaacttagacaaactggataaatttctggatacatatatgtagcctaccaagattgaatcaggaagaaatagaaaactggaacagaccaataatgagtaacaagattgaatcagtaataaaaattctcccaacaaagaaaagtccaggactggatggcttaaatgccaaattctagcaaactttcaaacaagaactaacaccagttctcctcaaactattccaaaaaattgaagcagaggaacttctccctgattctttctatgaggcaagcattaccctgataccaaaaggagataaggacagaaccaaaaggaaaactgcagrccaatattcccaatgaacacagaggcaaaatttctcagcgaaatactagcaaaccaagtccaacagtacattaaaaagataatacaccatgattaagtgggatttatcccagggatacaagaatggctcaacatatgcaaatcaataaaatatgctacatcacatcaacagaatgaaggacaaaaaccatatgatcatctcagtagatgcagaaaaaacatttgataaaattcagtatcccttcatgatgaaaaccctcaacaaaacacgcatagaaggaaaaaacctgtattagtccattttcatgctgctgctgaagacatacctgagactgggcattttacaaaagaaagagatttagtcaacttacagttccatgtggctgggggaggcctcacaatcatggtggaaggcaaggaggagcaagtcacatcttacatcttacatggatgacagcaggcaaagagagagtgcttatgtagggaaactcccatttttaaaaccrtcttatctcgtgagacccattcactatcacaagaacagcacaggaaagacctgtccccataattcaatcacttcccaccaggttcctcccatgacatgtgggaattgtgggcgtaacaattgaagatgagatttgggtrgggacacagccaaaccatatcaatacctcaacataataaaggccacatatgacaaactcacagctaacattgtattgagtggggaaaagctgaaagccttttctctaagagctggaacaagacaagaatgcccactttcaccattcctattcaacatagtactggaagtcctagccagagtaatcaggcaagagaaagaaataaaaggcatctgaataagaaaagagaatgtcaaacggtccctcttttcagatgatgtgatcttatagctagaaaaatttgaagactccacgagaaaactcttagatctgataaaacaaattcagtaaagttagtcacaggttacaaaatcagcatacagaaaataagtgctgtttctatacaaaaataatgaactagctgagaaagaacacaagaagacaaccaaatttacaatagttaaaaaaaaaatacctaggaataagtttaaccaaggagatgaaagaccttcacaaggaaaactacaaacactgatgaaaaaaattgaagaggacacaaacaaaacaaagagcccatgctcatggattaggagaattaacgttgttaaaatgaccacactccccagagcagtctactgattsagtacaatccctgtctaaatatcaatgtcatttttcacagaaatagaaaaaagatcctaaaatgtgtaagaaaccaagtacggctcaaataccaaagtgattctgtgcaaaaagaacaaagttggaggcatcacattacctgacttcaaaatgtatcacaaggctttagtaaccagaacagcaagatattggtataaaaacagaaacacagaccaataaaacagaatggaggacccagaaacaaattcacacctttatggccaactgatttttgacaaagacaccaagaacatacattggggaaagggcaccctcttcaataaatcatgctgggaaaattgcttatctatttgcaggagaatgaaactggacccttatccctcactatatataaaaatcaactcaatatggattaaagactgaaatgtaagccccacatctgcaaaacaactagaaggaagcatagaggaaacacttcaggacattggtctaggcaaatactttatggctaagacctcagaagcacaggcaatgaaaaaaaaaaaggataagtgggactatattaatctaaaagacttctgcacagcaaaggaaacaacagagtgaagagacagcctgttgaatgggagaaaatatttataaactatttgttcaacaagattctaatatctagaatattaaaggaactcaaagcaacagtaaaaaagcaaaaatagtctcattaaaaagtcggcaaaggatatgaatagacatttctcaaaataagacatagaaatgactgatatatgtgaagatgctcaacatcagtaatcatcagagaaatgcaaaataaaactgtactaagatatccrcttaccccaattagaatggctgttattaaagagacaaaaggtaacagacgctgacaaggatgtggagaaaaaggaactcttacacaccactgctggggatataagttaatacagtcattagggaaaacagtaaggagacttctcaaaaaactaaaaatagaactaccaaatgatccagcagtcctgctactaagtgtttatttaaagaaaagaaatcagtatatcaaagagatggcagcatctcagtgtttattgcagcactattcacaatagcagtgatatggaatcaacctacctaagtgtccatcaaaggatgaatggatttttttaagtggtatatatacacggtgaaatactattttgccataaaaaaggtgaatcatgtcatttgtagcaacgtggatgggaactggaggtcattatgttaactgaaataagccagacacagagagacaactatgacatgttttcagtcctatataggagctaaaaatgttgatcttatagaggtagagagtagaatgatagttaccagaggctggraagagtgtaggggtgtgggtgggcggatgaagagaggttgcttaaaatgtacaaaaatacagtccctagaagaaataagatttaatgttcagtagcagaaagttaataacaatgtatgtatattacaaaatagctagaacagagcacttgaaatgttcccagcacgtagaaatgataaatagtagaggtaatgaagactccagataccctgatttggtcattatacagtatagcatgtaagaaaatgtcacttttatcccataaatatgtacaaatgtttatatcaattaaaaaatttaaaaattaatagaacttaccctcaaactaaatgtagctctgatcccacattcaaaagccttaaaagcaagcctcagaaagatttgttttttagtactttaattgtcccagaggaatactcaagaatacttattgtattacaaaaaatatctttatatctggcatgcagtcaacaatttctgggcatgcaaagaatgaggaaaatatgagccacaatcagtggaaaaattaattgaaacagatccagcaatgttagaaataaaagcagtagatgaaaacattaaaatagttgttataattagatttcaaaaatacaataaggtagcaaaagggctgagtatgataagtagatacagaaaagataaaaagaaggttctactccaacttctaaaatgaaacatatgtgttatgaaatgtacattggatgggataacagattcaaatatgcagaagaaaaaattagttaattttaagacatactacaatagaaagtatcaaaatttaaacacagaaataaaagacaggaaaggatgaacagaacttcaagaggctgtggcataattataagctactaatatacgcttttggaatctcagaaggttagaatgagagaggtgctagaaaagataactgaagagataatggctgaaaatttttcaaatttgatgaaatttttaagatttataatatcacagatccaagacattcaagaaatcccaaatagaaggaatatgatgaaaactacatgaagagacatcataatcaaaatacttgaaatcagtagtaaagaagaaaattataaaagcattctgagaagaaaggcatattgtgtacagtgaaccaaagatgagaatacagtagactttgcagtagaaataatacatcaccaaggaaagtgaataataatttaaaagttttgaaagaaaaattggaattttatactcaaggaaatagctttcaaaattgaagatgaaatgaagaccttctatacagaagctaaaagaattcattacctggagaatactattataagaaatgtcaggggaagtctttaataatgtaaataatataaaacgaaattctagacctacasaaggaaatgaagagaaatagaaattatgtgggtaaatataggctacttcattttttaaaaaattatttaaaggattattaactttttaaaacaaaggacatgactgtgttgtttgagatttataatatcgagaagtaaaatttagaacaatagcatgtcggtttttatgacaacatggaagtatacttttgtaaggtgattatgctgtgcatgaagtagtagtatattacttggagacagactgaaataaattgaagaggtatgctataagacataaataaacactgaagaaaccccagcaaagagttataccaataaagagttatacaacaaggataaaacataattataaaagtactttatccaaaaaatgcaaaaaagaaaaagagcacaggggaacaaaaaatgaagagatgtatagaaaactaacagcacaatggtagctttaaacccaaacttatcaggaatttcttaaatgtaaatggtctaatgaccaatttaaaggcagagattgtcatattatatttttagaaagtaagtctcaaataggttaaaagtaacaggatagaaaaaatgtgtcacgctagcattaatcaaaagagcactagtgtggttatattgatattagacaaaataaattttaaaagtcagttttgaaaacataaagttagtaaatctttagtcagacttgtttgatataaaaagaacaaagacacaagttagaatgagaaggtgtaattacatattccacagatactttaaggattaaccaatattatgaagaactttatgccagtgaatacaacaagttagactaaatggttaaattttatggaagacagtgctatgaaaaattaccaaagttcactcaagaaaaaattgtttatgtgtatacatgaagatgagtttagatttaagatcctcttaaaaagaaaattgtttgtttcactggtgaatcttagcattagatggagaaataataccaactcaacatatactctttcagaacatagaagatggtatacttctcaactacttttatgaagccaatgttgctatgatagtataatttttaaaaggcattaaaatacaaactatcacaaaccaatattcctcatgaatgtaaatacagaagtccaaattggattataaatccaatagccaggtgacatttattgtttgaatgtatggttgatttaatgtttatgaatcaacccatggaatttttcttactgataggattaaggtaaaagtcatttgttcttctcaatagatgtagatttttttaaaaaagctctcaggaaacttgaaatagaagggaatttcctcaatgagataaataggatcttagtgaagcctgcaactaataacattcttaatggtgaaagacctaatgcttttctcttggtattaagaacaatgcaaatatctctaccctcaccacttccattcaagattgtaccagaggccatagctaattcactgagacagtaataactaattgaaagcccatagaatgaaaaggaggaagtaaaactctttattcacaggcaatatggtcatttatacacagatgaccatgaagaaaatcctaaagtatctacaaaagatgctacttgaactgataactgagtccaatcatgttatagaagatgaagttgtccaatcatgttacagaagatgaagttgatgtgcagaaatcagagtgtatatactatcaacattaataattgaaaattcagattgaaaataacattgatgacagcatccaaaatattaaatacttaaaggtaaatctaacaatatattgcagacttccacacttaaaacaacaaaatattgctgacagaacacaaagacaatttaaatgagggaagaagtagaccatgttcaatgtattataatattcaatattgttaagatttcaactttccctaaattagtctgtagattaaacataaccctagtaaaaattttagaagattattttgtagatgttattgttaaaaaaaatttcggaggactttccctgcctgaaagcatcactaatcaaggcaatctggttgaggtataagaatagtaatatagattaatggatcagaatagaactttgcagtgcagacctgcgcagatatgaagaattgatttttttttataaaggtaccaaggtaattccgtggaggaaattatagttaactcaaaaaatggggctgaaaaaattaaatagtctcattgaaaacaaaatacaaaccaaaaaatgccttgaccttcatctcacagtatatataaaaattaacttagaactgatcacaaccctaattgcagcagctagaacactaagatttctagaaaacaggcaaaaatctgtaattttagatttagtgaaataactcaggaatagaaaatcaaataccttatattctcatatataaattggagctagacatgggtatccatggacatacagagggaaacgctgtaggtaatatacacyggggactctaaaagaggagaactggaggaggatgaatgttgaaaaattatctgttgggcacaatgttcattgttaaggtgatgagtatgctagaagctcaaaccccactactaygcaatatatccatgtaacaaatctgcatatataccctctaaatgaatgaaaaaaaatttttaatgcaatataacaatttaaaaatttttttagggcacaaaagcaaaaagtgtaagaggaaataatgataaactgcgtcaaaatttaaaacatttgttacaaaatacccttaagaaaatggaaaaacaagccacttaagaaaatggaaaaacaagccacagaatgaatatctgtaaaacaattttctgataaagaactcttgtaattcaataagattattataacaactatataatggagtttttaaatgtgcaagtcctattaaaatgtacaaatcacttaaagagacagttcatcaaagtagatataccattaaacatgaaatgctgcttaacattattagttattaggggcaggtaaattaaatccacaatgaggttctactgtacacctgctaaaaaggctgaaattaaaaagactgataccactatgcattgataagcatatggactgaggttcacatttatttgctgatcggaatgcaaaatagcacaaccactttgcagaacagtctggtagggttttccaaagttaggcatacacttataccagctagcaattccgcacctcggtatttactcaagaacaataaaaacatatatttatataaagactcatatttgcatattcatagcagctttttcataataactaaaaactggaaacaactcaagtgttctttaactgataaatggatatacaaattgtattatatcccatataatgaaatatttcccagtgatatgaaggaacaaactaccaatcctttcaataccatgtatgactctcaaaaccattatactgagtaaaagaagccagatgccaatagcctgtgtactgtttgaatacatttgtataaaattctggaaaatacaaaactgtgctaatagcagatctatgattgctcagaatcacgaagggagggaattgtctgcaaacaagaaggaaggaccatttctgaggtgatgaaaatgttctatattgtgattactgtatttcttacacaactatgtatacatttatcgaaactcctcagattatacaacttaaatttgatcaattttaatgtatatagattgaactcagtaaaactgaattttaaaatgtgagataatagctatcgttaacttaaaaagcaccatacgaattgattattgttgatagtgatagtgatgtgaaaaggactgtgtctctttaacaaaggcagatgtaatcaatgtgaatttcattagcaatctctagattttatggttctgtgtacttttacttttaaaatattattattgactttttaccagaaaatattttctgtacaatttcttgcatctaatttttttaycaaacatgaatttgcaacataatttttgaaaactcatgtttcttgagtctacagctataaacaggaccttgcctgtcttgttgaccactggcatagttggtgtacctattgttgtgtaacatattactataaaattcagtgacctgaaacaactaacttttattacctcatggtttctgtgatccgcttcccagcgaactcatttgggcccctctgccaggcctctcacaacatgaaaactggcttctccaaaaagtcatacaagagagtgcccaagatgcaatctgccatctttttgtaacctaaaatctgaaatgacatcccgtcagctctgtattttatttgataaaagtgagttaatatgtccagcctacatgcaaggatagataattacattcagacttaaataaaaggagtcaaggatcacttgggtctatgttagaggcagcctatcatagtacrgatcaataactagttggatggatggatggatggatggatggatggatggatggatgtggagggrtggtcagtcaggcagacagatgatgggcaaatagattaatgctataccacaatataatttaatttatgttgcatacccaacttaatcctgaaaaacttgagactatttaggaaagattgaccaggatggtgagaggtataactattttccttctatatataaaagttaaaatattctataaccctttgcctttaaaaaaaaaaaaacttaaaagacatggtaataattataaagcatttgaaaaagtgaactctggaaaaaggattagatttttttttaactccagacaatcattctagtactgtcagcaatttggcaaaatttgatataagacagagattttgtttcaatttgaagaaattttcaatgatttatatgtttgctcttcagtgtcattcacattaaactttaaatgctttcaagaaactatctgctacccatgatcaataactatgcattcatttcacttttatccctagcatatgggtttaataactttgacagggaaccatataacttctgatggtcataattttctaggaattataacaatagaaaataattaatctgagggtcttaaatatttatcttttttggaaaaggttaaaatacataaaagaaaatataggctgggatcatggccgacaggaggcaggactagattgcagctctgacttggacagacagagcaggatgtgtaggctctcatcatgaattttagctccataacgactgcaggaataatcagaaaacccgagaggacccacagaccctctgaaagaagcagatttctcctgcaggacccaggagacaccccaaatattttgctagtatccatggctgagagacccatagatggttcacatcacaggactctgtgcacacaacccccagtaccagcccggagcctggtggatttgctgggtggctagatccagaagagagataacagtaactacaacttcactgttaggaagccatatccacaggaaaagggggagagtactacatcaagggagcacccatggcacaaaagaatctgaacaacagccttcagccttagacctttcctctgacagaggctacccaaatgagaaggaaccagaaaaccaactctggtaatatgacaaaacaaggctgtttaacaccgcccctcccccccagaaaaaaaatcacagtagctcaccaacagtggatccaaaccaagaagaaatccctgatttacctgcaaaagaattcatattagttattaagctaatcaggaaggcaccagagaaaggcaaagcctaatgcaaggaaatccaaaaaaaaaacaatacacgaagtgaagggagaaacattcaatgaaatagatagtataaataaaaaaaccccaaaacttcacaaaacactggacacacttatagaaatgcaaaatgctctgggaaatctcagcaatagaattgaacaagtagaagaaattcagagcttgaagataagatcttcgaattaacccaatccaacaaagacaaagaaaaaagaatatgaaaatatgaacaaagcctccaagaagtctgggattatgttaatccaccaaacctaagaataatcagcgttcctgaggaagaagacaaatctaaacgtttggacaacatatttggggaaataattgaggaaaacttcccaggccttgctagagacctagacatcaaaatacaagaaacagaaagaacacctgggaaattcattgcaaaaagattatcacccaggcgcattgtcatcaggttaactaaagttaagatgaaggaaagaatcttaagagctgtgagacaaaagtaccaggtaacctgtaaggcaaaacctatcagattaatggcagacttctcagcagaaaccctacaagctagaagggattggggcccaatcttgagcctcctcaaacaaaacaatgatcacccaagaattttgtatctagtgaaactaagcatcaaatatgaaggaaagatacagtctttttcagacaaacaaatgccaagagaattcaccactaacaagccaccactacaagaactgctaaaagaagctctaaatcttgaaacaaatcatggaaacgcatcaaaacaaaatgtcattaaagcataaatctcacaggaccaacaaaacaaaaatacaagttaacaaacaaacaaaaaccagggtacacaggcaacaaatagcatgacgtatggaatggtacctcacacatctcaatactaacattgaatgtaaatggcctaaatgctccactttaaagaaacagaacagcagaatgggtaagaattcaccaaccaactatctgctgccttcaagagactcacctaacacataaagactcacataaacttaaagaagcagaaaaaggcatttcatgcaaatggacaccaaaagygaggagtagctattcttayaaaagacaaaactttaaagcaacagcaattaaaaaaaagacaaagagggacattatataatggtaaaaggctttgtccaacaggaaaatatcacaatcctaaacatatttgggagctgcacacctaaaagaggagctcccaaatttataaaacaattactgctagacctaagaaatgagatagacaacaacacagtaatagtgggggacttcagtactccactgacagcactagacaggtcatcaagactgaaagtcaacaaagaaacaatggatttaaactataccttggaacaaatagacttaacagatatatacagaacattccatccaaagccacagaatatacattctattcaacagtgcatggaactttctccaagatagaccatgtgatagaccacaaaatgagcctcaataaatttaagaaaattgaaattatgtcaagcactctttctgaccacagtgtaataaagctggaaatcaactccaatataaaccttcaaaaccatgcaaatacatggaaattaaataacctgctcctgaatgatcattgggtcaaaaatgaaatcaagatgaaaacttaaaaattcttcaaactgaatgacagcagtgacacaacttatcaaaacctcagggatacagcaaatgtggtgctaagaggaaagttcatggccctaaacacctacatcaaaaagactgaaagagcacaaactgatcatctaaggtcacacctcagggaactagagaaacaagaacaaaccaaacccaaacccagaaaaagaagggaaataaccaagatcagagcagaactaaatgaaattgaaagaaaaaaaatacaaaagataaatgaaaagttggttttttgaaaagataaataaaattgatagaccattagcaacattaaccaagaaaagaagagagaaaatccaaataacctcaataagaaacaaaacgggagctattataactgacaccacagaaatacaaaagatcattcaaggctactatgaataactttatgtgcatacactagaaaacctagaagagatggataaattctttgtaagatacaaccctcctagcttaaatcaggaagaattagatacccygaacactccaataacaagtagtgagattgaaatggtaatttaaaaattaccaacaaagaaatgtccaggaccagagagattcacagcagaattctatcagacattcaaagaagaattggtaccaatcctattgacacaattccagatagagaaagagggaaccctccctaaatcattctatgaagccrgcatcaccctaatatcaagaccagaaaaggacataaccaaaaaagaaactgaagaccaatatctctaatgaacacagatgccaaaatccttaacaaaatactagttatccaaatccaacagcatatcaaaaagccaatccaccatgatcaagtgggtttcatactagggatgcagggatggcttaacatacataagtgaatagatgtgatacactacataaacagaattaaaaacaaaaattacaagatcatctcaatagatgcagaaaaagcattcaacagacttcagcattcctttataattaaaactcacagtaacattggcatgcaagggacatacctcaatgtagtaaaagccatctatgacaaacccacagccatcataatactcaatggtgaaaagttgaaagcattccctctgagaactggaacaagacaaggatgcccactctcaccactccccttcaacatagtactggaagtcctagccagggcaatcagagaggagaaataaagggcatccaaatccataaagaggaagtcagaagtgtcactgtttgctgatgatatgatcatttacttcaaaaaccctaaagactcctccagaaaactcctagaactgataaaagaattcagcaaagtttctggatacaaaattaatatacacaaatcactatctcttctatataccagtagcaacaaagtggagtatcaaatcaagaactcaaccccttttacaatagctgcaaaaaaaaaaaaaaaaaatacgtaggaatatacctaaccaagaaggggaaagacctctacaaggaaaactacaaaacctgctgaaagaaatcatagatgacacaaacaaatggaaacacgtcccgtgctcattgataggtagaatcaatattgtgaaaatgaccatactgacaaaagcaatctccaaatgcaatgcaattcccatcaaaataccaccatcattcttcacagaattaggaaaaaacaattctaaaattcatatggaaccaaaaaagcctgtatagccaaagcaagactaagcaaaaagaacaaatctggagccatcacattacctgacttcaaactatactataaggccatagtcaccaaaacagcatggtactggtataaaaataggcatatagaccaatggaacagaatagagaacccaggaataaacccaaatacttacagcctactgattttcgacaaagcaaacaaaaccataaaatggggaatggacaccctttttaacaaatggtgctgggatacagattggctagctacctgtaggagaatgaaactggatcctcatctctcaccttatataaaaatcaactcaagatggattaaggactttaagagccaaaagtataagaattctagaaaataacattggaaaaacccttctagacattggcttaggcagttttgggtttcatgaccaagaacccaaaagcaaatgcaataaaaacgaagataaatagctgtgacttaattaaactaaagagattttgcacagccaaagtcacagtcagcagagtaaacagacaacccacagagtgggagaaaatctttgccatctacacatctgacataggactaatatccagaatctacgacaatctcaaacaaatcagcaagaaaaaaaatcccatcaaaaagtgggctaaggacatacacagttctcaaaacaaaagaagatatacaaatggccaaaaaacatgaaaaaatgctcaacatcactaataatcggggaaatgcaaatcaaaaccacagtgtgataccaccttactcctgcaagaattgggcataatcaaaaaataaaaaaactgatgttgactgacatggatgcagtgatcatggaacacttctacactgctggtgggaatgtaaactagtacaaccactatggaaaacagtgtggagagttcttaaaggcctaaaagtagaactaccatgtgatccagcaatcccactactggatatctacccagaggaaaagaagtcattacatgataaagatacttgcacacacacttttatagcaacacagttcacaactgcaacatcatggagccaacgcaaatgcccatcaatcaaagagtcgatatagaaactgtgatatatatatagatatatctatctatatatatagaatatatatagaatatatagagaaaatatatagaatatatatagtatatagagaatatatatagaatatatagggagaatatatattccatcatatatatagaatagagagaatatatatagaatatatatatagaatatatagaatatatatagtatatatagaatatgtatggaatatatagagagaatagagagaatatatatattccatcatatatatagaatatagagaatatatatattccatcatatatatagaatatatatagagaatatatatattccatcatatatatagaatatatatagagaatatatatattccatcatatatatatagaatatagagagagaatatatatagaatatatatatattccatcacatatatatagaatatatatattctgtcacacatatatattccatcacatatatatagaatatatatattccgtcacatatatatagaatatatatatattccgtcacatatatatagaatatatatatattccgtcacatatatatagaatatatatatattccgtcacatatatatagaatatatatatattccgtcacatatatatagaatatatatatattccatcatatatatatacatatatgatagaatactactcaaccatataaaggaatgaattaatggcattcacggcaacctcgatgagattggagactattatactaagtgaagtaactcagaaacagaaaaaccaaacattgtatgttctcactgatatgtgggggctaagctatgaggatgtaaaggcataagaatgatacaatggactctggggacttgggaaggttggggtggcaagggataaaagactacaaatagggtgcagtgtatactgctgggtgatgggtgcaccaaaatctcacaaatcactaaaggacttactcatgtaaccaaacaccacctgtaccccaataaactgaaaaataaaaaaataaaaatgtatatataggctaggtgcagtgactcacacctgtaatcccaacacttgggagccaaggcaagagggttgcttgagacaggagttcaaggctgcagtgagcaatgatggcaccactgcactccagcctgggcaacagaatgagaccctgtctcaaaataaaataaaatataaatgaatgacacatgagttttttaatagatatgcacgtttatatttggatatacacctggatgtgtaatttctatacatggaagcttttgtttcttttatatttacttaagatcatttccatttgaaatgcaataaacctcaaaatgtttttactttatttatatcatttcattgtttttgttgccactatagtacaaggggcaattgagaatttcactttttattagagcttttagttttgtgattttgaataataaagtgttatatgcagtggagggcagtgagggaatcttcatattcatggaaatcatccaccattgtggattttgtacttattcctaagactaccgcttgccctaagatgagagaagcaactactatggattttggatcatggatgttagatctccttaatgttgaatatatcagaatggccaacaaccactgttgagagaaagagtaaaaccagcaaggatttcaaaaaaactaattaaatgtgattttgccttgatgaggcattttctggtgtcactatatacagattaacattttgcaaactacctttttaatgttcatatacattaatatttaaacctaagacatcaaggctaactactaagcagagaaatgttrttcctggaagggatgtagtatttttggaaaatatcttaagtttatgcctgttaaatagtgtgtagttcttgaagtagcatgtgttaggcaatttttttttttaagaattcaactttttgtttacaatgaaatatagcatagaaaaatactctttcttttttttttgagacagggtctctctctgttacccaggctagagtgcagtggtgcaatctcggcttactgcagcctctgcctcccaggttcaagtgattctcctgcgtcaccctcccaagtagctgggattacaggcactcaccaccacgcctggctaatttttttgtatttttagtaaagatggggtttcaccatgtttgccaggctggtctcaaactcctggcctcaggtgatctgcccaccttggcctcccaaagtgctgggattacaggcatgagtcacccttcctggcaaaaatattcttttttttttttttttttttgagacagagtcttgctctgttgcccaggctggagtgcagtggcacaatcttggctcactgcaacctctgcctcccgggttcaagtgattctcctgcctcagcctcccgagtaggtgggactataggcgcccaccaccacacatggcttttttgtrtttttagtagagacggggtttcaccatgttggccaggatggtctcgatctcttgacttcgtggtccacccgcctcgggctcccaaagtgctgagattacaggcgtgagccacagcgcccagccaaaaatattcttataattagtattgggttagataggaaattcatttcaaagaactaatgcctataattaaatttaaatatttcagatccagctttctttattttaaaaattttttattttattctattttattttatttttaaatggagtctcaccatgtcacccaggctggagtgcagtggccagatccagctttcaaaagcaatcatcttcatagatgaatttttaaattttttaatgttaagtatgtagtaaggtatattaatctagctctcaatatagaaaggaaaaatatgtaagaatatgcagttacaaataaggagcaagagyttggttgtctaggacttttaactcttaactactgtcagcaaactagtgaaagtggctggagttaaatttaccactacatgctcatcgaaatcaagttaaatattaaaaagctatcaaattcagagaaaagccatttaatataatcaaacagaaacaattaggcactgtgcttttctaaaacactctaggatcttgtgacccatagttcacgagggtattccaatattcaagtataagttgtgtgcatctgtttttattttttagagatatatgtttcaggtattaaatgtacatacaataaatatttgtttgaatgaaattatttgttatataagaactggtaactatatcctggtgtagctttttcatttaaaaaaattatttcattttatttatttatttatgtcagtagttttgggggaacaggtggtgtttggttgcatgaaaaagttctttagtagtgatttctgagattttggtgcacccatcacccaagcagtgtacactgttcccaatgtgtagtctgttatccctcatcccactcccacctttcctcccaagtccccatagtcccttataacgtttttatgcctttgcatcttcatagcttagctcccacatataagtgagaacatatgatgtttggtttttcattactgagttactttacttagaataatggtgtccaactccatccaggttgctgcaaatgtcattattttcttcctttttatagctcagtagtattccatgctgtatatatatgtaccagcttttctttatccactcattgatagatggcatttagggtgttctatctttttgcagttgagaattctgctgcaataaacgtgagtgtgtgggtgtctttttcatataatgactttcttttgtctgtgtagctacctggtagttaaattgctaggtcaaatagtagttctacttttaagtttttttttttttaatttatttatttttattatactttaagttttagggtacatgtgcacattgtgcaggttagttactccatactgttttycattgtggttatactagattacattcccaccagccgtgtaaaagtgttcccttttcaccacatccatgccaacatctatgttttttgtcttttaattatggccattctttcaggagtaaggtggtatcacactgtggtttcggtttgcatttccctgatcattagtgatgttgagcattttttcatacatttgttagccacttatatatatcttctttgagaactgtctattcatgtccctagcccacttttttatgggattttttttttgtcttactgattggcattctctatagattctgggtattagtcctgtgtcggatgtatagatggcaaagattttctcccactcttggggttttctgtttactctgctgaaaacattctttgctgtgcagaagctttttagtttaattaggtcccatctatttacctttgtttttgttgcatttgcttttggattcttggtcatgaactctttgcctaagccaatgtctagaagagttttttccagtgttatctagaatttttatggtttcagatcttagatttaagtctttgatccatcttgaattgatttttgtataaggtgagaggtgaggatgcagtttcattcttctacatgtggctttccaattaccccaacaccttttgttgaatagggtatcctttccccacttcatgtttttgtttgctttgtcaaacatcagttggctgtaaatatttggstttatttctgggttctctattctgttccttttttctacatgcctatttttataccagtaccatgctgttttggtatagccatgtagtataatttgaagtcaggtaatgtgatgcctccagatttgttctttttgcttattcttgctttggctatgcaggctctttttttgttccatagaaatttttaggattttttttttctagttctgtgaagaatgatgatagtgttttgataggaattgcattgaatttgtagattgcttttggcagtgtggtcattttcacaatattgattctaccaatccgtgagcatgggatatgtttccattcatttgtgccatctatgatttccttcagcaacgttttgtagttttccttgtagagatctttcgaaactccctaaatatttttttaggagggtgaggagctgttgtaaaaaaggttgagttcttgatttgattctcagcttggtcgatattggtgtacagcagtgctactgatttgtgtacattcattttgcatcctgaaatcttactgaacttatttgtcagatccaggagctttttgaatgagtatttagtgttttctaggtaaacgatcatatcatctgcaaacagcgacagtttgacttcctctttaccaatttggataccctttatttatttcttttgtctgattgctatggctagaacttttcagtactatgttgaatagaagtggtcaaagtgggcatctttttcttgttctagttctcaggaggaatgctttcaacttttccccattcagtgtaatgttgtctgtgggtttgtcatagatggcttttattaccttaaggtatggctcttttatgccaattttgctgagggttttaattgtaaagggatgctggattttgtcagtgcttttcctgcatctgttgattatatgattttgtttttaattctgtttatgtggtgtgtctcatttattgacttgtatatattaaatcatccctgcatctctgatttgaagctcacttgatcatggtggattatctttttgatatgctgttggatttggtttactagtattttattgaggatttttgcatctatgttcatcaggaatgttggtctgtagttttctttttttgttctgtcctttcctggttctggtattagggtgatactggctttatatgatgatttagggaggattcccttcttctctgtcttttggactagtttcagaaaggttggtaccaattattctttaaacacctgacagaattcatctgtgaatccttctggtcctggacttttgttgtagttgttggcagtttttaaaattactatttcaatcttattactcattattgatctgatcagagttttcatttcttcctgatttaatctaggagggttgtatattttcaggaatttatccatttcctctagattttctagattcatgcataaaggtgtttatagtagccttgaatgatcttttgtatttctgtggtattggttgcagtatctcccatttcatttctaattgagcttattcggatattttctcttcttggttagttgcactaatggtctatcaattttgttcatcttttcaaaaacccagctttttatttcattgattttttgtattttttgttgtttgtttcaatttcatttagttctgctctaatgttggttcttttcttctgctgggtttggattttgttctttctctagttccttgagttgtgtccttagattgtctgtttgtgctctgttggactttttgatgtaggcagttaatgctatgaactttcctcctagcactgcttttgctgtgtcctagaagttttaatatgttgtgtcactattattgtttagttcaaagaatgtttaaatttctatcttgatttcattgttgacccaaagatcattcaggaccagattattttatttgcctgtatttgtttagttttgagggttttttttgagtcgatttccagttttattcccctgtggtctgagagggcactggatataattttgattttccttaatttattgagacttgtttaatttattaatttattggtctatcttcgagaattttccatgtgctgatgaaaaaaatgtatactctgcagttgttgggtagaatgttctctaaatatctgttaagtccatttgaagtccattattttgttgactttctctcttaatgacctgtctagtgctgtcaggtgagtattgaagtcccctattattgggttgccatctatctcatttcttatatctagtaataattgttttataaatttaggagtgctgcgttaggtacatacatatttaggattgtgatattttcctgttggactagtcctttcatcattgtatgatttccctctttgtcttttttaactgttgttgctttaaagtctgttttgtctgatataagaatggctattcctgattgcttttcgtttccatttacatgaaatatctttttccacccctttaccttaagtttatgtgaatccttatgccttaggtaagtctcttgaagatagcatatacttggttggtggatttttaatccattctaccattctgtatcttttaagtggagcctttaggtcatttacactcagtgttagtattgggatgtgaggtactattttattcatcacactagttattgcctgaatactttgtttgtttgtttgtttttgtttgtgtgtgtgtgtgtgtctgtgttgtgttttgktttttttttttttttgagacagaatctcactctgttgcctaggctggagtgcagtggtgcaatctcggctcactgtaacctctgcctcctgggttcaagtgattctacttcctcagcctcctgagtagctgggattacaggcacctgccactgcacctggataatttttgtagttttagtagagatagggttttaccatcttggccaggctggtcttgaattcctgacatagtgatccatctgcctcagcctcccaaagaatactttgttttttcttcattgtgttattgttttataggccccatgagatttatgcttcaaggaggttcaattttggtgcatttcaagggtttgtttcaagattcttgtagtgctggtgtggtggtgatgaattctctcagcatttatttctttgaaaaatcctttatctctccattttgaagcttagttttgctggatacagagttcttggtttgtaagtattttgtttgaggatgctaaagttaggaccctaatcccttttggcttgtagggtttctgctgagaaatctgctgttaatctggtaggttttcctttatgttaccactttatgttcctttaggttaccgcttgcttttgcctcgcagctcttaagattctttccttagataacctgatggctacgtgcctgggtgatgatctttttgctggtggtcatctttttgygatttatttcccaggtgttctttgagcctcattgtatttggatcctcttcctcctcaggaacaccagttattcttaggtttggctgtttaacataatcctaaattttttggagggtttgtttattctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcctgcctcggcctcccaaagtgctgggattacaggcgtgagccaccgcgcccggccgggtttgtttattctttaaaaattatttgtctttttctgattgggttaaagaccttgactttgagctctgaagttctttcttctactcattcaattttattgtcgaaattttccagtgcctttttttatttctctaagtgtgtacttcatttccagaagttgtaattgtttttctttatggtatctgtttttctggagcatttttcatccatayactgtattttttccttaatttctttaagctggttttcatctttctctggtatctacttgagtagtttagtaatcaaccttctgaattctttatctggcaaatcagagatttcttcttggtttggatcccttgcgcatgttatagaatcttgttttgccacattaccagaattacttttccgattccttctcatttgagcaacctgtttcagtggaaaaatatggaactcaagggctgctgttcagattcttttgtcccatgggtgatcccttgatgtggtacatttcttctttccctagggatgggacttcctgcaagccagacttcagtgactgttattgctcctctgggtttagacacctagcagggttactaggctctgtgttagtgctgggaaatgtctgtaaagaatcctgtgatgtgatccttcttcaggtctcccagccatggataccagtacctgctctggtggagttggcagggctgtgaaatagactgtgtgagagtccttggttttagacacgttgaggatgctggctttcttgaatgctggttatgccagcagtaaagttgtcacgtggacacactgagaaccactggtttgctgggattttgcaggcagtgaaattagctgttgtcttctccctccttggaacaggattgttctgtcatgagttgctgtaatgtcctaagttggtcggcctccatccaggaggtggcgctttcaagagagccccagagtttttggcctgtctttcagaacttgcagtggcttgccacttctttcaaagcatctgtgaattcttttagttttcctggtacattcctgtggtggttcctggattaaaagtccacattgtgagtccccacacattgttctgtctgtccaagtgggagctgcatgtcagccctgtctcctgtctgccatcttgactccacaatcagctttttcatttttactgaaacttaattccacattgagagtttttaaatttcagcattgaataagtgccatttttgactagtatataaattttattaaaacaactacatctgaaaaataaggaattcataaattatcatttttataacctctcgtcatttacatggaacatgtagaatctttatgacttcaatttagtaaattgtaaatacagtttaattgttgtttaacttgtatttgacagcttaccaaataaactaatgaaatgaatcccacgtaatctagatacctacactccaaagaacagtacatggatatttcttggcctgataataaatgaaaagaaaggaataactgatgtatctgccttgacttattgtatctcaacatgaaggggagagagggcagttcttagtgaaataatgcacattaaaacaagataaaaaattttaattgacataatgattgcatatattgaagtggtacataattatgttttgatttataatgtatagtgatcatatcatggtaattagcatatctatgatctcaaacattatcatttctttatgttgggaacattcaatgtcctcctagctatttgaaactctgtaatatattattgttaactagagtcatcccacaacggtatagaacactagtatttattccttctatatagtggtaattttgtccaaggtaattttgtttaacacaataaaaaaccatgctaaaaacataaaccttaattgtagattttagttttggtattgtattatttggcgatgataagcttagaaaaaatacttaatttttaatttaattcattagattttgtttctgttaatttattctttatagctaaaagataaaaagatcacactattttactatcacacattatttttgtttgttgaagcaaagaaaaaaatttagaatgtgacaagagaaaatattattaatcttaaagaaaatttaagttttaaaacaggctgattcaacacatgttgtcagttcagtttcagacaatgtataagatatgaatcatagttgtgcagaaatatcaattgatttggtcacacatatttaggactgattattgctgactattgttatatttttgaaggttttaaaaattcaattaaagtgattatatagatttatactttaatatttcagtggcaacagaaattttggttttcagagcacatctgagattaaagattttatccttttcctatggttgactcataaaaaatcaactctattttcaatactgtgatcaaataaaagggaattgggacagtgtgtagagtaagtacttttttttcatcatttcatcgtgtttattacctgctctcagattgcccagcaaagatattgtaacagtgtgcgttgtaatcaataagtaatgtataaatatgcagtttcaccatggcctcagcactattaaattttattattttaatttattattttattattaactggatagataggaaatggcatctctattttcttttcaatttaatgttctttgcttactagtgaaaagatgatacatgatctattgatgttgccaccaaagtttcagaacagtctataggaggtacttttaaatgcatttggccttgtctagattaaaacaacagcttacatttattaaacactcactaagcaccagatacttagtttttttaaggattatataatatttgttctggttagtatactcattttacaactgtggaaacaaaggcttagaaatattaatacatccaaggtcacagaatcagtaggtggtatttatagtttggtggatttgtcccatcaaagttggttttcccttttacttaccattttaactcctaagttgtactatcatagcatacccatactctgaattcataactgaaataataaccttactttaaattttacattttctgctgaattctctttatgctagttgcatatataatcttacaggacatatttataaagacagcttaaaatagaccagacacttaagaacgtataggaaggtaatttgaatgttacagatttttcaatatgggagattttatcagtttcatcataataacaatagtgcattcaaattctttcatgtatgtaccacatcttattcttttatcactccttcagacacatgaggttatatactgatctccacatgaggaaaatgaggcaggggactgttgtttggttccacttctgtgtgctttccatctggatcgtacttatcaggatgacattctattattgcaaatctgtgctttaaatttattggattacaaagctttaaagatgtgtggatctgggtgctataacactgctcaaaatagctgcctgaatgaagagatatatgtactttaacattacacttttaaaagtgagtatatttcatgagatgaattgtctgtcttatgcgcaattataaatcatttctatttcataagactgtagagtgattttgaatacaaagcaatattggacaaatagcaaattatgttaaattgtagggcaaattgagaaagcgaagctgtgattttgagcaactgtgccttcatgatttaaaatgcaactttctwatgcagtatggaacaattcttatttcctctcaaacttctattataaatgcatttattctttttaattttagcttcacagataattctggtttggaattagggatctttttttgaggataggaagaaatttgcaaattatatttgagttttgatttattgtgataattgactaatttattatataayctgttataatctgaactatttaaaaataattttctgctttaaaatctctcacagggtctttcttaagacacyttcattcacctctggaaatagcagcagtagtttctaatctttggctagcagataatttctaaaatcatttttctttctccccgaattgtagtttgagtagcmcttgtctttcagagaaaatgaactttattcctattagaaaaactgttaaactaaaagatctgacaacaacattcttgaataagtttaaagaatttatggcttaaattaatctgaattctartttaccttttaccttgagcttggctgctgttttcaatttatatgcattttatacattaactgctaccctcaatytcctgtcaactttgtagtaagtgatactctgtcaaatgctactctatgatgcatttaaataaagataaaaggtcaatctaggcttttctaaagttaccattctaggatataagcttctgaattgctttgtatttgtatcattagacgtaatttctgacatttaaaaatttaccaaaaatgtaatgaattcaaggtagtcattatatgtctatggattctttaagcatgttaaagactttatgtatctttaaccataaaaaacataatattgctaaataaaattattctgtgtatctctaggcagtctagaactcatattctagaattctagatcagcagtgaacaaagtgaggatgtctactcttaccccttctttttaatatatgttggaagttttagccagggcattaaggcagtaaatacatagacaaataaatagacagataggaaaggaagaagtaaaatatgtatttcttcatagtagatgtgatattatatatcaaatgattctaggaaatctgcaaaggtactaggattaataaatgactttagcaaggtcgcagaatacaaggccagtattcaaagatcaattatatgtctatactttaaaaacaaataaccagaaacagaaatttaaaagccagtatcacttacaataccaaaaaaaaaaaaaaaatgaaatacttagaggtaaatttaacaaacattttttaagacctatatactgaaaaccatagtatattattgagagaaagtaaaaatctgaatgaatatagagatacaccatgttcagggatcagataagtcaattttgctaagatgtcagttctccacaaattaatttagaattcaaagcaattctaaattaaacccaatgggctttattttagaaattgacaagctgattttaaaatttatatggaattgcagaggaaaaacaattgatacagagttagaaaactcacaccacctaaatatttattatatagtaatcagagaagtgtgttattagcatatgatgttgaaacaattcattatccatttagaaatacaaaaggaaactccacccttaccacacatcatacatggaaatcaatttacaagatatcatagacctaatataaaagcaaaacataaacactttaaggagaaaaataggagaaaatcttagcaatcttaaatcaggcagaggctttttagataggaagcaaaagccatcagtttttttttttttttcttgagacagggtcttgctttgtcacccagtctggagggcattggtgcaatcatggctcactgcagccttgacctcctggggtcaagcagtctccccacttcagcctctcaagtagctaaaactacaggtgcatgccaccacacctggcttttttttttttttttaagggacgggtctcattgtgttacttaggctgatcttgaactcytgggctcaaacattcttcccaccttggcctcccgaagtgctggggttacaggcatgagccaccgtgtccagcatgaatatttataacaaagtgataaattagacttccttgagagatacaatttaaaaaatgaaaaagcaagccacagactaggacgagttaataaataaattaaatgcataaacacctacatgtatattgtgtatgtttgtatatgtatattgaacatacatggacaaggatatgtgtcaagaatatataaagggccaggtgcagtggctcatgcctgtaatcccagcactttggggggccaaagtgagaggatcacttgaggccaagagttcaagaacagcctgggcaaaacaatgagatgtcatctctacraaaaattataaaatgagctttgccaggcatggggcacatgcttgttagctactcagaaggctgaggcaggagaattgcttgagcccaggagttctaggatacaatgagctgtgatcatgccactgcactccagcatgggtgacagagcaagactctgttttaaaaataaaatacacacatacgtgtgtgtgtgtgtgtgtgtgtgtatgtgtatttttgtctataaagaacaattataactcaataatagaaagacaacccaattttcagtaatgggtaaaacagttgaaaagatrtttcactgcagaagatatgtgaatggtcagtaagtgcatgaaaagataatatcatcagtcatcagggcaatggaaattaaaaacattatgaaataccacaagatacctactagaatggccaaaatttttaaagacagtactaagtgttgatgaggatgcaaagcaactacagcttttatgcattgctagtgggaatatgaaatgatactattacttygaaaaacaatttgacaatttctttataagttaattatacatttaccatatgacttatcaattccattatttgtctaaaggaaatgaaaacttatgttcacataaagacttgttcacaaatgtttatagtaactttctttataatatcaacccaaatgcctatcagtagaaaaatagataatccaaatgtggtatattgaatacaatggaaaactatttagtgataaaaaagagcaaataactgatacttacagcaacatggataaacctccaaatcattgtggtgagcaaaacaagctagatactctaaaattccatttttatagaattctagaaaagattaatataggcccaggatgaagatgacttactggaaaggattataaggaaatagtttgggttgatggaaatgttctgtatcttcattggtgtggtaattacrcgtttacatatgtatcacagttattgaactgtacatttaaaattcatgtattttattgtgtgtaaattgtacctgaataaagatgaaaaaggtagtatttataaattctattaataattgatttccaaaggaaaataacacaaaagataagtgaacacttaaagataatttcaaagtaaatcttgcttgaaactatataaaagtatttattaaaaggcaattaattactaacatccaagtgtgaaaattttgacctttagtgtattgtgcagaaaaattgtggtatatttcatttaaaattgatcaaagacagcaacatacattaatcagaggaaagcatcaattaaatgtagaaacaagatttaaacaaagattcatattaaaataatgataagtaatacttagaaactgcatcctagagacacattattcgtatttttagaaaaacagaaacatattagtgtgaaaagatgttaaaaaatgaatattaaattgttgagcacaacacattatgttggcaacaatataccataagtgactgtagcttgcaataaggaaatatcttacttgtttttctctttaggctttttttataggcattaataacaaatatttcctttcctcccttatttattgaaycacaccccttctcatactatctttccccccaaaggaagtgaattaattcactacctcttgttattacagtttttcattttaaaaacaaraaacacttaagttttccttttctcttatttcaaagttatatatttagccacctgagttatgctatgcgtcaaaatgtttgttgttgttgttgttgttggtttgagacagagtctctgtcacccaggctggagtgcagtggcgcggtcttggctcactgcaacctccgcctctcggattcaaacgattctcctgcctcagcctccagagtagctgggactacaggtgcgcgccaccacgcccggctawtttttgtatttttagtagagacgggattttgccttcttggccaggctgctctcgaactccggrcctcaggtgatccacccacctttgcctcccaaagtgttgggattataggcttgagccactgagcccagccctcaaaatgtttttgaagtaatttttgttatagttacacaaatgcttctttagttcaatggtacaggaaattatgagcttgcttctattttgtatggcatcaaaaatgtgtaaagtactgcagaatgggttacgtatattacatcttctcttaaaatgataatttttatggtcctttacttttttcccccttcttttcctttatgagctgtgtccctaaaaatcactttaattgcacatctaagctttcttctcacccaagaaaaccattttgaagtacgtaggtgatattactttcttgaggcttgatggaccctgctgagatcaaacctgtttacttttcttaaaactcctttttgttggagagtcttaaatattagtctttgttaacctttccacagatttgttattgggcgggaaaaaccaggacaagtgagcgaggttgcccagttgataagccagacactggaacaggagaggcgccagagagagctgctggaacagcactatgcccagtatgatgccgacgatgacgaggtcagtagtgcttgcaaagattctttttcccacattttctaattcatgaaactctctctactgtataacagtatgacaggttttatgcagtttcttgaggaaggtgtgtccacattgaactaaaattctaccttagaaaagaaatactactcgcatctgatatacgcttaagaatcaagtcatggtatcctgtttacagtatgaagactgtggacacaaataagtcttatcttttgcactattataaaggaagtcatagaaacagaaaaggataaaaacacaaaaatgtgaataatgtcatctttattggtggaattgggtgattttctctctctgctttatattttttcaatcttttccaaatgttctacaatagtatgtaatgcttttccaaaaaatcagtaaacacacccatacacaaacaaatatacatagaaaagtactaaagattgctgagtgtttccagtgtctttttcccccaggaagaaaaagttctttggatctgcttactatgatttgtgctaacataatgcagaacaaagctttccactagcacatgttccatagagcagatacatattggaataattttacatcctgctttctgtaaaagatcaagtaaatgaatagaagctaacccccaagtgaaaacagctctccagaacccttgtgtgctgtaatataatacagatgctggtctatttctaatgtctttgaaatgtacattgatataatgggacaacatgctttattataaacacgtttaaacattcatrtgtttcatattggtgtgtcaaaagatccatcaacaatttaattgtagtattttatactccataaactagtacatattcaggtaaaacaaatattcttcattccagctaatataaccacagtgaaacttcatgtattcaaccccttcttatctgaatatataatttttcagaattttgctttctagccaggatatagatattaataaacagacattcaaatattttcacatatttttaatctgagatgttttaatcccaatgtatattaagatctcatgaatatgtggtataatgaggatatattctccacttatagcagaaaattagaggtggtatatccgttaacttttgatcaaagaataatatattagaaatcctttaaatgaatgaattagactcttagaacttgatttaatttattttcttacttggtgagtccatttgaaatggcaagtatattttcattacactgagatattttgtatgaaaaatgttctcttgaattttcaaactaaaaaagggatttcctcaaatattttgaacttgtatcttacctggttttcaattctttacattagtattttgtattttatcagagacactgatttgcttttgctgcaagcttattctgagattgtagaatcattttctgcaggtttgatttttgcgtcctcactgtgctaggatttttggtcttaggttcaggggagtacagtgacatcaagtggtggaaggggacatggccaggctttctagtctgtgtgccttggtgtctttggcatgaaagcacagggattgggytagatcacaaaattccttccagcttctaatgttccatgaatatgaaataagacatcaagtctaacaagcagagggggcaaagaaagaagatagtcacatttttaaggcactccaagtaaaacatttagatcacagaccacacattttctgcaggtattttgaggcgctgatcacattcatccccaaaagttgatataaaattttgctctttttttttttttacgacacagggtcttgctctgccacccaggctggagtgcagtggtgcaagcatagctcactatatccttgagctcctgggctcaagccaacctcctgccttgcctcagcctcctgagtagctggggcaacargcacacagaaccacatcctgctaattaaaaaaaaaaaaattttttttttatagatgaggtctcactatgttgtccaggcctgtcttgaactcctggcctcaagcagtcctcctgcctcagccttccaaagtgctgggattacaggtgtgagccaccctacctggcccagatttttctttaacttgataattggaatagatggaaaaagaatagtttttacttgacatttatacttaggaatgtatcacatcttaaatggaagattgtttatagattttttttgtttgcctgtttttgtaaagtaatcagagttgtcacctgagcagatattttcaggggcaaggaaattaagtaaatattcagtggcaagcactttgcaaggtgtctttcttacatgatctcatttaatctttaatgcagccagaagagattttctttttttccctagaaatgcagcaactgaggtttttttctagtggtacatccagtagctggcagagttgaaattggaataaagtcttgctggctccaaagcctggactctttgcaacacactgtgctgtttttgagtagcatgtaagaacactcctgcagacacagaataactgggtaacaaaagatgttaagagaattactgtttgcggtgatggagtttaggttctatgattctttgttctgtatttctaataatagggaaatcaagtctttggataattattttctctatgcaacagtccataagaatcatctttatagagtttaaagagaagaataattgagtactcaaattttttttaattagtttagctttaagttaaactgtttttctttctgcaagttgtagaagtaaaaacgaggtgcttgctatgttactccaagtaactcactttatggaaaaaagtcaaggagacttctcctttgtatctgtctctcatcctctgtgacttgggttttttccctttcttgtatgttacacactgcctcaacaaaacatgcccagataaaaccaactgttaattttcagtgcataggagagatgaaagctgtacaaatagtgaaaatccactccaatgttaaaacttcaaattgtcacttgattcaaattcttttttctaatgctgaaaaaattattaaatggattgatttgagtgctttttccctattttctatttactctctgtctttctttgtgaatgaagaataaaatgtccaagaggcataaaggaaatgagaagaacaaatattggatagctaatggataaatgctccttgaataattgagttaatttcatatataattgaacaatttattgattartatatctttgttaatcagtcacttggtttttttacttttatgatttatagaatcatcttgtgatttcaaagttagagttatttttatttgacagtatctcctgtgacattccctgcaccagccaggaaaacctccatttagatacagaacaaccaagttcatccaactgatttccagagccagctcttagtcagcattttctgctgaaggatagatagcttctgtttttgatcaaatcatccaaagttgattgtaacttggaacttgtcacattgacagagggtatttgcttgcttgcattcactacatggaaaacatcacaatgggagaaatagatcctgaaattataaacctacagtggagctctaaaaactatattgagaaagattamcttacaatatattgcttatgcttagacatatctgtttcaatgctttaggaaattataagtcatactctagtagaatttaagctatgtagataattttcaaactatttaaatttctgctttttctgtttttttcttcctctacatctttagaagggtttaaaataagcaaacagccaattttattttaatttgcatccctgtttttgtttactctctgttaaacattctgattaaaaaaaaatgttaaaatggctctgcctaaaagctgtagaataaaaaggaggatcctatttaagaagagggagatgaatatttgaacaattgaaaaattttaaatgtatatctgaatatatctgtgattcatgatttaatttctgtttaatcgaagtattgatcacttgtttttttttttctttctttctcttttcttttttttaataatctgaaaggttgccatggaggatttcaataaatctctcagacaatcagcactatttcatgacactcggggggtatgataaatttttcaactagaatttaactttttagtaacatttaatctcttgtcatactccaccactatcagtttgtagccttttagtagtgagatgatgtaattatggtatatattttgtgtagtgtgtatatattatgagtattttttatttaagagcattatgccgtttgaaatgctgcaggcttagactggaaatacagtatgaactagtgctatattccatttttgagttagaaaataggtatggtcattgaaattaaaataaagtattacactttaaaaattatgattatttggcttccttaaatattcttttaagatatagtatttgttacattgtaaagtcttagctatagatagcatttcaaagtctccttaggcagtagttcataagaaggttaatcatcactccagaaactgaagccccttctatactgaagcccctaaaatataatttaatctttctttcataatttgttttcattactggaaattaatatcattataacaatattatagcaactttttttttagaatcttttaaagtattgaatacagtttagagtagctgccctcatgggtatggttttttattgcttgtgttagcatgtcataattagaggcaaaaatataatggaagctttggtttgcrtaagtattaaaaggtatacaataatataatatttatgttataaaaagtgttagagggataacattaagtttgactcatactgtttgccattcctagttggaaacagcttgtgtgtgtaaacaagagaatgcaattattatggttggccttttaataatgtgaatataataatgtaaatagactttatactgtatctataatactgagaaaccaagagtgtgggcattttttaccaacatgccgcaatattgtcttagtacttaacagtgtgtattacagtaagcactgggactcagtgtttttcaatcctttatcaggctgctctctgcggtgggggttaagccttctttaatattttttgtcaaccattttagaacactgtggctgaattgcaaggaatgtctggcaactgcaataacaataacaactattttcttaaggtttgttttttggtttaaagtaatgcttacctgtactttcctgcttcatatgtaaaattaaatattctttgtgtcttattaactatctgtatgttctgaagaacttctctagagtgatgtgttttgtgcattgaataatagtttgaaaataatcattcaaaaaacaattctgaaacatagcatatattttaggtataggttctgcaatttagactcatttcttaatatttagccatggatatttttaacccctaacactttaaatatcttgtgattcaaattaaagggaaaaagcaaatgtccaacagcaggtctgtatgatgtttacacagtaataatgcacatagtgatttatactgtctgtaaatccagtacttttttagaaaataatcttttgatacaaaattcttgatttctcaaaacactaaatatatctttaaattatrgtagtatttagttgcatgatttatatggtagacatatcaaaatatctaaaatatcaaaatatctaaaatgatactatactttaaataataaaataattctcgttatgtttagttgctgttaatatagatagcagtgcttaaaaatggaggttgagtgtatgtaaaaggcaggctgatttatggcaattagaggaaactgaagaataaaggaaatatatttaacagcctgttcacagactccaatttggtctaatctctaaaatcattaaatttaattatatcctttgttttatgatccccaaatctatagcaacagtcattgtcaccaaagccaagaatcacaaggtgcttggaaaacattccgtttaagaccctatccatatgtgcactggcctaagtagtgtatacacatgcttaacacacacacacaccacacacacaccacactcacaccacacatacccatgcacacacaccacacatatccacacacacaccacacacacaccacacatacccacacacaccacacacacacaccacactcacaccacacatacccacacacacccaccacacatacccacaaacaccacacacacacaccacacacacaccacacatgcccacacacacatsacacacaccacacataccctyacaaccacacacacaccacacacacgacaaacaccaccctcacacaccacacacaccacaaatacatacacacctcacgcccccacaccatacacacaccacatacccacacacgacacgcacacaccacacatacccacacacaccacagacgcacacaccatacacaccacacacacgccacacacacacacactcactctgatcccacggggtagacatcctcctgtacttgaaagattctctctagaaatattcttcatatatggagatgttattttttaatacactgtgtacagacagaaagatgggtaaaggggagatacaggttaggataggaaccttcatctaaacaatgtcatctttttgcagatcattttctttgatttaaaaaaattatgatgcaaatgatttgaatatattttccttcccactgccacattgtgatattatttactcatgagctagatacgaaataccaaataaactttatcaaattcttccatgtaattaaatttctctgaaagtgtagactttgtactccctagaaacaatgctagaacaattcaatattacaatgatgaaacacagagtttgcagtgttaaagagatgtcatagaaactaccacaaatgacagtatttttctgactttaaaaacatatattttattagttgaataatttaccaaaacattctaaaatgctaaaagacatagtgagagacggatgcctgggaaacagacttactttcccaggggccatcgggatcccctggattttctatgccttttgtttcctataccttttatggtgtctagtacactgactctgttgcccttgtatgtcagcttaatcctgtgcacctttcagggttccatttaagtttcatctccttcacaaagcattgctgggctagtggtcttttaaaagtgtgtcagtagcactgtgtgtatctctttctgtcattatttatccataaattccccccattagcctgtaatctcttcaatgacaggtttcaatgggcttttgcttgctacarcattttaattgtcttgagagtccatgaatttgcaagaagaccctatctctatcacactaaaccacaatcttcttcatgtaaaaccagaaaaaaaaacaaacgtgcatattttagcccttgaaaacctttgggaatatcaaaatagcaacttggtgactcacagtaacatgccttctttttagtcataactgaataaacctgcagttgaaacagaatagtcaaaatggcctaaattacartactgcatatatgtccttatctccttcccaatgtattcacttagaaatagccttaaatcatagaaacatattttctatcacagaaacacatttccatttgcaataaaaactgaatggtgatgtggccaaggactgagatggtaaagctgctttatcatggagttttgccaggcttgataaaagatgttaaaaactctaattgatttctgaagtttcagttcctaaagggatttttttaatggatttattgagataaatttgacatagagtgaaatgcacagatcttaaagatataattttatatattatcattacatagctccatttaaatattaactttaatgagtaataatttacatacaataaatgcactaattttaagtgtatttaagttaatggtttgatgagtaaccaccaccataatcaagatacaagacatttttattacctcaaatagttaccttagggaactttgtagtcactctcagcctgagacaactattcagtctgctttttgaaactataagttaatttctccaattctagaatgtaattagaataaaagcacaacatacttaattctagaatataattacaataaaagcagaacatacttttcttgaactgcttctttcactcatcataatgtcataattatcgttaatgcttaaatgttatgatgatactgtaattggtattgctttgagttatagtagacaaaacccagggtccacctgatatgggatgcctaattaggaaacttcatcataaagctggaaccccatggactacacctttctgtaaggtgaaaataaatctatcaccccagggactgcatggaaaattgccagtgtcaaaccttgggtgctgagtggaaaagccaaaaaaattttttctaacaaattatgatcacaagtagccttaatttatgttacttttcagaagaaaaaaaaaagcatatctttccttgggcgttcatctttactcaaagaaaaaaagttaaagtttcgagaaatatgagttgacggtttcaaggtacaaagttcgcaggaaaataaagcaccatgagtaaaaaacagcagaaaatagaagaaagggagggaggaaragaaaaaaaagagaagaaagaaaataaatataaggtcaaaatcattttattatcaattataccaaactagaacaaatatctccaattgcatataacttattccagaagacagaaaaacaaaagtagtacaactttgataccaggaatgcagtaaaactttgacagtgtgagatgtatgaagtaataaaacataactttggtaccaaaagctaacaatgatgagaaagaaaacttataggtccatcccattcataaaaacaatgcaaaaaggtcctaaacaaaatattagcaaaccatatgaagcaacatataaaagagataatatatcatagctasgttgggtttagccaggaatgcaagtatggtttaacattggaaaatctgtcactttttatatttgacaytgtactggaaggcaagtaaaagaaattaaagaaataaattgtaaagaaatgaaactgttattcacatatgatgagattgtctatttaaaaaatctcaaaaagtacctatagataagttattagaaataatataaagttatagcaactttgctgaatacataattaatgtaaaataaaacatctatttcaatatgtctgcaaaccaggagaaaacataatttataagttaccatttacaagacttcaagacataaatgatagggaagagcttcatagagaaaaacaaaattgtattgagatataccaaagaaagtgtataaaataggacaaagaaaccttgttcatggattggaagattcagtaactgttgatttggtgcaattctagtaaaaataatttcaaaagatttttaaatggaatttgataagctattgctaaaatatacatgaaagggcaatacatgagaaataaccatggcatttcacatgctttaaaatggaaataattattattaaactttaataaatttatactttggggcaaaagaatgggcaagttggtcagggagcccagaaacagcactgtagatatacagaaacctgatttatgacatagattacactctagaagagttgagaaatgtttggctcttcaataaagagaatatagtgaagttgagcccccatataatccatacccaaaattccatctcaagtggactgactacgtaaatgtgaaaagcaaaaatataaaatttggaagatagcatagaagaatgcctttatgacctcagtttttagcaatgtttcttacagctgggtgtggtggcttatgcctgtaatcccaggactttgggaggctgaggcaggtggatcacgaggtcaggagattgagaccatcctggctaacacrgtgaaatcccgtctttactaaaaatgcaaaaaattagccgggcatggtggtgggtgcctgtagtcccagctacttgggaggctgaggcaggagaatggcatgaacctgggaggcagagcttgcagtgagccgagatcacaccacggcactccatcctgggccacagagcgagactctgtctcaaaaaaaaaataaataaataaaaataaatgtttcctaaatgagccactaagaaaactgactacattaaaacttaacttctgttcatcgaaagaatacttttaagacagtgaaaagataaaccatacgctggagtaaaatgtttaaaaaatacacacaatattattccatttatataaagcataaaatcatgtcaaaatgacacatagtttggatataaaaatatagcaaaactaaaaaaaaaaaaaaaaaaaaaaaactctgataaaattcagcagaattactccagaagagtaagcaactgaaatggaatcaaggaggcacacacagaggacttcaatgaaaatgagtggttctgttccttttccttaaataagttgttagtttattggtggtggttatataattattcattatgttttaaatttatttattgaataggctttatgtcaactcagtatttaatataatttaaaatctgctgtgtataatgtactttgcagttatgtgattatgtggatataaaatgaatatgacatagttcctgctctctgaggacttacaaaatggcttaaaactctgtgtcttcaacttgcttcagtatgagaatatcatggtacttctttaaaagtacagatttacccacccagcctcagacctaccaaatctgaatatggcttgcaagggtgtcacctgcgggtgtttgtgggaagcggttacatgcaatcagtattggagtggtccagtgtaaagatgccaggaatcttgcagtaaagatctttgagtcctggtattgcaagcactttgcaagaaggaatggctgccacaaaccacaagtcagccatgtgaggaaaggactagaattattctccctagaaggagattgtaagattgagactatgtttatcattaatctatgtaataccataatccatgtaataccaccaatgacatttgtgttggttttacttttttttgtactttaaattctgtaactgtaatttctggttctatctgatgatctgatagcatttttgcaattacacgaatcaatttttatataaacaccatatttttcaacattcaattacttgtacaattatagaattactaaaataatgataacatgtctcttcagtcactcatagctgccctcttctatagaggaaaattcagggaaatacaaatctcttagtttcttcccacagttctactggcatcagaataagtacttcattgttctcttggcaagtaaaatgaaactcaaggaagactgccagtttgaatttgcagtgtgacatttgaattatagaggtccactttggtctgtcgaccgtttagttcaggatctcagtgggaaaaaagatcactggttcccttctcatatagaatatatttatcagggacttaaakacaatagcatttctctctttataagtaggtaaatgtattaaatggaattgaattaagaatattaagacatggtgaatatattttatgctcacaagcagcttattttgctgtggaaacagtaaatatgtatgrtaaaaaatttaaatccttttcaaggcaacctgtcaaaagatccaataacgatagtgtaaaagaatcatcacaattttaaggcataaaaaataaaaattaatttgatatttctggtttctatttttatttgaaaggatatttttgttgtttttgtttattttctgtagcacaagcagctgtggcaatgaagggtgtgttcaaaaaaawttttttttttttgagacagagtcttgctctgtcgctcaggctggagtgcagtggcatgatctcagctcactgcaacctccgcctccccggttcaagcgattctcctgcctcagcctcctcactagctgggactacaggcacatgccaccatttgacccagcaatccaattgctgggtatatacccaaaggattataaatcattctactgtaaagacacatgcacacgtatgtttattgcagcactattcacaatagcaaagacttggaaccaacccaaatgcccaccaatgatagactggataaagaaaatgtggcacatatacaccatgcagtactatgcagtcataaaaaaggatgagttaatgtcctttgcaaggacatggttgaagctggaaaccatcattcttagcaaattaacacaggaacagaaaaccaaacaccgcatgttctcactcataagtgtgagtggatcaatgagaacacacggacacagggaggagaatatcacacactggggcccgtcagagggtggagggctaggggagggatagcattaggagaaatacctaatgtagatgaccggttgatgggtgcagcaaaccaccatggcacatgcatacctatgtaacaaacctgcatgttctgcacatgtatcccagaacttaaagtataaaaaaaaaaaacattaaaaataataataaaaagaaattgaatgtctgacccatggacagacaatacctttggcctgatactctcagtttgagatgggtcaacttgaactcatgaccaacaggattggaagggttcaacaaacattgtttgtcaaatagaaatgacagattccagaaagctgccaacctggctacaagtggtagccttctgtttgattaaaactttgtctctctgcctcctgaaacagggagtttggcttgatgatgtcttcaattcataggttttctttaaatccctggtattggttcactgatagttctgccaagttgttcaatgttgtcttctggtttttcaatctcagcactagttatgcagacaccagaatggacatggccactctgctcaataggcagcactcaagcccatttatatcactggccaatactccccttgatgaarcatgttatatttttactaactctgggtctattacgactgacttgttgggtctgtcactcctaaaattacagactgacatataaaagtttgggatagatagggttaggagtggtggctcacacctggaatttcaatactttgggaggttgaggtgggagaataacttgaggccaggagttcaagaccagcctggacaacatagcaagacgtgtctctaaaaaaataattttgtaaaagcccggcatggcattgctgcatgcctatagtcccaactgcatgggaagctgaggtgggaagatcacttgagcccaggagtttgaagctgcagtgagctatgattgtgccattacattccagcctgggtgacagaatgagtccctgtctctaatcaatcaattaaaaaaaagtttgggatggcaaacagtggaagcaaattgtggcaactggtcacattctttgaactgcttatgtagctgcaccttagaggaatttttatatatttaaatgtatttaaagaaaggcttttaaaaatagaatcagaatctgcagtttaataggatctccaggtgattcttttaaaaatatttttattgatgcataagatatacatcatttcagggtacatgtgacaatttaatatattcatttaatttgtaaagatcaaatccgtttacttgggatatccatcaccaaagaaagacctttgtaagaagtcttttcttaaaaataaagaaaaaatgaaatcttttctttaggatattttaaagaattttaaaatatatatatgtatttaaagaaagaccaccattagatcatgtagccttcagatgattatagagatccctccaaaatgaggctactcttagttactaaagggagctttcctgagggataactaatttattatttgtatgagccctacaggcaattgtccttatgattaaagtcatttaatcagataagatcttatgaaaatggttcctgattttaggtaatgtggttattggtaccacctcagtcctggaaggcagtcakgtyagcctcaaccttttggccagggtttttctggacagtagaattgctctaacccctagacttcctccttgtatgccaaggtttgagtctatgtaattattgatcctgctgtacctggttcaataccttaggccaagtggaaaggtcaatacagaagcttaaggagaaagtcctgggtttctaaggtatatcctgatggtttatgggatttctttaaccagttgggtctgggagcctagagaatatagttgttatcaatgccgaaagttagactaattctgctgcttggaatcctattgatagtagtattaatcatatgctctgagatagactgaatggctttggtcctagccactcttggttacattgatcagtgtggccaagggaatgccatactcggagaaaattcacctcaagccaagactgtgtagaaatgagggtggacgttgtttggagacaattcctccatgggttctcccttctctgcttgttttttgagcagcagcagcaccagcagcctatgtttcagattatctttccaatgatgttggtatcattgggagacagtatgtccctttaggcagtgacaggtttgtttatcactcattattcaaaaatttgaatttcctaagggcagaattcttaagattttattggttgtactatctttctttctctttctttttttttttttttttggagacagagttttgctctgttgcctagactacagcacattgatgcaatcttggctgactgcaatctctgccttacgggttcaagcgtttctcatgcctcagcctcccaagtagctgggattacaggccagtgccaccattcccagctaattttgtattttgttttagtagaaacaaggtttcaccatgttggccaggctggtctcaaactcctgacctcaagtgatccacccacctcagccttccaaagtgttgggattacaggtgtgagcctccacgcccagcctggttatacattctgcttcatttttaaaccgcattcttctggcagttccatggatttgaactctgtttggaagccatttcttaactgtagacttaattttaagactttgaaaaccatcaagtttctgtttaaacagaaagaattcctttctgtttaatagtactctcarctgaactctattctttttacattttactacaagcagcaagaagaaatcaggctgcaccttcaccactgtgtttagaagtctacttagccagatcaccctgttcacaaggaacacttcctactttctcgttagagaaggtgataatgttgctaagctttgtgtcactacataataagcacgctcccttccagtttccactcacaatctgtgcagtgcaatttagtcttgctccaatacactcttcrgaatcctagccttcgcccactgcctgtttccaagccacttccctgtttttttctgtatttgttttggcagcatccctcttcaatttgctgcattacaaactaccaccaaaacttagcaacttaaaagaagaaatatttgtacattaccgtgtctgtgggtcaatttagctggatgcctctgactcagaatctctcccaaggctgtaagtgaggtgttagccagagccgtggtcatccaaatgctccactgggagaggatctgcgtccatgctcactcacagctgttggcaggactgagaagacccacttccaggctccctcatgtgacctggcaggcctcaggtcctcactggctgttggccagaaacatcagctccttgggatgtgggcctctccctgctcataagatggcaacttgcttcccaatagtgagggctgagagagagagagcaagaggacaaaagaggcacaaatcacagtctttttttttcaactaatctgagaagtggcattccattacttttgttgtattctggttgttggaaatctgtcattcagccctcactcagtgggaagggattatacaagggcatgaacacccagaaagcaaggtcattggggtcattttggagtctgcctcctatagtaggaaatagagtcccagcttctggagtatactttctaaaaggaaggggataaaaactaaagaatggatttgagttgtcggaaaatattttattggcaaataatgatttttttggtcaaaattttaggaagaataatttttcagcaatattaccaatgacctgacaaggtgagagcctgaaggtaaggaacacagacgccatatgagtaatctagagaaggattttagatgtttcttgagtgggtgactagacaatgagaatggagtgaaaaatcaggaaatattctttttttttaatatatataaactttaagttctagggtacatgtgcacaatgtgcaggtttgttacatatgtatacatgtgccatgttggtatgctgcacccattaactcgtcatttatattgggtatatctcctaatgctttccctcccccctccccccacccacaacaggccccggtgtgtgatgttccccttcctgtgtccaagtgttctcattgttcaattcccacctatgaatgagaacatgcggtgtttgttttttttgttcttgcaacagtttactgagaatgatggtttccagcttcatccatgtcccaacaaaggacatgagctcatccttttttatggctgcatagtattccatggtgtatatgtgccacattttcttaatccactctatcattgttggacatttgggttggttccaagtccttgctattgtgaatagtgccacaataaacatacgtgtgcatgtgtctttatagcagcatgatttataatcctttgggtatatacccagtaatgggattgctgggtcaaatggtatttctagttctagatccttgaggaatcgccacactgtcttccacaatggttgaactagtttacagtcccaccaacagtgtaaaagtgttcctatttctccacatcctctccagcaccttttgtttcctgactttttaatgatcgccattctaactggcatgagatggtatctcattgtggttttgatttgcatttctctgatggccagtgatgatgagcattttttcatatgtctgttggctgcataaatgtctacttttgagaagtgtatgttcatatccttcgcccactttttgatggggttgtttgtttttttcttgtaaatttgtttcagttctttgtagattctggatattagccctttgtcagatgagtagattgcaaaaattttctcccattctgtaggttgcctgttcactctgatggtagtttcttttgctgtgaagaagccctttaatttaattagatcccatttgtcaattttggcttttgttgccattgcttttggtgtattagacatgaagtccttgcccatgcctatgttctgaatggtattgcctaggttttcctctagggtttttatggttttaggtctaacatttaagtctttaatccatcttgaatkaatttttgtataaggtataaggaarggatccagtttcagctttctacatatggctagccagttttccatttattaaatagggaatcctttccccattgcttgtttttgtcaggtttatcaaagatcagatggttgtagatgtgtggtattatttctgagggctctgttctgttccattggtctatatgtctgttttggcaccagtaccatgctgttttggttactgtagccttgtagtatagtttgaagtcaggtagcatgatgcctccagctttcttcttttggcttaggattgtcttggcaatgcaggctcttttttggttccgtatgaactttagagtagttttttccagttctgtgaagaaagtcattgatagcttgatggggatggcattgaatctataaattaccttgggcagtatggccattttcacgatattgattctacctatccatgagcatggaatgttcttccatttgtttgtatcctcttttatttcgttgagcagtggtttgtagttctccttggggaggtccttcacatcccttgtaagttgggattcctaggtattttattctctttgaaccaattgtgaaagggagttcactcatgatttggctctctgtttgtctgttattggtgtataagaatgcttgtgatttttgcacattggttttgtatcctgagactttgctgaagttgtttatcagcttaaggagattttgggctgagacgatggggttttctaaatatacaataatgtcatctgcaaacagggacaatttgacttcctcttttcctcattgaataccctttatttctttctcctgcctgattgccctggccagaacttccaacactatgttgaataggagtggtgagagagggcatccctgtcttgtgccagttttcaaagggaaggcttccagwtttgggccattcagtatgatattggctgtgggtttgtcataaatagctcttattattttgagatatgtcccaacaatacctaattcattgagagtttttagcatgaagcgctgttgaattttgtcaaaggccttttctgcatctattgagataatcatgtggtttttgtctttggttctgtttacatgctggattacgtttattgatttgcgtgtgaggaaccagccttgcatcccagtgatgaagcccacttgatcatggtggataagctttttgatgtgctgctggatttggtttgccaatattttattgaggatattcacatcaatgttcatcagggatattggtctaaaattctctttttttttgttgtgtctctgccaggctttggcatcaggatgatgctggcctcataaaatgagttagggaggattccctctttttctattgattggaatagtttcagaaggaatggtaccagctcctccttgtacctctggtagaattcagctgtgaatccgtctggtcctggactttttttggttggtaggctcttaattattgcctcaatttcagagcctgttattggtatattcagrgattcaacttcttcctggtttagtcttaggagagtgtatgtgtctgggaatttatccatttcttctagawtttctagtttatttgcgtagatgtgtttatagtattctgtgatggtagtttgtatttctgtgggatcagtggtgatatcccctttatcatttctaattgcatctatttgattcttctctcttttgttattagtcttgctatcagtctatcaattttgttgatcttttcaaacaaccagctcctggattcacggattttttgaagggttttttgtgtctctatctccttcagttccactctgatcttastgatttcttgtcttctgctagcttttgaatgtgtttgctcttgcttctctagttcttttaattgtgatgttagrgtgtcaattttctatctttcctgctttctcttgtgggcatttagtgctataaatttccttctacacactgcaaatgtgtcccagagattctggtatgtagtgtctttgttctcattggtttcaaagaacatcattatttctgccttcacttccttacgtacccagtagtcattcaggagcagcttgttcagtttccatgtagttgagcgattttgagtgagtttcttaatcctgagtgctagtttgattgcagtgtggtctgagagacagtttgttataatttctgttcttttccatttgctcaggagggctttacttccaactatgtggtcaattttggaataagtgcgatgtggtgctgagaagaatgtatattctgttgatttggggtggagagttctgtagatgtctattaggttctcttggtgcagagctgagttcaattcctggatatccttgttaactttctgtctcgttgatctgtctaatgttgacagtggggtgttaaagtctcccattattattgtgtgggagtctaagtctctttgtagatctctaaggacttgctttatgaatctgggtgctcctgtattgggtgcatatatatttaggatagttagctcttcttgttgaattgatccctttaccattatgtaatggccttctttgtctcttttgatctttgctggtttaaagtctgttttatcagagactaggattgcaacccctgcctttttttgttttccttttgcttagtggatcttcctccatccctttgttttgagcctatgtgtgtctctgcacatgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcttagcctcgatggtctttacaatttgtcatgcttttgcagtgggtggtactggttgttcctttccatgtttaatgcttccttcaggagctcttgtagggcaggtctggtggtgacagaatctctcagcatttgcttktctgtaaaggattttatttctccttcacttatgaagcttagtttggctggatatgaaattctgggtttaaaattcttttctttaagaatgctgaatattggcccccactctcttctggcttgtagagtttctgctgagagatccgctgttagtctggtgggttgccctttgtgggtaacccgatgtttctctctggctgcccttaacattttttccttcatttcaactttggtgaatttgacaattatgtgtcttggagttgctcttctcaaggagtatctttgtggmgttctctgtatttcctgaatttgaatgttggcctgccttgctagattggggaagttttcctggataatatcctacagagtgttttccaacttggttccattctccctgtcactttcagataaaatcaggaaatattctgataacaaaagattgaaaagaaaattttgaatgagttgataagtgggagaaaaaaataaatatatatgctgggccaggcatcattttggatattttgcatatttcatttcttcgaatcctctcaatatcctatgagattggtatcttttacaccattttatagaagagaccacaaaagatacaaactaaatgacttacttactgttatgcaactgggacattaggatttttctctcttctggccctcatctctccaaccccaaatgctttttttgttgcattagtttatggtgttgtcctggagaaataagggatggtgaaaacmatcataatcataacgtcatgcagtcagttagcatattctaggcactgtggttaactctttcatatcactacaatgaattctcatagcaacctctttaaatgaagaaggtgctgttatttccattttatagatgaggaaacaacattcaaagagactaagtgtactaacattataaaattaggacacacaggagtcactgacaaaaaaatggaaagagagatgcttcggcagagagagggatgtttttgccgaaaggcctctggatggttggtgcagatttaggaattttaaacattaaaatgtgagtttgacgttttcctcctccagggaagaagcagctctcctttattctctcacagaagtgcgtctgaaaatacatagcaccaaattcaaatccggtaaacaaattccatcaaaaactgcataattaaggctatttttgtgattagcgccatttagtttccctgaatttaccagagcaaacattgctacagcaaaaattactgctaatggttgaacctaacaacaagagaaaatccccagaagggtcatttaggccccagctgcagctgtgtttcactatatttcatcctggaaagctgagattaacaggaaaatcaggctctactgtgctatgcagatgtggctacaactatctgaatttattcagcaaacatttgttcagtgcccactatatgccaagcaatgtactagccacaccgggattgcagggataaattgtacctggcactctctaggaatgttcagatgaaagaagttgatgagagaaggcagatatagaaacatcaaagcattatgagtgatgtcagctatacagtgggagcataaaggagtgaattaggagagtcttaagggcagcagcttcacaggatgttctcatgtacacggttattcatcttgaatccttggggcaggttggggccagtaaatgaggaggacagaggcatggaagttttcttgggcttgggtagaagctggtgcctaccccaamctgggaatataagtagaggaacaggtatatatagaggaaaggaaaagttttacttcagaaatgaccaatttgcttataaaagattcatgtgttgaggtcttctaggaacttacatttatgagaccaaagtttagcaaatgtggttacaagatacagatgagaaaatcgttagcattttgctattgcagtattttgacaccagcagcagcaacaatagcggtcactcgttttgagcacctaccatgtgccagmccttgtgttaaatacataggcaccatctaacttaatcttatgacagctttcttatgctaaggaactgttttgtccttactttatagatgaaaagattaaagcttagatatagacgctaattcccaatgtctcaggaccaggacttgaacacagttctacgtgacttcaaaaccaaaatcctttcattgatccccacttaaccaactccccaatataacagatactctctgttccttctgcaaaacctagactgatatctatagctctcatgagtgtcccaggctctagtatgtctacatacgtctcccactagtcaaaagttatatgtttaccaagagacacaacctgttggttgtacttgttactataattatgttattttataaaatattaagtgatgtaatatgtgtgtaaatgaagttgttgtatctatgaaaactaaatacagtgctttgggaagatttaataaagactggcagctcaagaaaattaggtatgagaaggaaatataaaagaggggaaaaccataaaattctatagaaattttgcattcattttgccttggaaggatctttttcatctgttttaaagatgctacagtaatttcatacactatatgttatggttgtagtttatacaagagtgcataaaatgtcagtcagcagacccataagccaagaggaagacttggccctgcaattaaaagatgagcaaataaatgaatacttctgtgatttaagttaacataaaatggtatgcatatgtgtgtgtgttcgtttgtttgtcagcgattcctctctgtattgcaattaacccacaagtactgctccsgattctttcaaaggggaattctatattcttgtccagggtaagcatattatgagagaagagaagaggacaagaactttggagcccactatacagaggtgcaagtcttcaaagtgaattcagtgataatgtttaaagccgtggaaggtgaatttcaatacaacaggattatccacccaggtttggggatgggatcattaaaaaatatattcccaatttttttttctgcagaactttagtttctgtagactggaagcatcatagcataaaagaaggagcatgggctttaaaatatgttgaatgcagcttcaacaacttaattaattgaccttaggtatggtctctgagtctcagtttcctcaaattaagatagtatggtaacacccatatcccatagttgttgaggaatgtccaatgctgggcacacagtaagttgcaaaagtattgctcttcattttttacccctttgtgtggggctactaaaaatatcatatattaatcagaaaggtaggtaaagacatgaaagggaaaatttactatctctgtcagttttttacccaaaaaactgttactgccacatttgaagtggatttgcgtgttaggacaaagaatttcaagagtctctggttacttgaaagatttttaatttgaacagaaatagagctagataccaatggaaatactttgttatagtaattttgggttttgttggttttgggtttttttggtacaacattgttcatcttcctttgtaaatggcagatttaatccaatctaattttgcggtttacaacattctgctgacacattccatgttacttattttatttgcagtgtaaccacaaaaataatttccattttcaataaagataaaatattagaagaacctatttttcttagtccactaagtgtaacttttttatttccaggtatttatgagattctgtagtaaatgtatcatcctaaagcctatttaaggttggaatggcaaatgatcagcaagagagagttataacataatgttttaaacatgccatccttagcctataataagtaataagtagaatcaagacagcaaaagacatatttgtcctcaggatgcttataaggctaattggagaaagaaggcattagtaaatgaaaagatgaaatgagtgataagaattttaacagtactgcaggtaatttgggtattgggaaggagaggatactggcaaagtccacaaaagaatcaagaagaacgcttaacaacgtatgtttattaagataattttcataatgaaagtrtatatggatgacaaagtgcagctaaaaggtaagaattgcatatgttatgcataccctaatcctgttattcacagtaaggttgttagtataatatactactgccttcttaacaagtgaccacagttcattttcttgatattgaaaatctccttaggaagttctgtctattaccaagttaatgcrttggcattcttggatttattcttttaaaaatatttgctgagatcctgttatatgtcaggtcccatcctaggcacatatttatattaattctctcacatgtagtgaacaagtatttattttcaagctagcaaaaggaaatcaaattgttcatttcaactcatgtttaaaacgtgccacattgttagggcttagtcatactttaaatttagcataagagtttcttgagtcattcaatgctgtatatagtgagttctatatacctggtttaagccttcataataaaggcttgggttttgctgccatttgtaatgatagggttaaaaacaagtacacagttttatacctctatatgaaaatttttcagcaaggtatcttgagattatttacttgccagtcttgctgcattcctattaattaacttcactggaatttaccaagtatttgttggttctagaaatgggtatgaacaggagatgaattgattcaagaatacaaaagaaaaaaaaaagccaaatctggaattagagttttttaagatttgtaggatctcattgtgctaataaataagtacaagctatctgaccaaccagctcccattcttcagctaccttcacctgccagtggcaaagacacttgaattggtatttatagtttagacattttcagactgatttctacagagatctagagttccaggtactcaggagatacataggatccaactggaggccaccaacctcttttcctttcagtcaaatcacctgtgattatatttggggaaagtaaaggttccaactaacctgtaaccagtttggaaaatcattgctccacatggaatattctgagcttacttctgtacacagatgccaccaatgtcaagttctccatgataatagcctctgtgtggggaggtagagtgtgaaggatgctgtggcagtgtgttcatcatggttgatgaccttcaaattccttactagaaactgtgtctactttcaggctctgcaatttagagaaatgtggaaaagttggagagaaatcagagcacaaccacaaagacaattacagcaaattaccttggaggcaactagaattattttatttgaaaaagagaaatctgaaggcaatttaataatggtctttcagacattgggaattattagattgggattaaggaccagatttccttcacgtgcaaacataggtggggggaaaggggaagtgaggggctcctgctttggcaggaagaatataatacagaatcaaaagaaaaaaaaacagcaatcagatgctgagcctatttactcaaaggaatagatcattcagtacaccgttcatggaagttttttaaaggcaatatgaattcctgtctctgttttatgtgttagataacgtgctacctgaaggaacagggatgagttcaatgaactttgtttttttaaccctgtcagtgatttatctttaaattatatcataaggtatagatttcaaacaattattttgaattacagtatcatagcttgatgctgccaggagaggatctactttctaataaagttaaggaagttagtggcaaagaggaatgtttattccaggggtcaggaactcagatacctacagggacaggtgggtattacaaaggagtgaagctaacaatatagaactatatgacattagaaaaattgtggggtattagaaagcatataactcttctaaaaggggcaaccactactaactggccaattgttatcatgtcccaatatgcctaatattaacggatgcttggctttctcaaggaaagctggaaatctagaactttatgtgaaacatttttctcacattgacagaatactcagatttgtaaatgtgctaggcaggcaaaacaatacacttggtgcaggctgcaagttagaaacctttggtttattctttagctcactagttcaccacaataattaacaagcaaacaaaacagaactgtttgaactctaacgcttaggagaattaatcagctaaacctttgcaaggcttaattaaggtcccttccaactctgtgattcattaaactccccttcccttttcattgctctcagtattgggtggcgtattcacaaagagaatttaaagaaatgacttatttccctcagcaacataattttatttggtaaaataatcaaatrctcagaaaaaacaactcttgtttctgtattaaagatgccactgayactagtagatttttagaaacgcacttgtatatggcataggtttgtcactttggatctttaaactaacatttgtttataacattggctgcatgaggcatgcttggctgaaaaacctacttacacttttaccatttgggtacatgtcttacttgtcttttataaaatattttcaaataactcacctccacctggggtaaggacagctggatttctgaaatccccttcctttcagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagaggtatgccactaagctgcaaaatatttctttatgcctgtccatttcattaagtatatatttctgttcaaataatatattaagaataatcagtttgcaaatcaaagctttttaataacaggttgtcttgagtctcattgaatttcaagtagaatttaagtagatctcgttccacggtcattgatttaaacgcttatttgtcatagtgacatacctgtagcccataatttcaagcagtaacttaaatgtgcagttttatgatgtttaagttatattttttcagttttacagaagttttggtaactagtgataagcttttctctcaaggcagagacttcctaaaaagtctctttttgtctttctgttcatgaaataggtttctaataagcatcagatggcatacccaaagggtttacttgaagagagtttaatwcacagactttgaacagagktaatagtactaacaaggggtggtgaagtgcacaggkactggcaacagcaggaggctgttaccatcaacatctgcagctttataagatgcacagccactggtaaaagctgcatccttggggcaagggtaagaatacaccctgactctgctttccttttctgctgatgcttccaaacccaggcaagggagtatggtgatgcagtctcagagtttgaagagatcagactcctgaggcaatgtgctctcagagaagggccaagaatagaaccttgggagaggaaatgtggataactcttccaaagtagcttctcagaaccatgacacatgtaaaacagaaacagtgattaataggtcccaaagcagtttatctatccttcattgttttggaagagtatcctccatcattgaagagaaatgtgtcattatttacaacttgttcatttcttctaaagactttctaaattaactgatrtcttcaaaccaaagagcaatgcagaaaaagaaaaggtctgcagaaagtggctgagtgggagaaagaggtgtaatctagttacctgtttctctgcagcccttatttggycaaagaatataagttatcaagaaaagtaggtagatgacttgttctctaagaatattttaactcacaacccaactttaacaaatattgaaggcagtgagatcaaaatagtattccctggcgaaagcctataatacagctctttcattttaccagttgagtatgacccctagtctttggtagataattgagctggaagaagggtccacattcttttatgggaggtgaagagcctacagggcacagataatatatggaaagttatatcttccattttcaaaattgagctaaggactcaaagttccataaatattgttttaagcatgcaccattgtgtagagtgatctagaccaggggttagcaaattatgatacattgtccaaatctgggctactttttataaataaagttttatttgaacacaagcatgcccatctctttattgtttgtggctgataacatactacaacagcaaagttgagtagttgcaatagagactgtatggcctgcaaatcctaaattatttgctttctggccctttactgaaaaatgttactgaccctggtgtagactgctgtgtgatctcgattcattctgtgtaatgtggctgatttatttttagcttgagtaaccagatctgtaactttattttagttttggtttctaagaattggaatttcatcctcacctcaataacaggcaatatcacatcgttccacttaacaattcttttatcctcttttgttttacatttaacattaatatattcatttcttcagaatattgcccctgtgtatcacctgtgtggcactcttttgtgacatttgtatcttgtacactgtcactatcatagtcttaaatttctttatgtgattaatatacatgtccaaataytatatagcactgggcacttttcacaggatcatccacaaaacttggggtgagtgtgaaggatcatattgtattagagtctttacaaagtttcatgttacaggattgtcttaattattttaagcaaaagtatgtgttttactactcgggcaaaatacattagactgacattatctcaatcagtcatactttgggcctgttttgtatctatcttcctgctaaactcaaagctcgcatgtttttgcttattatcatgtcctcagtctttgtacaattcttggcatatagttagtggtgaaatatttatggaatgaatggtgtcaaacatatactggaatttgttgtatgatataagacatgtacccaatttaatgtttccaaatagccaacaaaagttggctagcccttttattaaatgctcctttaccaatttccctttggtgggagggccaacattattatctaaagaatttgtgcctttaccttctgaactgcttatggcttcatagtctgctccatcttctcatttttcttcagtgcaatactattagaatatacgtcaatattgatgagctaagtcgcatcattccaacttttcaaaaatgcctttatttttcaacttattcaagaaaatatttgaatcactttataaatacccttgaaaaatacgctgcattttttgttgtaattatgttaaactagtaaatttctagagaactggcattttaaaaatcacatcgaatcttttaatccaagttcatggaatatatttgtttaattcaagccttttttctcatcctccctaaaattttatcgtgccctttattcattatataagtcacatacatacataagttacctaagtatcgagctataagtaacaggacatattactggagtgggttaaataaaagctgccacatggccagtcatgctggctcacatctataatcttarttctttgggaggctgaggtgggaaaatggcttgagctcaggagttcaaagttacaatgagcaatgaaggttgccacagcactccagcctgagtgacagaaccacacaagaccccatctcaaataaacaaaaactgggaggattaagatggcaggtaggagggagaactgctgcagcttctgcttggttggacagaacagcatgtggagactcacattgtgaacttttgccccaagaactaccacaggaaaataccaggaaagccaagagaatccacagaccttttgaaggaactggatcascgctgcaggctccctaaaatgccaaaaaagtgtgagtctgcttgctttctcaacagggaagctcgtgatttagggtgagttctcagccctggtcataagctgcctggaaatagacttggtgctgttgtggagggcacggtgggagtgagactggcctttaggactctgggctgcgtgggagcagagtgaggcctatgacttccggctttcccccacttccctggtggcgtatatgactcatcagaggcagccataatccccctgggaatataactccattggactgggaaccacaacctcctcccccacagcagccatagcaagccccaccaaaggagagactgagctaagacactcctgtccctcccccaacctggtggtcttactctacccaccctggtagctgaagacaaaggttataatctcttgggagctctgtggccctgctgactgcctgagaaacctgaatacttgaccaggtgttcctagggcaaatttgcatcctccctataggaccccagctcatgtgctcttgaaagtgccaactcctggctggaatccaaccaatacaagaccagcacactcaataaaaataacaaccaaggaccctgcagagtccacttcactcccttgctacctccatcaaagcaggtgctggtatccatggctacaagacctgaagatgaatcacatcacagtactctttgcagatactcccaagtaccagtgcagagcctggtagctccactgggtgctagatccagaaaagcaaaaataatcactacatttcagctctcaggaaaccccattcctagggtaagggagagaacaccaaatcaaggcagcacactgtgggacaaaagaatctgaacagtagcccttgaatcccagatcttccctctgatgtagtctatccaaatgagaaggaatcagaaaaacaattctggtatatgacaaaacaaggttctttaacacccccaaaagatcataccagttagccagcaatggatccaaaccaagatgaaatctctgaattgccagaaaaatattttagaaggtcaattattaagctaatcaaggaggcaccagaggaaggtgaagtccaacttaaagacatcaaaaacataatacaagaaatgaaaaaagtttttcagtgaaatagatagcataaataaaaaaacagtcacaacttctggaaatcaaggacacacacaaatgcaaaatgcactggaaggtctcagcagtagaatcaaacaagcagaagaaagaacttgaagacaaggctttcaaattaacccagtccaccaaagacaaataaaaaagaattttaaaaaatgagtaaagcctccaagaagtttgggactatgttaaatgtccaaactaaaaataattagtgttcctgaggaaggagagaaatctaaaagtttggaaaacggatatttgagggaataattgaggaaaacctccccaaaacaaagagaaacaaatcctcgaaatacaccaaaatagaaccttcttcaagcataaatctcacaggacctttataacaatagcacaatagaaaaaaaggtattcaagcaataaatagcacaatgagtagaatagtacctcacatgtcaatactaacattgaatgtaaatggcctaaatactccacctaaaagatacagaatggcagaatggataagaattcaccaatcaagtttctgctgtcttcaggaaactcacctaacacgtaaggactcacataaacttaaggtaaaggggtggaaaaagataccgtatgcaaatggacaccaaaagcaagtaggagtagctattcttagacaaaacaaactaaagcaacagcagttaaaaaaagacaaagagagaaattatataatgataaaaggactagtccaacaagaaaatattacaattctaactatatttgcagctaacactggagctccgaaatttattactgttagacctaagaaatgagatagatggcaacacaataatagtgggggactttcatactctactgtcagcactagacaggtgggtcatcaagacagaaagtcaacaaagaaacaataggcttaaactataccctacaacaaatggacttcacagatatttgtggaacattctacccaacaattgcagaatatacattctattcatcggcacatggaacttctccaagatagaccttatgataggccacaaaacaagtctcagtaaatttaagaaaattgaaattatctcaagttctctaagaccacagtgaaataaaattggaaatcaactctgaaaggcaccctcaaaacaatgcaaatacatggtaattaaataaccctgctcctgaatgattgttgggtcaacaatcaagatggaaatttaaaagttattcgaactatatgataatagtgacacaacctgtcaaaacctctgggatacagcaaaagcggtgctaagaggaaagtttatagcattaaataactacatcaaaaagtctgaaagggctcaaactgacaatctaaggtcccacttcacagaactgaagaaacaagaacaatccaaacccaaacccagcagaagaaaagaaataatgaagatcagagcaaaactaaatcaaattgaaacaaacaaatgcaaaagataaatgaaataaaaagctggttctttgaaaagataaataaaattgatagatctctagcgagattaaccaagaaaagaagagagaagatccagataagctcagttacaaatgaaacgggagatactacagctgataccacagaaatagaaaagatcattcaaggctactatgaaaacctttacaygcataaactagaaaatctagaggagatgtttaaattcctggaaatatacaatcaccctagattaaaccaggaagatataaaaatctctgaacagaccaatagcaggcagagagattgaaatggtaattaaaaaaaattgccaacaatgaggaaaggattccctgtttaataaatagtgttaggaaaactggctagccatatgcagaaaactgaaactggaccccttccttacaccttatacaaaaattatttcaagatggattaaagacttaaacryaacatctaaaaccataaaaaccctagaagaaaacctaggcaataccattcaggacacaagcataggcaaagacttcatgactaaaacacaaaaagcaatagcaacaaaagccaaagttgacaaatgggatctaactaatctaaagagcttctgcatagcaaaagaaactattatcagagtgaacaggcaacctacagaatgggagaaaatttttgcaatctatccatctgacaaagggctaatatccagaatctacaaggaacttaaacaaatttacaagaaaaaaacaaccccatcaaaaagtgggctaaggatatgaacagacacttttcaaaacaagaaatttatgtggccaacaaacatatgaaaaaaagcttatcatcactggtcattggagaaatgtgaatcaaaaygacaatgagataccatctcataccagttagaatgacaatcattaaaaagtcaggaaacaacagatgctggagaggatatggagaaataggaatgcttttacactgttggtgggagtgtaaattagttcgaccattgtggaagacagtgtggtgattcctcaggggtctagaactagaaataccatttgacccagcaatcccattactgggtatatacccaaaggattataaatcattctactataaagacacatgcacacctatgtttattgcagcactattcacaatagcaaagacttggaaccaacccaaatgcccatcattgatagactggataaagaaaatgtggcacatatacaccatggaatactatgcagtcataaaaaaggatgacttaatgtcctttgcagggacatggatgaagctggaaaccatcattctcagcaaactaacacaggaacagaaaaccaaacaccacatgttctcactcataagtgggagttgaacaatgagaagatatgggcacagggaggggaatgtcacacaccagggcctgtcagggggtggggggcaaggggagggatagcattagaaatacctaatgtagatgatgggttgatgggtgcagcagcctaccgtggcacatgtatacctatgtaacaaaactgcatgttctgcacatgtatcccagaacttaaagtataataaaaaaaagaaaaataatgtaaaaaattgccaacaaaaatagtccaggaccatacacattcacagctgcattctgtcagacattcaaagaagaattggtaccaatcctactgacacttttccaaaagacagagaaagagggaatccttcctaaatcactctctgaaactggtgtcaccctaatacccaaaccgggaagggacataacaaaaaaagaaaactacagaccaacatccctgatgaacatgggtgcagaaattctcaacaaattactagtgaactgaatccaacagtatatcaaaaagataacctaccatgatcaagtggatttcataccagggatgcaggaatgatttaacatatgcaagtcaataaatgtgatacatcacataaacagaattaaaatttaaaaatcacatggtcatctcaatagatgcagaaaaaagcatttgacagaatccagcatccctttatgatgaaaaccatcagcaaaataggcatagaagagacataccttaaggtaataaaagccatctatgacagacccacaaccaacattatactgagtggggataagttgaaagcattccccgtgaaaactggaacaagacaaggatgcccactttcagtacttgcattcaacatagtactggaagtcctagccagagcaaacaagaaaaagaaagaaagggcatccaaatcagtaaagaggaagccaaactgtcactgtttgctgttgatatgattgtatacctaaaaaactataaagactcatccaaaaagttcctagaactggtaaatgaattcagcacagtttcaggatacaaaattaatgtacacaaatcagtagctctgctatacaccaacagcgaccaagctgagaatcgaatcaagaactcaacgccgttcacaatagctgcaaagaaaaataaaatacttaggaatatacctaaccaagaaggtaaaagacctctataaggaaaactacaaaacactgctgaaagaaatcatagacgacacaaacaaatggaaacacattccatgctcatggatgggtagaatcaatattgtgaaaatgaccatattgcaaaaagcaatctacaaattccttgcaattcccataaaaataccaccatcattcttcacagtaccattcaggactaaaattcatatggaaccaaaaaagagcccacatagccaaaggaaggctaagcaagaagaacaaatttggaggcatcacattacccaacttcaaactatactatcagtcaccgatatagcatggtactggtataaaattaagcacatagaccaatggagcagaatagagaacccagaaataaacccaaatatttacagccaactgatgttcgacaaagcaaacaaaaacatraagtggggaaaggacacattactaacaaatggtgctgggacaattggcaagccaggtgtagaagactgaaactggatgcttatctctcaacttatacaaaaatcaactcaagatggatcaaagacttaaatctaagatctgaaaccataaaaattctagacgataacatcagaaaaactcttctagacactggcttaggcaaagagttcatgaccaagaatccaaaagcaaatgcaacaaaaacaaaggtaaatagatgggacgtaattaaactaaaaagcttctgttcagtgaaagaaacaatcagcagagtaaacagacaatccacagactgggagaaagtctttgccatctatacatctgacaaagaacgaatatccagaatccacaaagaactcaaacaaatcagcaagacaaaacaaacaatcccatcaaaaagtgggctaaggacatgaatgaatagacagttctcaaaagaagataaacaaatgtccaacaaacatatggaaaaatgctcaacatcactaattatcagggaaatgtaaatcaaaatcacaatgtgataccacctcactcctgcaagaatggccataatcaaaaaatcaaaaaataactgatgttggcatggatatggtgaaaagggaacaacttttacactgttggtgggaatgtaaactagtacaaccactatggaaaacagtgtggagattccttaaagaactaaaagtagatctatcatttgatccagtggaaaagaactcattgtatggaaaagatacttgcacatacatttttatagcagtacaatttgcatttgcaaaaatatggaaccagcccaaatgcccatcaatcaataagtggataaagaaaatgtggtttatatgtaccatggaatactactcagccataaagaggaaagaaataatggcattcacagcaacctggatggaattggagactattattctaagtgaagtaactcaggaatggaaaaccaaacatcgtatgttctcacttaaatgtgggagctaagctatgggtacacaaaggcatgagtgatamgttggactttggagactcaagtgaaaaggtggggtggcaagaggttaaagactacacattgggtacagtgtacactgctcaggtgatgggtttaccaaaacctcagaaatcaccactaaagaattttttaatgtaaccaaacaccacctgttccccaaaaacctattataacaacaacaaaaaaattttaactgccacaaagattatatttgcttcaatataaattaggaagtttttccgyatttttttattttcagaaattacttttataaaagagacttaatgatgtagataagatagaaagtwccgttcctggaagtttgttattattcagcttttaattcagcatattaaaggtaatgacagaaaccacaattacttttgcactaaccttatataaaccatctgtgcattagtggaggaatattttaagtacctttcataataattattactctgttcaagttttcaatttcagggggacgattttggtattttgcatttytcaagaaatktagatatttcctttaggctattatacttattaacttatatttttataaaataatttttaagtattgaagtattttatatttataagtagttatcccttttatattctttcttctctttatttgaatatttttacttttttaggtttttttgtagaattttatctgtcattctagctttttagttcctaattgtttcttctttgattaaaaaaagaaaaaaaacaaagaccaatatttcttttttctttcttctttttttcttcttggttgattaattgcacttagtttatttatttttaataactcttacattctgacacctgtactgatttttttctgaatattgctttaactacatgtcacaattttttacagatagaatgccattgttatttatatgtattttttcttgcaattttctttttaacaaaagaatgatatagtgttttttttcattttccagacatgtagaactttattttgctatattgtgttatgggttgcaactttattgcactctgatcagaaaacatattccatataatagctattgtgtagaattttttaagatattttatattaatagcttgatacataaacagtttttatttaataatcctcatttatgcaaaaagcacccttgttccatatttagatgtgaagtttatgtgtgtgtatgtgtatatatatatatatwtwtttttttttatggttttttkttttttttttgagatggagtctcactctgtctcccaggctggagagcagtggtgccgtctcagttcactgcaacctctgcctcctgggttcaagtgattctcctacttcrgcctcccaagtagctgggattacaagtatgcgccaccacacccagctaatttttgtatttttagtagagacgtggtttcgccatgttggccaggctgttctcaaactcctgacctcaggtgatctgcccaccttggcctgccaaagtgctaggattacaggcatgagccaccatgcccagccatatttttttatatataaataagattaataatacaaacacatatacacattttttctgtactatggcttatattttgtctatttgatctaccaaatctgaaaaagcatatattaaaatcaccagttaccatcatttatttcttcctgtaatcctaccagtggtagttttagatattttacatctttgttgttaactgcatatatgttgaggattattacaacttctttatttataatatctctcttgtcctttatggtgcactttgtcccaaattatattttgtctcataataaaaaattaactctggctttcttttgctttatatttgtttcacagcatctattttttccatcttatgtatgtattttttccaacttatgtatgccaccttatttcatattttacaatgtccattcttttttcttatttcttttttaagtctttctacctacttgccattaggtacatcaaattttcatctgctgctttaaagttatacatttgtattttattaccttgacttattttgacttagtcttaggttattttttcctggcaatatataaagcagatcaatatctatgtctttatcgtttaacaaaataatacccatagcataccatcctctacctctcctcttgttgccaactttttgtatttcaggagttttagttacatatatttgtaagtgtactttttacaaaataattagttccagctcacctatacttctttctgtccaactgtaatgggattctggtgctgccctagtgttaattcactattatctctggtgctgcagcttacctaccacattacaccaaaggtttctaccaaaggcaccaaaggataataagttagtgtctaggaggtctaagcttcagggcctgaaataggctatccctgatgtacctccagatacaggcttactcaggttatgtggagaagactaaagattaaattgctggcccccattcctggttactgtactctcctgcttcagatcctyagttttccaaagacatctgcaactacttgtgttctgtatgagtttctcatcagctgttttattaattgatgaataagaccctgaagcccatacaaagtctatttttcttttttggcatctccgaagttgaattcaagagagacagggaatagctcatgttagtttgctatgttgtactgcactggcactttccccctccctaactttgtatttttatttattccatcatcctgtttctcttaggaatgtttgattactcatattctaacttcttgaaaccaatgctgaatttattgtcatacttgattgtttaaatatgagagcagttaaaattatgaacctgtctcttattatgcctttgsscacatctcgtttcaacgtgcattcttctcattttcatcacttcataaatagtctatattttttatttttactttcattttctctttgacttgaacaattggggaaactttttaatttgtaactttttaatctatttaatgttttattacattgaggccagataatagtgtcttttcaagtttttctttttttgaatgtgttgcttttattgtagactaatactggtgtttttggtaaaagtgacacgatgtgttttagaccttctggatccatattcatttttccttaatctaggaaattgagaattatatatactgaaattatacctcattgttgtattttgtgtcttacagctttggttatctatgttgatggcatgttgaaagtacataaaatatgacttcaagatttatcaacctttaagtatactttgatgttaatattcttactgctacttttgtttgcagttgctggataaacaccagtgtataagtgtgtacctatttttaacataaacataattgtagcactttgttttatagtagctttaaaataatataatcacctgtggttccagctattcagagggctgaggtgggaggatcacgttagcctgggaggtagaggcttcagttgagtggtgattgtgccattgcaccccaatctttgcaagagagtgagaccttgtctcaaaataaataaacaaataaaaatataatattggaatctgtattttttacaagaaaatttaaccaatttaagtttataattataattatgcaagatataggtgttcccaccttattttatgctatatgtttcttttatgtttattggctttcacactaaggcttgtctttaagtttttgaaaagtgtttaaaaatttaaggacaaaataaaaattaaaatattaaaaatgaaattaaaatttaatttaaaaattaaaaattaagaacaaaatataatttgaattcaaataatcatttgaatgtttcatatggaagattttgatacactcttgggttctaagcgagattattaaaatataattgttacattttttaaaaacttatgtttttggttagttttctaaagatatttacaacagatagttatactctcaggttaatcagtatccactattattccttttaaagaataatttcttcattcttatattctgaattttttctcattctcagagtatatctttaagtaatttgttaagtatttgtggaggatatagtttccatgagcttcccatactgagaatgacattctaattcatttatgaactttttccctgaaaaagtggtagggcaagttttattgttttaagagtgttttaaaggaaaagtctaacataaagcttgcatttggatgcttgtattgttttcaccttgtactttaaaaatctttagcacaatttattgaagtaggccttctttcattgattatttgtctttttaatttgctttcattgctctgtttttgttttgttttcattttagttcattaatgtttccttcagttttttcctatttctgttttttttctagaaatactgtcatcagtatctattacgtttttttatggttttattttgtctttttttcgtgtctgagattgtttcttaaatttgtcttgtcatatcagtgattttattttttatagcattaattatgctttttgttaattttttattgggtaaaatatacatgtatagtttactgtctttaccattttaagtgtacagtttaattgtaattaaatatgcttttaaattcaaattcatttatgctttttagcacttctaacatgacttaattctcttattaaatgtttagtcttcttactcttcattctttctcgcttttctttactttctcttcagcctagaatttcaaaaagtgatcttaaaatatttttttacttatgggatacatcattttcacaagtttacttatttgtgtgttcaagttgatattttctttaccttgatttgcagtatttgttaatagacctaaggtgacctgttttttctttccttatcttgaaatgaaacaaaaatcttttagtaattggttagtcagtaattattcactttttgattatgaatctcatttctagacttagatcaggagggatatttaggtgcctcgtgtccagcccagttgctattttctagcagtctgacatctagggcaattctctgtactaaggtcagatactcccaagtattgccacacagttctctaagttaaagagataaaaaaggtaatttccagtcttcactgctagcaaggcacttactgaagccacccatgtctatataggtctgcagctgaaagtatgcagtgtgccatgcatcagccaccttcctgcatttccccctaacagttgctttctgagcaaatatggaatactgaggaagttagagagcccagtttgaggccccattcctgggcaagacagtaggggttgtccactttttgcttgggacagaatggatctcaagccatcagtgagggtggtacaaagtgtctccctgatgtcagaggggatcttggatagatttttcttaattcaacttcatgactcttttatattctatgaactgttgtttttagttgtggtgttcatttttgattgtgagtttttttgtttttaatgtgattacactggcagtttaatggaaggtacggcgaggctggctcaggaactgttagccaggtaccatttaaagtgactgtccaatttctcccttgccattcctcctcaggagtcacagcaattgcaacaattaaaaaaattcgacatttctcttgaagaaaaaatggagtctaaaagttggtttattttatttatttaattctatgaaaaagaatctagaaaagttataaaatgcatgggataataacattaagttatctttatggaaktttccactaccatgtagggaagctataaattgctgcctacttaatagcaaacagttacttatttaaaaaagagctgtaattacaggccatcaactacatccagcagcagcatcattaataacaagtttatgagtacctacttagggagtgaccttgttagagaatctcacccaatgctacatatgctgccattagtgttaccattcagattagattgtgatattgttcagtcagccagttttagttcattttgcatacatgattccctaagtaaaacactttcgttaatactggatagataccatatgtaaacttttcagcagaaattacaaagaaatatggcaaagcttcatcttaacaccaaaatgtagttaaaaacagctttgatttcttttgtgaagctatattgttgtaggtaagacatacatcactcaaatactcacaaagataactaaaaatttagatcccaatctagaaagcactttataaagttctatgcaaatattagttattgatttgcttttgtaaagcaacagcagaaaatgttgcccttatctgattgtaatatttctagaactagagctctcttaaaacatttcctgcraagatatttttcactttttaaagaaaaatgtttccatgctctcacaggataagtagagagagggcaaaagttcagtctcactatttaagtttctgtgtaaaggatgtttctatttctagcacagttatatttggattatatcgatccggtaatatgagtgcatgttctgtattcatctttttgaaaaaaaaattatacacagcaggtacaccttcagaatgttaaatgaaagctcctgttctcataggaatgtgtatgtttatttgtgctgaaatcctgaggtgcatatctatggctttcatattaaagatgactgaagagatgaaaatgatggtcttgtaagttaaaagacttttacctgcagtccttaaccttttctttttatttatgccctcctaatcccaactcttttctccaaacctagcttctctgaagcccaaaaactccaacaggcatctcaggctctatttctattaaccagccctgttaaccttctatcccygcagtcagcgtgcctgaccattcttgcaaactcttggacctgtactttgaaaaggttattgattcttgacataaatctcttaaacatgtggaaagggaactgctctagaataagaaaactcaaccttttaccaactatgcttcatttgtcgaggtccttcacccctgtgaaaagcaattttcttttcctcatgaaatggagataacttgggtccatcttgctcaytttgcttggaaagtagggtccacgtctggacaaacaggccaaagacacatgacatctgatctggctataggaacaaaagactaaacaagccatccagcagcaggttgcctctgacctttctcacagggtgatctggagaattcttacaaggtgtttttattaatctccctgaagtatcttgaaagtagattctatgtcatgttcatgtatcctcagtgattagcatagtacctagcacgtagtctcagtcactaaaggccaattgattattaagggaggtggaggtctgctttctaagcttcattaataataacagcagctgattgagcaccattttgcattcactgtcagaatgctcagagactaccagaagtgatccatggtttccagttggagtaataacttctcatctgagaggttatgatgatgacatatggcttggggtttgggggaagattaaatgaaaaatatatcccaaagcaactggttcagttagatacatggttaagggaggaacagaggtaggaagagtcaaatctggttttgtttccgctccatcacctgtttctagtgggaacttgaaaaggtgtgtgacttccctgagcctctttcctcatctgaaccatgaggttcacaacacctgccctgcctcccccagtcatttgcaatgataaagggagatgattaaaaataaaggggcctacaaatgtaagaaatttagtattagtggaaagaaccatgggctgggatttctaaaacctkgctttggcacctaatagccttccaaggtaagctcactagacacaggtccatactatataaaacaaaaagggttcagttagtgtattttgatgcttttcttgtcaaaagtgatggatttgtagaaattctcttaatrtacatacagaattaaaataatcgcatatttttaattttaggcctcatgtgtactaagaaaatcttgtccattctgaataatgtgaatttacacaattcattctgctttcctatatgtaaagaatttagctatacttagtaacactccaaactttgcgcagttgttctcacctcactgctaattagttcagttccctcctgttatccatttttggtgagatggaaagggtagaatagatcaacatgggctgtttcacagttttacctgggtttgtcccacaatttgtggattaatctagtgtatttattcacaagaaggaaaatattggctcaggacaagaatttctaagctctgcaaccttgacaactaccttcaggttctttgtttcataaatgtcacacctgttgtatgtgaaagggcccttggagttcctcacatctagcatttttcatatgggaaactgaggcccagagaagcaacttatagaagacacagtgatctgagaaaagaaagtccaaaatgccaacaagctgcatgccacgtatttggttaccctacgaggagttaataaaatctgtcacttgcccatagtgcagtgttcactgtggaatctgcccttttgatttcttgtttctctttaaattgaatcagaggtgttcattttacttcaggtgtgacattttacagcagttagcacatttaactgagaggtgaagctggggtaatcatatttgagttattcagatcattctttcttggtcctagctgagtttattgaggacatactatatgctagccactgtgctaagtgctttatatgggttttatcacttaatcatccaataaggaaggttatgacttataaggaactgaattttacaggcaaggaaagtgaaatgaaagaggttaagtaattttctaatgctccatagagtacatggtagaccagagatgaattcaagcagtctaagttaactactcttcatgcttggcacatggttgaaagaacaagaagtatatcttgtcaatagcgattgcaaatcctmtaaaatcacctaagtgtatggattttctggatgccttagcacatagccatgtatgtttgtgtgcatatacattatttgtttttgtagatttatatataaataatgtgtctaatgtctaagtacttttgcccttttttacgttattagtttatactggtgggggagattagccctaatatttattagagggagaaaaagtcatttttacagcatcctgcacatagcaactcttcaacgaatgcctattgaattcatccttattttctaaggaaagtggcaatggatcagaacgagaagatccaggttttagttctggttttaatggtgatycactgtgaggaaaagaccaggttggctgtcttctccaatctttagtcttcccgtgtctaaaatgagttcagaagagcctacagttggagcgtccactgggcattcaagcctatctgactggctagcctggtgtgtcaggattccaaaagatccatccagactaggacttaggatgagtatagacctcatcagtgaaggggtaggaattgcagggayttctgagcagcactgttgtgtctttacaccttcttccaatctagtcattgagaaaacttgtgattaggttccttgccaggtgcactaatactctgagcatctgctaaaggcaggtaagtaagaattgtaccacttgtgctgtggtaagaaactaaaagagccagattttgtgtcttataaaaataacatttccacatagggtcctactctagaaactgttcaagcatagaagcccctaggagccggtgagggtgcaaggagcaatagccacaccagcaagatggccagagtgaccaggtcaggaagaatgtaagcagtgtgagtgcggcagaatcaaactgaaaagtttcaaaatcactctcagcaccaagagcagtaacaagagctgtggcagtgcagacctcatgccttttgcataacaggaggagcactttacaaggaacttaggaaccctcaggttctgggcagttagccacaggcatccaagggggtcgaatagacctgtccttggttcttccatcttccctttatcatccttcccatgtgtccccatgaacttggtaaaaacccaagggaatacaggttgcaaacccaagagagggytgaggtttatgaggtgctgtggtctccacaggttcacattgctagtctgaaaactccacatttctgtccttctgtcagactcactcacttctgataagaaaacctcttagccttacttgattacagtaatagtaaaagtttatggtccctcatgtacagtcttaaatccaaaacgctcccagtcttttttgtaattttgtgtcaaactaatttagtggtacaacctgacctaacaggatgctatttacagtcttcatgtacctcgcttagtgggaatattcatgtttggtggcaaaaataattcatgtgtttttgactatagagtgcctccaaagaccctgctgtggataataagcaatttgtagaagatacatcgtaactacttttctgaagttggaagaatgctgacttccaaaaacatctggccccaaggatttcagacaagaaattgtgaacccataagttgtttttcttaaatttgggagtatttattgatcccctaaggaaacgaatgattcgttcagttccttcttcttcccttacaaagaaaacaaagcggggggagggacaagcaaaacaaatgtaaactgtgactcttattgctaataagctgtggcagaagctgttgggggtctgagtcttcaaaaggagcagatcttttggaggacagaaatctggatctgtacctttcctgcaattaaaagaaaaaaatatgtatcagagatttccccgtgcaactgcagtcctcctcctctctccctttgcagtggagctgctgatcagaatgtgcttgcaactcacaggaccatagcgccacctttcttgcagatttggaataaatcttcacacgtccaggtttggaattaaatcacactatcagctcacttgcctgtgtatgccgttcagttagctagacttagcaaggaaacagttccttgacgctcaaatcataaaggaagagctgcaaagagggcaataaaaagtgttttcttctcttggtccctgagcaattaaaytggtaacctaatctgatgttagggagtatagaccataaactgtgtttaattagtttgcacccagtgtcatttcacacagtagacactttaatttacaacttgctgcactgcagcacttttctaggccttttactatgtaataaggcattcttgtagctgctgaggcttyacaaatatagatacactttcttagttcagattttttctttcttttcaattttcagttgcaaatcaaacatgcagttacagaagcagagattcaaaaattgaagaccaaggtaagcaccgaaacatggtgtttgaattttactttttaaacttcagatactatgaataaatccaatcctaggactaaaggttttgtccctgtatatttgaaagaatgcaaatgtgatagattcattttcactgtcaggtacgtagacaaacctgccagtgagagcaaacacccacatccccctcagtgcaaataacacaatattttagatatatatatttatgtatttgcacatatgtggcctctgagatttccttaaaaagtaatatttttaatggttcaagtatgcaaagtatgttttgattactaattccttaagcaaagctactatatctcctcttcacttaccttattataaatagatttaatcatttgtaggaacaaatttagtatagcacatcaatgttttataaaccatttctaatttctaataattaaatcttataaacttaatacatgcataatttaagtgccaggtactactggaaatttttagttgtttggttcacataatttaaatttgtgggggagaaaaggtcttgataaaagggagtatgtattattagtctatatattttcattgacaaactttaaggcactcgtatgagacacaattctagcaattttgtttagttttatcaaatatacaatttcaaagatttaaaaatatattttaaattacttttaaagcaatattctttattgtttcaatggtcttttaaaaattaaaacataattaccctcccccgcccccaatcaccaccaccactaccactaatgatctcttttgttgttcacattgaacacttgttttggtttctccgtgtgttttaaatggagatgaattagcaaggctattttggttaaatgctattctcagctaattcactctgcagctctttagtcaaaatacgactatacatcattcacggtgttagtccagctccgtgaataataattttaaattagtggcggttgctaaataaacaacttgatacaaaacattgcttaataaaagatgcagtnnnnnnnnnnnnnnnnnnnnctccgcctcccgggttcacgccattctcctgcctcagcctcccgagtagctgggactacaggcgcccgccactacgcccggctaattttttgtatttgtagtagagacggggtttcaccgtgttagccaggatggtctcgatctcctgacctcatgatccgcccgcctcggcctcccaataaaaatatattttaaattacttttaaagcaatattctttattgtttcaatggtcttttaaaaattaaaacataattaccctcccccgcccccaatcaccaccaccactaccactaatgatctcttttgttgttcacattgaacacttgttttggtttctccgtgtgttttaaatggagatgaattagcaaggctattttggttaaatgctattctcagctaattcactctgcagctctttagtcaaaatacgactatacatcattcacggtgttagtccagctccgtgaataataattttaaattagtggcggttgctaaataaacaacttgatacaaaacattgcttaataaaagatgcagtaaataacctattcctgttttaaattgtcattgtctcttgacatagaaagaattgaagattttttaaattgttgttttaaaaagatctctttttccctgtgattgtgttttaatggcgcttatgtattagactatagacatttaacttagaaaatactataaattagcattttatattttttcatcattatattggcatgtaatatccacagattagcactttattatgattctttattattcattttgataatagaattcctaatcttgacattgttttggatgctttctaactttgtaaactgttttgcaaatgtgtttagttaaaaatatttgcaaaaacatagatgtgtgtgtatataaatacatgtttacttttgctaagtgctatatgattttgaacattgatagtttataatgactttgcatccttttgaactttaaagaaggcatataaagtagataaagtaccagtttgaaggccagagagttattgggaatgacttttgagccctcacctaaatgatcagtattggatttctgtagaaatgagggtattagactagtttactatctattcctaagagtccctagaagcagaaaaacaaaaagctggttatggctttctgttccgtgggagggaattaaattaaccaagcaaaaatttatacttttacttacactatcttttatatttttatgggaattgaggtttataaagcttgagaaattcattacactacatgtaaaataatgagctatagaatatgttcatgttccttgaaataaagaatgaaataagatcaccaaaagggttaaaagcagagtgaaagtggttaatgtttatcagatgattcttatgcccaaggagctatttcaagcattctgatgtgttatatcacaattctgttgtatggatgatgtaattgagtcttggagaacttcaattacatgtccaaggtttaatggccaataatgacagaactgggattcaaatccatgctgaatgactccagagatcccctcttaaccattaagccatactgtgcttctaactcctctctcctccctggccctctccactccctttttagttaattttttatatataattatatattttttaaaaactctcaaaacatgttgacattcgttggatatatcaaactctgaaacatcttttactgctcacagaatttcagatcacctggtgtgatggaaatatcrtgtgaggtggaatccaatccatgttttatcacttatcaaatgtgtgaccttggacaaatcatttcacttttcaaggcttccattttatcatctgtggaattataaaaataatacctgcttttctcatctcaagtggwttcagtgattgtttatgataatagaacttgatctacaacatgctataaaaatgagagatttttgccacaaaagtggccaaattatctttgccttgacgtttgctttctccagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaagtaagccgcttctaataactaaagaatagttatgtttgtctaaagaaggtttatgtccaataattttgtaatatctagtggaacagaaaagatgaccttagagatatctttcctatccaggagcatagttacagcataaatacacattaagttttggaagtcacttctatcactttttcatgagattatgttttgtatattttatagtttttggctgccagggcctctttgctatttttgataattaatcgttgtttrtaactgttaaaacatctgaatttctttattctttttgaaacacctctatgatttagaaacaagaagcccagcggaaagtcatgtagaatgactgactattggatgtggagcacgcaagccacagctggggcctgaatcaggctgctcctctctattcttagatcagtaactacagaatttcccactacagacagtgcacatatcgactagcaaggccccctgccctgccactctgcatttctcagctgttgagagaatcaggagggcctcctttcactgcagggagagagaccattaccacattctgcttttgattttcaacagctgtttctgagctactgctcctttgcttccatctcttggatctcggtgtaatgtcacggagactgaccacggagatttttactagatttttttcatcagttacttctggctagttagaacaaataagtagtaccagtaccttttctggtcttccatgccaagcctcagaagctaagcatatatgtaagattaaccatatttctkttatttcctattatgtggaagaatgtttttaatatttaaaagagttttgctatcaaaagtttcttgttaaaaggggagtaattattctctgtgactataaattcaatacatcactgttttaactatttgccaaactctttttcatgaaataattttatagtaaattttgctaaatttgcatattctattccaggttttcaaaatggaactgtttctcttctccccatattatccttaggtctataagtgagtgcccctctcgatgtttctgacccacccagccccctcttcactgttattcatagaaatcttacaattatctttttcgaactcttatctagttacatcagtttactatactatgcttatgacattggaaaaatggaattatttctacctgacaagtaattatctccactaaattacccaatgtgggtcattagtgcagtctttcctatctaaatatgtatgggtgttctagaatcaggagctacgaaagaaaattatagtaagcagaatcgaatcatttttctttgccttgtgacccattaaagatgttttagtttctttcattactatactttttcctctaactgattgaatgttgtccatttaaataactgttcagttgcttatcctactatgcagtttattgtttcagataagaactttcatttattgagtgtatgatataatcagaactattattttcttcttaagagagcttgatttcatcaaaagacaggaagcagaaagaaagaaaatagaagatttggaaaaagctcatcttgtggaagtgcaagscctccaagtgcgggtaagttgtgttccctaagacactaaataataagatggttttgctgtacttggaggggagcgctagtttagagttttataaatggatttgtttttcctagattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaaggtttgtttaacccaaccacaaaaatcatttttgatgactgtgtaatttggccttttatttttctttttctgacccagagatttaaaagttggaaataccttcctactatgggaaagaagaaaaggcttatcaaaataggagtcaatcattttagctctcgtcttatcaaaaataaatactttaatatgtagcattaacaaatcacaactaaagataagccaaatactattttaaaatcatcatacaattgacagatttaataaactgccttacaaattgtagttcatcctatctaggatgaactacactacttatgtgttaatgactaaggtttagattttttttttttttttttttttgagagtctcactctgtcatccaggctggagtacagtggtgcaatctcagctcactacaaccttcgcctcccaggttcaagcgattctcatgcctcagcctccccagtagctgtgactataggcatgtgctaccacgtctggctaatttttgtatttttagtagaggtgggcttttgccttgttggccaggctggtctcgaactcctgacctcaggtgatccacctgccttggcttcctagagtgctaggattacaggcatgagccaccgcgcccagccaagctttagaatgtttaagtcactagaataaagatctttttcataatatcagaaggcagactgctgctttcagcacttgagattcatgtagttaacgaagtccatatagttttgtgcttttaccatggtgtactgtgtatacttcttaggtctttcatgtcaaagaccaagtaagaccaaaacactggaaacatttggtattataaatgattatcttcattcatacaccaaccataaataaattacttatgttcttacacacacaacattcttagattgcacgtgtatgaacatgaatgactgttttaatatctgtggtatatttgcaaattagaaaacacataataattataaagataaatacacaggaatgtgtggcttcatctttttaaatatatacatagtagtccctggaaaatgaaaataaaagaatgtggtgcagcagggttgtcatgacaggaccgacaactcagaggcaacactttgacgtgcagtaaaaccctgttataatgggctttttagttttttcgtgatctttctcacatattaaactgtctccagtgaagttttcctgataagcaagtgtttatatcctatcatgaacttttagaactaagctcttagccattaaaaatggaaaggattagaaatcttcatttaaaattaaaatgatatctagagatttgaatccattcactgggtttatatccttctaatgggttttccctaaataggatgtaatttataaatagtgcctcttaggcagctgaaagaggaggatttagcattagcattacgactaagtgaggagctgtgtgacttcaggaagagtatttagcttctctgggttgatattactgtgcatattattttaaaagtagtatttccttcttcaccactttaaggcctgttttgaaactatatggtttagtctttgaagccaaaaaagtaatttatttgagctcttatggaattataatttttatacctggaacactataagattgatatctaaagaaaaacatcaggaatcaaaccaaattttttacctttttgaatattttaatttttaaaaaattatagtttatatataataaatacatattcctgctgtggcatactcaaagtatgagcagtatctagtagcttttcatttctattcatttctttcagtttagaaatctgtatcttttcaaacatataattaatggtgtttattaaattatatgactacagaagatcaacacactatactattaacatgctgatttggatcaaaaccttacatttcatctgaaccctttttctattctacaccctccattttgccacataattatcagtttccctagcaacactgttggttcacagtgagatgtggagactactaattcttactgaagccaatccatgcttgtgcagtagaggtagaatcagtcatctcagacattagtagcatacatatcaagtgctcttccagttttgctgtgaggacagtcagtgataaatctctttgaatttcagttgcttgatcacataaactaaaatggcgtggtcagtagctagataggaatgctctggaaagcacttttctaaattgatcccttgcttctgttgctagggaatgctgaaatactagaggtttagaaaggaaagtaaggctgcagacctaacataggccattccacatttaaaaatccaycaccaacgttttgtaccaggagaggtatagcacttccagtagttcccaaagttcctagatgcaagtgttatcctcccgaccttctactgactgtccaattctgatttgcttttcaggcactggagtggtaggatgagtggtttagcatgtttttaggcattgaggtagctcatgaagcaaaagaatgatcaagtgtaggtcaatgaaaatggtcagaatgaaatagtaaaaggaagggaaggcaagctaaggaggaagaaaggaagagcctctgagcagccgtttcttcatgtgtactcatgctcttccaaaatgatgtgactcttaatattgaattataaatttttgaggagtaaaacctttttccaaaccatacagaaatttagcacaaatttaaaattacgtttgaccaccatttgtatgtttctcactaaaacctaagccaactcaagtattattaaaattttgataacaatcatcagtacaaatttgttatttaatatattgtaacacttttwtcttatcatgattacataaagcagacgtaacaaatttttttccaccaagagccataacagaccccaaatccattctagtttatatcaatgtgctggtcaagtattttccttgtgttccaggaaaggaaaaatgataattatgccctgctgctatgtttcatgcttgtcatttcttagtgcctaaataatgccaggattaggataaaaacagagaataggtatgttagagtgatcttggtaggctaaaagcttgtaatattagttttattggatttcctagaaaagtcacagaagcaatacattctgagcttctagatattccaggatccttatgttgataccatttgctgcttcaaatattttgaaggctggtttgctaaaggattgtgcatatcccatagagatactgaaagaaagactagggccagtaggtggaagttacctatgaaggcatatttctgactattctaccgtgagagatcaggagtaagtgtgatatcatttaaaaaattattttgaacaccgaaaacctgcttccaggcaggccttaggtggtacactgacttgtaagagaaagtggctactaggcagaaagaaagtactaggtcctgccgattatactgcaaggtatatgatttgtgggatcaagaatgaaagaggaaaagtttggtaggagacaaataaatagaatttaaggcactatgtaagcatctcaaaagatgagagggaattcaaagaagagaaaattgaataacattagcataattttttttctgattcatggtctttatgttgaaaaggtagagccatttgaaatgacatagtgtgttcttggagtagaagtgggctttgactgcagaagggtttgtacataatcttgtaagcattgtgacccattcacagttttgaagcataacaggaacttagtcacttgtaggtttgtaaatgtgattcaaggatttctgtgaaatttgaatattgctaccaagtgctgcttcatttcattytcacrcctacctactcagtgagtggaccaccagttaggtaatactgcatgttatcttcccaaaagtgtgaacaaggagggttatataaggcattttatactttgttcccttagttacttactgttccttagctctaatgagaactgagcaagaaaaaaatatactccagcctgagtgatagagcaagatcctgtctcaaaaaaaaaaaaagtgacattgaaagctattaaatatcctgttaatattagcaacctgaatccagaaatgtaattaaaatatatatgactaacttgagtctatgtaaacaacacaaaattgttttaacattagaaaacctactcatataaaatcaacacattaactagaggaaaaatacatataattatttcaatgaatgaagacaaacatttaatgaagtttaataccttttcaagtttaaaagttttatcaaactaaaaatatggaggaacttccataacttgatattgtgaggctaacaaaagtctctgtcacacattatatgaagtggaaaaatgttatactccaagaatttcctttaaaattaagaatgcttttaatatttcatcactaagtgtattactactgcttctattcagtgttgtcctagaggtcctagtaagtactaccagataagcaaaagaaatcaaaaatttaaggagtgaaaataatcaaaattttcattattcactcataataaaattgaatacattaaaaaactcgagtcttctgattattagatgttataagaattaacagggtagatggatttaagaarcatcagacatcaatcatttccaacaaacaaaatgtaattttctaaaatatgccataaaaatagcaaaaactatgtataaggtagtcagtgatgaatttaacaaaagwtctcaagacccatggaaagacatgaaagaagacttacataaattgaaagagaaaggaagcctcaatattataaaaatgctttttatgcaaaattaatctatatatcccatgcagttttaattagaattcaaacaaggcttttaacttctttagaatttggtaagttgtttctaaaatatatatggatgaattgcttggcccagaatagggccaaggtgaattgcttggcccagaatagggccaggttctcctgaggaagaacaaggtgaggaacttgttcttctagatactgagattcattatgaagtaaaagtgattaagaccacgtgatatagtcccagcaattgtcaagtggtctaatatgcagaatacagagtccagaagcagactgacacatttatgtcagtttgagaataatacagagcagacactgcagttctgtgggtaaaggatggactaataaatggtgctaggaaaattgaccatccatatggaaaaaatgaattggattctacctcacattattcatgaaataagttccaaatggattacagtctcaaatttgaaagacgatacttaacactcttagaagaaaatgtgggatttcatatgatttctttttttttttattattatgctttaagttttagggtacatgtgcacaatgtgcaggtttgttacatatgtatacatgtgccatgttggtgtgctgcacccattaactcgtcatttaacattaggtatatctcctaatgctatccctccctgctccccccaccccacaacaggcccctatgtgtgatgttccccttcctgtgtccatgtgttctcactgttcaattctcacctatgagtgagaacatgcggtgtttggttttttgtccttgccatagtttgctgagaatgatggtttccagcttcatccatgtccctgcaaaggacatgaactcatcattttttatggctgcatagtattccctggtgtatatgtgccacattttcttaatccactctatcattgttggacatttgggttggttccaagtctttgctattgtgaatagtgctgcaataaacatatgtgtgcatgtgtcttaatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtacctcattgtggttttgatttgcatttctctgatggccagtgatgatgagcattttttcatgtgtcttttggctgcataaatgtcttcttttgagaagtgtctgttcatatccttcgcccactttttgatgaggttgtttgtttttttcttgtaaatttgtttgagttcattgtagattctggatattagccctttgtcagatgagtagattgcaaaaattttcttccattctgtaggttgcctgttcacaaaaattccaaatcgtaaaaaggttggatgaatttgaccacagtaatattaagaaaatctgatcattaaaagacattataaagtaaatggaaagagaaaccgaaagttgaagagggtatttgtagcacgtataactaagaaaaaaatattgttgtccacaataaattaagaactcacataaatcataagaaaaacacaaccaacatagtagaaaaatgggcaaaacgcataagaagttcacaaaagcaggaacctaaacattagtaaacatagacattcaacttcactggcaaaaatcaaacaattggcaaagataaagtgtcacagtaaaatgtgatagccagcacatggaaaaacaggaaaattcayaaaactgtttcattaaaataatttggcattatccattaaaatagaagatgtgaaaatcctatggcccgacaaatttacttcgatgtgtatatatatcctccagaaactcttgtcagtgtataccaaaaggcatattcaaaaacattccatgtagcattgtttgtatagctgcagtaaaaagttaattaattttagttacacctttcaacataatgttaaacaaaccagctaactaaaaaacaatttgcagaatattatatacaattcactaccacgcatctgaagtttaaaagcaagaaagactaatcaatatattctttagggataaatttatggaataactagaagaaaatacaggggttacaactagaaatagagaacagagagggcttcaaaagtaataattttatagtttaggcttgatggaggtacrtggttgtctttttttttttctttcttcatatgagttacatatatggtatacatttttatataaatgttttagactagaaactttaaaataattaaaaggtaagaataagaaaaccacaaaagagtttttaagctaaaaaatatatattagtttaaggtttagtaagaaaataaaaaaggatagcatcagccagacatttatatccataagggtgctcctaaggtcattggactcctccaagaaatcatttcctttgtcctttttgcctttctcttgagccctcaaaatcagcagctcttttcagatacctgtgggtttgaggccaggccagacccctaccaccatatctgatttatttcctgatagagtttgagagtacattaagcattctcttttagcataggaacctagaattttaaaataaggttaaaggcatgattaaagccagaatttattagatggaaagtcattaaaagaaaagtgaatgcttgcactgcattatcaggagagtctcatacaagagcattagatacagagcaatgaggtaattatttcatgctgtcacactgtttagttctaaattggagcctagggaattctagagtagattcagcctttttaaaaatatatatatattttttgcatacagatataatgtaaactttcacaattttcatttttcctgaaaacttattttcaattttgtttaatccccaataaataattttgaccatgaaatattgaattgcactaataattaaagggtgaacattcctggtaaatcactatgggaaattttaatgaacaagccaagtgaatgagaaatcaatatttattgattattttctggtgtatcattaaggccaaaatctgtcctcttacttaaaaagcaaagcacctaaattgcctgtctagttttgtgcaagttttgaatctgactacttgtaaactattaaaacttttgttgccaaatcagtgagacattctaaaggaggtattcagttgcaaattgacagctctgcttcattcatatttctcactgcatcttcataagttcgtagaatccaccagacccttcagtcatactgagttataaaatagtactgggagatatctaggccaggcacggtggctcatgcctgtcttcccagcactttgggaggccaaggcgggtggatcacctgaggtcaggagttcaagaccagcctggccaacatggggaaaccctgtctctactaaaaatacaaaaattagctgggcctggtggtgggcacctgtaatcccagctactcgggaggctgagatgggagaatcacctgaacccgggaggcggaggttgcagtgaaccaagatagtgcccctacactccagcctgggacagagcaagactctgactcaaaaaaaaaaaaaaaaaagttgcttcaagaggaaacacaatgttactttgtcagaatgagctttaacttagtaattttctgttcattttaggaaaagtgggctactttgttttggcttttgaattttacttgcttttaatagaacaagatacattatgatcttttataagtaaagatcattttaacccaaatgtgagtaatttcttttcaaggaaacttcagaagactactgtattccaaattatttcttatattgatatatggtctgattcaccatgatatatacatattatggtctggttcacctggttcaccatgaaattctaattatagattaaataataaccatatagctatgctaagataaaattgactaggctaggatatcagggtagagggatctaaaagtatgaaggagaagatgctacccagtgtggtttgtatatgaagtgttgccctgggctcctacattgttttcaaggtgggtcacagtgttcacgtaagatatctaatagccaagagggaaacatgaccagtcacagaggttgaagcatctgtaaagttaaaactgaacagatgaacagttatttagtaccagaaaattctgctctgtgtatggttctgaaaattgtgccaaccatattatttcagcaattagagtatcaggtccatcaggttatgactgagttcctttaagtagacatgaaataattctgttttaatactatacagtaatcatgtctaagacctataaggaataaatccacttacaaggaaactaaagaaacattagaacataggtataccaaaaaacactgttgcttgtgagtttttgatgacactaagggtttttttttgaacattgaaaaggtcattcaggtattaatttttggttttaagttaatgtttgatttactcaagtgacattatcaaaaacctaattctttaaatcttttaatttgttgaaagtcactgttgagggatttttattatttatttacaaactttattacaaactatttccaagcttaactaatgaaacacctataaaaatttaacgatacatttacaaatttgatatattccattttctattaaagtactattaagtactattactaggagactgacagtctttgcaagtacttaaaaaattcttatacatctattatattacacttccaaggattgtgaaccttcagttttcttacattttctaatgctttacataacaaaatcttcccatgattgaaagatgctttcctttttagggaaataactatcatctcaggtaactgagtttactttctgtaagaggcctacaatctgaattcttcctgtactaatcaaggatgctattgtatcacaatatgtaatgggagggtgtctacttagcatgcttggggttacctaatatccatagattttgattgagaaactgattagattcttgtaggcaaccctgagtgaaaacacagaatcttgcttattgttgccatgtcaaagacactacaatatcaatgtcaagaaaaagacattcacatatcctagctcccatgacccagcttatccacatgatgtcatagttctactcatagatgcctgcagtccccaactagtttgtcatttgattacatttttgtatttccctggcttttaggttatgcagatctcttttccatcagaatctaaagacatctgacactgaaagaaccctgagatatttaaatgcctttccctgtggtctaaatctaaattccatatcctttcatagtctagaatcaagcaactcttacaagtgtttcaaatgatatttgatagcagttaggacatttcctatagttttttctgactggtagtcactgcctttccaggtagtctagcggtattactgaagagttgtttctgagatatggataacagaatttaagcctctctgtccactgagaacaggagtgtaggctgatcataaactgaagaagggtatattagatatcagattgcaccagagaagcactacactaacaaataaccaacttacattttgaaggctatacagatagttttgagattgcatgtattgacaaaaaaactgaaaaagggatttcttaatattctttcaatgattagcaaattaaatgtatagctcatacaacaaaagttcagacctagttagaagattagaaaatagcaataatcttctgcttgttctggaactgttgaaagatacccttcctccataaccgtgtctaattcagtacatcttccccatacaatactaaaatgaagtaataactgaaagctaagccatagaccttaggccaaattatctggcagttagtaaggtagcaagccaggcagacaatcaccacagatgtaatgaaagagcagccttctctcatggggaagactgatagtcatgcagattttgacaaagttccctgggcttatatcaacatgtggagatactgagtcctaggacaccagatctaattaaattaaaatagaattaaggtgcctttaagagaaaatatactaaatatatgtttttctctatttttattcattttaactacgcaagtaatacataaatgtaaacaattacataatacaaaatataataccaaatttttaaacattgcaaataagattaaagtaccctttgaccaacatctcctaatctaataccttctttgtaagtaagcactatatcagtaggaagtatatctttccagtttgttgttgttgttgctgttgttgttgttgttgttgttttgagacggagtcttgctctgtcacccatgctggagtgcagtggcccgatcttggctcactgcaacctgcctcctgagttcaagtgattcacctgcctgagtagctgggattacaggtgcacgccatcacacctggctaatttttgtatttttagtagagacagggtttcaccatgttgttgaactcctgacctcatgatctgcccacctcggcctcccaragtgctgagattacaggcatggcatgagccactgtacccggcctctttccagtttttctatgcaactatatgcatatgtttaccactagaaaatgtattttgtgttaatgttttctaaatattttaaatgagtgtacatgttattctgcaacttgctttacccacttaacatcttgctaatctctttataaagatatttattgagtgcttattacataccactcttctaagcacttttatatctattaatgcatatataatcttcatagcaatacagttattatgttttgttatcatgactgttttgcaattgaggatcctgagggacagaggttagataaattgcccartttaatgggacagccgcttgttctgaattctattcaaggaacaactccaggtctactctcatggtaactgttttacactgcctctctgagatacataaacttacctcctgaaggcaattatctattaacccaaaccccagtgggcccaccttttatgaacttgcagtggctgcaaatgatatgcagatactgttcaagttttaaaatgccaccaagtgcctcatgatgctcagcacctccattggtaatagcacaggcgaggcagtgtgatggcatgaagtatggctgtttctgagtgggttagtgcacgtaactgcggagcagaccccattgttatgctgctccattcccctagttccctcgctgcctgtatctgatctgtgggcagcattccacttacgtcaaaaataacgtcaatctagtgaaaaaaactgtatgactcacagtattactgtagggaactggtctctgtgtaatatgatatatagcatcctaatttcwtagagcatttttcataacagctgctaaaatcatcaaatccattaaattcttttaaaggatccaatttgtagcagtattgaaaatagtcttaaaatgcaggtatagaggtggagtctctctcactcaaaactgctctgtcattagctacttcatatcttctgtgtatttatctgtctgtatttattgattcacctcagtcttctcctgttctgtatttctagctgcattgcgtcagaggtaggctatttcagagactggagggtctgagaaaaatggaagataagaaagcagaggaggaaaaggaaattttccgctgacccttatggacaacagaacaaggcacactggagaaacgaggaaaagaaagaactgaggtcttgggcttatgaaagcagtgtaatattattgactaaaatatctgtagagaacgaatgacagtgagagaaatggccacttaagcctttacatctagcagcacataacttagaaacactgagccagttggatttcccctgccacactgccatccacaaaactgacagctatttttctttgtaagaattttattcttggatatatgtaaagccaaaaaaaatccctcagtgttgggggtttttgtttcctctgatgctatatgcttctgcaagtttgcaaagttagcccttgacatgtgcttttgttgggaacataaagtaagaccaaaaagaggactcaaagaaggcagaagaatgtgaagtttacttccagacttgagattgaccttccagaaggagaataggcttctgaagcctgagctctattcactctctgtcacagattaactgtgtggtrcaagttaatacacaaattgaccttctttaagcctcagttttcttatatgagaaataagctgggaccagaatcccaaggttattttgagttgtaatattaggatttttgtattacatgatggaaaaagatagcatgtgatggtcagtcacccttctagttacccagcagcataaatcttatacacattttccttccgtgtacacacgtgtcctctaatactgttaagggagacatattgcatgtagtgtctttggtaggtgcttcttgtggacagtattccttccagcttccttctggtgtaaatgctattaaggcgaaagttttcaacttcatcctatttttctggttcttttaaaaaattatttttagaatggaatataaattactgatttgtaatccatgaatcactgcaataaagtagctctgtgatatttgctttcagaccttcaaaaattgttaactgcatacaatgtgttgttggctacttaggtaccggatataaggcacaactttttagattccagctaacagcatcataaatagatataattttatgtgtgtgctcaagcagtttgcacctagtcagctaatgttaaagcagatacaccagattgccatttttgggttgtctgacacaagcaccaggcaaattattgaatagtaatagagcaaggagtcccagagtaaattttctgcactattaaaacctgctaataagtagttctgattttctctcacttatatttgttcagcttccattgatggagtacctattgtagtcctggatattgggttccataccagatcctcagggccagcattctactgcaaaaggaaccatgtttacaaaagtggagtgagattcttccttgggtctttttgtcacttagtagccaaagctgttattaaaccaaccagaccaaaataaaaaatcatccaggaagtaatttattctatacttttcaacatgtcatcctttttttttatcatgttatctaacatatagggaagattaattataatattttagatggagcctattggagaaatgagtttcctagactagtcacgtcatatatgattttataacccaaaacaccaaactctaatggcattaaaatcttgcaatgggaggtttatcaacactagctaaatcatagtggatagcctagtagcctggaaatcaagacactagagtaatcatggtagcgcattaattagttatgtaaatgagggcatgctactcaagttctctgagcttcaggagagaaaaaaaatacttgattggtayctcatggggctgttgtaaggaacaaatgagatagagtatgtggcatgatttgtattatagagcatacaatccaaatatgagctagataaggcataaaacgtgcaagtactacatacagtgtttctaattatattacagctttcatctaygtggtgttccacattttatatttaagcaagagcttataagattgactctctcccagttatcacaactaatgaactcttaatgggcagctacaaatatagattttatcggaaggaggaaattaaagtgatcaaggaattattttttctcccctgacatgtaaaaagtaaagagactgctaattagaaaatatttagctgttctttataagtacctgaatggtctgaattttctgagtattcattcttcattcagatataggaaatgaaaagtcaaaaccttctctaaatattgtcattcaatggatgtatctcctgggcaaaaatgtagttaattttgtttgttagagccatatactaagtgctaggtttcatagacaagaggcacaaactgaggtgcttccttgctttggttttgtagtatagcatatttagagcacatctagaataatgctgtaaaaaggaattgcctgagctaataatattataagaaattgtttattctgttaatacaagtacataattttctgcaactcagttatttgcactcaattattaactccttgaacatgacttcagctaatgactgccactctgaagagataaaataggattaatgatcaaactcctttatttctaaggagtgattacatatgcaaatgaaaggagtagtagcatttcaaataagttccaccagagagtacttttccttaaccaatatccaggtatgttaatgggtacctttcctttagaatgttaacttcggggtcctaacttaaaatctaggtagcaaaattaaaggtggtaagagccaggctaaagaggactaattgaattctctctgtggcctttgctgttaatagttcattttctttgtgtcccactttactctctttttcttttagcctttttatttaaagacttaagtatttacccttcgaaaatcagtgtcgtttctggtggggagagaaggtattcacagagatgagtcagaggcacatacaaataacttgtaatacaaagttagatgttaatgaaagaaaaggaaatgtttatcctacctcatccacaatactagtaaactaagtacttacgattttttaactgtttgtttcttcatttgtgtagccagaccttgtttcttttccccagctatcgtcaatttgctgattaggtaaattcctcactggtctttctacaggtttcaaaaaggaacaaggtagattttcagaaactgttttgggttgaaaattatatattaaaatgaaaatgatatagtacctgaagactgctagtaaattttgctacagtaaatttatgatagttaccttctgttgcctgtagttgaactggaaacctgactttgtaggttttttgtccttggtttctaagatctgtcaacttttgatataccctcctctatatctttggtcatctaacttcccaacatgcatacacataaatagtaaatacaaattagtgatttttataattatattgcaggaaggttgtatgcttttcggatgttggatttttatagcgccttcatcatctttagtgttggtttcttcctttgactttgtatatttctcctaagccccactgatttcttggttatttcttggttacaggctgtcatggtggtcacctgatccttacctgatgttactggttaccttgagattttatcagtgtctgygrtctcttcatcagttctctccaaaggtttctctcactgattatctttcaatattcttagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaaggtgagcacccttgaccgtttcctgatttgtactgttggagtatatcattgttcctacagcttattgaagattatgatttttctgcaaacagagtctatgtcctagttggtaagcagctagaatagttcacgtctttgtctcctgaattctttatattgttgtaattcaaaatattttgtctattcattcagtgaactaaccaagagcattatcygtattgtcatatttcatgatggtgcttttgatattcagctattggttttacttagtgggaaataatgaacgtacaagtaattgtttctgtaggtcttaggtatatgtattagtgacgatgttaatatggtgaattggtatgaaccatgcattctcatctgtaaatcaacaaaaactggttttcatggggattcactaataaaaggttggtcttatttcaaagtaagtattgcatagaactgatactcagtggcataaccttccttataatctcttataccaacagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggkgcctctstcctctatgtggggagacacttcactgttttctacttcaaagtctgatcatgatgtggaagaatctccttgccatcaccaaaccaccaacaagaaaatattacvagaaaaaggtattgttaatttctttttctgacttcataacacctcagcttgtacagtataaaaatgactttttctcataatcataagtcatttgttttctcatagctaataattaatattaatttctttttatattatagaataagagaaacaacccctscatgtattttactttaatttagttttatcttttcctatctggttcagtatttttatctcttcagctctctataagtttactactcaagggagttcttcaggggagtggggcagcccagagtttcaacaaacactaacacagtcataaagaaaaaaacactacatagtcatatagaaaaatatagagcgattttgtagaatagcagcccagagtttcagtaaacactaacgtagtcatataggaaaaaaagacgaagatcaaagtaacacaggcatataattgatacttaataatgttcttggatgaattgctaatatacctctccacgtaaccagtgcagatcttctagaagagggataatcaaccgaatgtagtctccacctgcttttgtaaatgaagtcttatgggagtacagtcacacttttttacttacatactatctattttcatgctacagtagcagtgttgagtcgttgtgacagagactgtgtatctcacaaacctaaaatattttactctgtggcccctgaaaggtaaagaaagcttcctgwtgcctggtctagaagtatattttcttatactcaaaattgctggataaactctgaaaatggcttcatcattggttgccatttatctagaatttttaaaaagtgttatacctttacttttggtctatcaagttaccacaaagatgattaattacagccatgtttgattgcaggcttgaggataaggctctggttaccctaacaggagttggcgattttctgaattgtgtcaataccacatttacaaatcattttttttcatatctgagggacatcagtggaaattrggatggagaagtcccattataactggctaaatgataagcatctaacggaatatcaaattagargaagtaaaagatttttttctagagatttgtaaaacaggttatatgccagtagaaggcatgaaaatattttcctcgttcctgttatataaacaacctaatactaaagttttggtcccgargcttacatagcactgggcctttgttcagtcaagattaaataaagtaaattgaacactatcaattttctactcacaattactagagattattattctaattttttgtgtggttaataacacattatttgacccagaagatgtgttcaaaaatattcattgaattaatgtctagtaaatagaaactggcttttttaaagctttacaggatttattgcttattaaaagcattgggcctctgcaagtatagatagagtacaattatatcaacgctcagaagagagagagattgcrtccagctgaggttggtaaacaaaacctatccaaggaagtacaattagaatagccatcaaagcacttaagggaaaaaaagggtaggtaaggagggaatagcgggtaaagtgatgtcattaacagagacaggcacatatcatatgatttaaaggtacaaggctatcccagcctggctgtagcagtttgcttatgcagggtggagtagttacacacaaaagtgagccagtaggttaagtatatagctttagaagttaaacatcttagataacttgccatattactaggaaaccacaagaagtttgaccagaggaataaaaaggaaaagacaccaccaggtatggagaagctgagttaggagaccctatgaggtggtgccctctaaagagragcagtagacartgacaggaaagaatgattcaaggacccttgagacataccttgactaggtaacaggtaagaaagtgaggcaaaactatcatgggcttcacgcctcagaacatatggtcttgtcattaacagaaaataggaaatcagcaacatgatgggggaaataggattaactcatttttttaacagaggaggtcatgagcgcaagagagaggtcaggactgccaggtagatttgggagtccccattataaaggaagagatagtcaagtatcttattacagtgagattaaggagatgcagtccagtrcaagaccttaggatttggccatcaggagatcatttattatttgaaaatgaaaaccaggttgccacagcttaaagttgaggcacccaatctgggggctcagatgtataattggtcacaaaggtagtattggagagattttaaaaagcctaacagaagtcttacgtagagctaaataaacaaaatgtatgtttcttttttcctgaaatcataccaatctaatgttggattttatgcagactagaagttctagtgtgcattaaagatggatttaatcgattttaaatgggaaagtacattattccttattcttaacatcttcagccctatggaagcattcatttcagtgttcctgggaacgcactttggcaaatgtgtgagataaagatgtaaggttgcctagcaccaagctctgtgataggcagaatcaggcttttagtcgcrtgatgtccaaataactgcaacactcatgggttacagagtgttttcgtgtacattgcctcagctggtcttctcagcgctcattgtaacatctcccagctacctytcattcaggaaataattaggcagtctccttttaactttgcatagtcctagccattaagagttgctttaggattgatctggaagaatttggcactttcttttcttcagcttctattaagaaaatttaaatcttgcttttaaaaataaaatccattagtaaaatcaccttagaaggtgtttgtgccatgtctatgtctatggatttttttatatgattgtgtcacatctgtgacaattcagttacccaaagagtaatgatgcaaatatgcataataaatatttgaggcttgaagtggatttttgacacagacatatttctgactcttgtgtttcattatgtacatttcagtgagttgcttattgtaatctaagtatcattaactaaaaatatgaaaagctcattgctaaaaacatttggagtatttgtcagtgtcctgtgctgcttgagagctttgaacctagactgctatccatgaactgtgtgtgtacttcatgttttttaaaggtgtatgtcgatgtgtgttgagaaatttctcttgaagtaaacaaaaatcatgagcaacattaacctgcaaagttaattgaacacttttttaagagggccattctctttgccttccatactagaaagttcctagaaatttaaaacacattttaaaagataagagacagaaaaacagataccaaaaaagaactggggaggaagagtttcacacataaaaaacatcaaatttaaaacagcatttgttaatcatctgagctaattggatatgctgaaacgtgatgccgatcagtaccctctgctgaatagtttgggtagagcctgtccgagatggaacaagtgccaccagtggaattggttcccaccttgacattgaactccatttgcaaagcctgtcttcctattggcttttggtatcatttcgagggtccccattccccagcagctgctacctttgagagtcctagaggcaaagatcagtctgctctgaacactgaggagattttggcatcttccacattaaggggaaccagccaagttttgctgtaacctaactattaagaaggccctttcaaagatataaatgttttgtagctgagcccctgtttaaggagtctcccccatgtccycccctcctctgttccaggaccggccacaggccattagcaaaggagagccagagaagaaaactttgactctgactttccccctaaatctcccagactctcagaggtgatattctgcgctgggctttggagatacgggagaagtgggctatgttcctgttagaaggcactacaaccccaaggcaagaaaggaatggaggacagagcccaggcacttgaagccaagaatttggagccagagaaggaacaaaagtcatgttggtccctacttcgaatgcagaggatgatttgagagtatttattctcccttgttcattcccatgcagttgaagctaaaactctttgtgatgaatgttgagcctctgtcctatagaggacctcccctgcttaacygmragttcctcaatgtaactgtgtctcctaggtcgtataagaaggcattgattatttattttacaattaggaatttaggcaaagcccttagattcagagaygcattgacttttgaattgtgactttaaaaataataataattgatctttttcacaaatgtgtatatcctagatgatgccaaagatcccaaatcactaagggcatccagttcattggcggtgcaaggaggaaaaattaagcggaagtttgtggatctggggtaagcacttcacgatgtaaaaagaaagccctctgtaaaaggaggattgaaagagaaaatttcagcttcccctttctgactgcttactatcattacagggcgcctttgcgaaggaattccarcaagggaaagaagtggaaagaaaaagaaaaagaagccagtaggttttctgcaggtagcaggtacggttgtgtgattaagaacacgtgtatttctatacctaaactttctggccccctcttctattgttaaccaaaatcagtggtcagtatctttgagctaaagtgatatgccaagaattgagatggaagaaaaattgcacaattagtttatattggtcttactccaattatrgcctccatctagccttgggcatatccattggttcttaattgcagaattatggccacatgaaccatttcaataagtgtttatctaaattcagcacaaatatatctatgtgatacttcagaaatatcaaatatatttatgtgatacttcagattttttgcctggctacccacaatgctagtgcattgtattaagtctaaaaggataatcattttgcatttaagtaccttgttgacattcaagattgtcttgtccacatgtatgtaggagtgaccaccatcttttgctgcacttggctatttaattgattttgtgggcactgtcaactatgcttagtcttcagtaaagaccttcccataaagagcgagctttgaacagcatgttatcaaattttcccagttgttttctgagattatataattttaagctgagatttgtatagggagtcagtaaagcatcaagctctgaagcccagctgcctggatttgaatcatggctctcctacttataacttttaaatcttgggcaagtgagttaccctctgtgccttcatttcctcatgtaaaatgagagtaataacagtaccttttacataaggtcagtgtaaggattcaatgagttttcatgtaaaacatttaaaatgatacttggcatgtaggaggtattcaaagaataataaagataacaatttgctgctattgccattactgttaccttattattatttgcaagttacaaagtagttttatatttatcatttcatttgatccttataggattgagaggatggcaaggcttggtggcccacacctgtaatcccagcactttgggaggccaaggcgggtggatcacctgaggtcaggagtttgagaccagcccggccaacatggcgaaaccccgtctctaccaaaaatacaaaaattagccaggcgtggtggcgcacacctgtaatcccagctactcgggaggctgaggcaggagaattgcttgaacccgggaggcggaggtttgagtgagccaagatcgcaccactgcactcctgggcgatagagcgagactccgtctcaaaaaaaaaaaaaaaaaaagattgggagagtagataataataccatactttattgatgaagaactttaccttcatagaatttaattgatttgcccagggttatgcagcaggcagttaatgtcaacctggggcttgctcctcctgtgtagatgtttttccawcatactatgccaccttcagttacttatgcatctaatgatgcttaaatttctttataaaatttggaaataatctcaatatcatagactaaggaagaaacacactaaaaataaaatactataaaatcatgcaaggaccacttctccacttcatgggttgtccactgctgtttacttttcttttttctcttttctgacatataccttggtgagaaattgtaccttcttcttggaattaaaggagcattaaaggagcataatgggcgggagatgaggagagagaattcccaaattaattatctttgttagtgtggctttcctttatactgtacattggaaaagggtagaatgctctcagaatgaggacaacaatctcaggaaaataaaggtaaatctgaggctatatgcatctcgaaagtagtttaactttgtgtggttcgggagtgagaatgatccactttgtgtgttaaaattaagaatagaaaaataaaatcaaacatactcatggaaaaaaacaaataatgaaaccgtttaggggagaaagagatgcataaatacatgatgggagagaaactcagatactgaaaatgacactgtccttcctttggtctctgggctttgaagacagtcactccctctcatctttgaggcaccacctgagagggatgtgagcacctgcagccagaaagggggagggtgtttgatggaattttgccatagtagccagagatgattcacctccttgtataaatcacaaatgaaagtcaagccaatcttgattgtgttggtgagtgcctgcccacctcactataggcaaaaccacagcttgtcaagggcaggtggccatcagcacactgcttcaccacagtcgatgcctgctttgaacccacagctagacttctagattggctgcctcrccaccactgtatttttaaaactctggagtccccctgattcagcagtcagaaattattgtacacatacccacactacaaactagtttctaattagaatcatgattttgatcttttgtagttcctaagtgtgatgattgggtgttcacaggcatgtgtgagatggcctccctcaaaccttgttatgacattggcatacccaaaaaaaataaaatcatagttttataattattagtaattatagtagaattttggcaggatggaaaggaattcatataattggaatagaagaacaaggaaagaagaaggacacttttctcttgcaagaaaaaaaattttgagctgctatagtaattggttaacactaataaaatctgtggacagctatattcttctgtatagattgataatgggtacagaaccttataaaacctatcccaggaagaacagaattgctgcccagtaggagcttaatgcaattgagttggattctcagggtcctgaaagtctgtgggctgtaagcaccatcagctgcagggtcgcactatgattgtagtgggcaactgggaatacactcaccaaccctgggagacttcctcagaaaaaggagggaaggatccttggactgagtaatgttatctttttgaagcatttcatccaattcttattaggctaagattctgataagatcattggtcagctataacctatggctgttagattttaaagaggcaagactttcactatttggtcttggttttagttttttcctctctataaagagtttaccttgttgtgtttctgtggatacataatgactcagatacatgcgcgacatgagacaactagagaaaatggatgaggctaataataataaacaaataaacccaacaaagaaatatgacttggttccatcccttttcaaatatgtgctcagtggcattgtctttttgtttgtttgtttgtttgtttgagacagtgtctcactctgttgcccaggctggaggactrtggcacaatcacagctcattgcagccttgacctcctgggctcaagtgatcctctcagctcagccttctgagtacctgggactacaggtgtgtgccaccatgtccagcttaaaaaaaaaattgtagaggtggggtcttgctatgttgcccaggctgttgttgaactcctgggctcaagcagttctcccacctcagcttcccaaagtgctgggattrtaggcacaagccactacacccagccaacattctgattttaaacaggcagcatagcagataacaaaagcaggaaacatttagttgtcagagcttgttcaccccttaaaatgtataccaaagggtaaaataaaatcctattctgtattctggagtaagtagccactgatgtcagtggagcatctactttggagctctgtagataagtttccagtgtagtcacggaatggaaaactctgtgagatgtgtgtatctcagatggggagatgtgtgtatctcagatggggctaggtgatagtatgttgagaaaatgataaggaaaggagatggcagtcttctatggaaatgaatttgcattcaagtagaaagtgtgaacaacagaaacaacactgagctggaatccaaggtagtagtccttacttttccattaggcaagtctctgaattcctgggaccttggtttcctaccaaaaaataagtggattgggctracactgcatggctctgacttcccattcacctctgcgtacactgtccagtatggttgcctctagtcagataaggctagtctatattgggatatgtgtaggagaataatgaatgctggactcaaagacttagtatgaacaaaaagaacataaaatatcttcataatattataatattgattacatgtcaaaataatattttgggtttggagggtaaataaaatgtattattgttaaaattattttacctctttttttcccatggtgctactagaaaattttagtttacaatgtggttcatttatatttctttttggatagtgttgatctgtaggattccatgaaaaacaaatcttcctttaatttctaccccattattcagttggtctattcatttattgtttattttcttatttatattctactcctcgttattccaaaataatttgtttacatacaaaagtacatatgctacaacaatataatttattaaaaagtaaattgaatagggaaaagttagattaaaaagtaagtaaaattgttacttaaaatacaacatcttcaataacatcttcatagtaagtataagagtgaccttccagtgaaagccaaaaacacaatgtcaatatggttaaaagcctgggttgaaatcccaactctgccacttacttcttggacaggtttcttaacctttctgtacctcagttttctcatctgtaaaatggagacatagacacacacacacacacccgcccctcacatacttcttcatgttattaggaggattaagatggtcacattgaagtacatttcaaatccttaaataaaaatgtctattgttatcattgtttattaaagcaggtttgatgggaaggatacaaaatgacattcttcttgcgtattttgctggcagtcttgttcatccaaggatgacttttgttatatcttgaagaatgaatgggctatatggattatacttcaggctgtacttcataggctatttctctcaaagaggctttagataaatcatggcatgacagtgagtttgaaattatatcctatgacaagtacctggagggtccactctgcccctgttgctgagtaagagcaaaacccctgcttaagaatcatctgagctggctggaaacacaccttttagaagaattgatggagatgagcacatgtgtgtgagtagaaaaacaccccatctctgcctaagcctggcccagtgaatgtagtcattttcatggagacctttgaataatgtcagcttagccctagtagatcggacttattccccataactgtctagcccatttttagctgcatttatcaatttaatattcagttttctttttaagtacagtatttcaaatgcctgaagcctgacaaayttacattcttaacaggcaaacacttttccatacttaaaaaagctcttgaaaatctaataagttactgtttaactgtagtgactctaaacgtcccaatatagttatcaaagtgcttaatatattgtgtgtttgttaaaaactcaaatttaaaatgagtttagatcattaaaatgagtttaacattttaaggtagaatcagtggacacatttctctttcagatttctattcatacaaattttcttaaacacctaagcaatatatctgttattcttaaacttagcatttakattttgatagtatggattttatttacgtgatcctcttctatttcattttaaacccctccagtatggggaagactcattaagggaatagtttcaccatctcgaatgattcagagttgaacactacagtgaccatctcagatgaactattattgattagatcagaactcaggatctgggagcaggatatgtctgagtagggggcgggggttggccctgagctttagatggacatgtttctcacagctgttatccattagggtctctagatcccatttagatgaggctagctttacaacctcaaactccttggtggatrttagaaccttatagaattacttcattcgatttaggtaaatacaagtctgcaatcttcctctggttgcaactaattttcttcaattaacttcttttactcctgggcttaaattctgtatttcttttatacttcatctgttctggcagtttctgaactcttaatgataytttgatgacatccagttagatgctgaatacttcacacacctgtattcaaagttagaatgacaacaacaaagatcaccttggaatgtttagctggcaatttaattttgggatgccagccccaggatacactggattcaagatatatgtaaatgagttcattacttataagagatattacataaaccatttaaatgccaggaaacagctacctctgaaatggtatctttggattatgargacgaatttgaagccattctttctcccagttcctaggagtgacttatgattctcttttttccaaaaatgatagcaagccagtaaattatagctaaaaaagaaggtgaagggaatatagactatctacctattttgatccactggaaaaattattttcagattcatcaagagttcatttctaccaatctcgattttggggagaaaggaaggtgaaaaggaaagaaaaggaaggaacgaggaggagaagaagaaagggagggaggaagcaaataagaaaggaaagaaggattttatgttattcctaatggatttctccacaaagtgaaatagactataagagtggtcaacrtggaataactgctgccaaaccctttctgcttctattgtgggcccaagagttcaatttattcagaaggaaattgacatttattttagaaagcatgtctgctaagctgataggtctgtaattttaaagcaaaaatttcgttttttaaatgaatgttctctaggtccgagaaatgaaagcataccactcactgttcagttctttaaggatactagcaagtacccaggggttacatcagttcatggggttttaaaatcacagatactcacagaggaatgagagatacaggatacarcttcagcaggggcacagccaagcytcatgggaaactgaaaaatattcttcaaaatatccctgaatctggtgatttgccactgtagagacgtaggtgtcttctcggaagtggcctctcattgccttctgcctggctcttcctccttcctgtctattacttggtgtgcaaagctagggaaaggaagcctctgggtatcaccagaggcccagcttctgtgrtctccttcaccgcacatgtaagaaccacatggcctcaagaccctcctcagtgctggatgcacaggtccatgtggaattattagtcttgaatatttttctgacagtgaaaatgttgtgagagagtttaattagatgtgaccttcagatttttttcttttcaaatgttgcttggacaggatttggactaccaaaagtccttttcaactaaagcaatggaatgaccacaagtagaaaacaattcttattttgtccctatttgcttttaaaggtaatagtgattgttctaaaagcattgttacaaaggctgttcactgggagtaggacaagattgtcatgctgtcattaatcatggcctatttataaactttaaaacaatatccatatatttaagcactactatattttattgaaaattgtggatgaactcatttaaaaattcccttgattcagaaatctataaccagaggagataatgatcatccggtccagtttttcctcagagatacccaattataagagtatgggactgcagagaaaatatttatatgtttctacacagytagagctttctaggcatttttactagaatgtgsaacctaagctaaaaaacaagcctcagaaaataaattatgaggctgagtgttgtgattcacacctgtaatcgcagcactttgggaggccaaggcaggaggtcaatagcataataaacccctatctctacaaaaaataaaaaagttagccaggcacrgtggcacacgcctataagtcctagctactctggaagctgaggtgtgaagattgcttgagcccaggaggtccaggctgcagggagccatgactgtgccactgcactctagcctgggttacagagcgagaccctgtctcaaaaaaaagaaaacagaagttgaattgtgggtgcatagatagtgagaactccagagagattgacctctgcagaggtaatgtggttacattttaaggaggctaagtggaagagggggatgagaccatctccatggagacattcctagagttgtaaagctggagccactagtcatatctttccctagagacacatgtttacatcccaaagggtcagagcccaagatccttcccaagttgaatttacattaaggagataagatttctccctccaccctccccagaggctgcagaggggacagctttccctctcctrtataatcaaccagattcatgtttttggagttcctcacctagagtgtagaccatgtgtaggatgacatctggttcccccagcatgctgatctcaatattttatcagaacctcactgacttcttcattctcttcagttatcagccttataatccctttacatttgtatcttgctttacagtttacaagatgcttttacatttatgtcccagtcgatcctcacaataatatttgcaaataaatgggaattgttaggtgttatactatttatataaactggaaatatatttcaaaatatatttgaaatgagatgtaagaagactgaaattcagtatacatgtggtgggacagaagttgtctggctgtggtgtccaggcacttttaattgaaagggaatctctgtgttatcgtggtatcagcagctatcaaataataggcattccatcaaacrgcaagggtgacctcttccaagatgcacataaactgctgcctgttcctactttggtttctgatagttattttttctcttaaccaaaagataattacagatatgaaagaacctacattaagacaaaaaaatctgttttcaaactgcgttcttcaaatgcctttgaatcctttaaatgttaaacaataaacatagaccattgacaatttgtaagcactttcacatatctcatttaattcttaacaaacacatatgagatacataaaaatatccactttttacagatggagaactaaaagccgagagaaggcctgagaccatgtacttaggaggtggtaaaccctggccctccaagtgggagatgaggacttcagatctcctacgcctcctgtgaaaaggcactaagattctggtgaaaaaccaataaactacgtgttccacctaaagtattttgaaccctgaaatttcaaaattatttaaatatatcattttcttaagtctcagacccttcggaacacaagtccagaggaagacaggaaagaatgctgcttatgagctaatgtccctagctgtgaggcatgtcacccagataaagggaatgcagtgatgattaacctaatagcagttcctaaaagactgtgcccctccctgattataattcatctacgtacacttattaggcacattttataaaaattcaccatggcaatagcaatacgaaaatgttgatcattgtcacagaatccatttagaggcaaaaagataactattaagattagtgttgtagtcaaaagtgcaaactttttactctgttgaatagaacagtttctcaaattgttacttcaaactatattcagagtccttgggttcagtaggtcttttatccgccctttctttatctaacacacccattcttttcacaaaacaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaaggtagaaaacacatggattacaaaagcaaacaagagaaacccaaatccctcctcttcttcaatctttggaaggcattctcaacttatgtctgtagtctggatccaagaaaccaatgtaataacactgcaataaacaatgcatggtatttcttatgtggggaaaagaaagcctcatttaactaccaccttctttaatgctgtttcattgtagattgtacattactctttgatttgcctatcttttcacatattgctatttaatctcagtttgacagttaagccatgctgggaaagatgcatttgaatcatagaacagaatgatagatctgtttacccagtattctactttaaattacattactaaactatttcactgtgcttctcaagatttactgaaaagcaaataaatttgggactgaatacgagttcagtacatctaagtgaaactctttaaaacaaaccaatgatgacatagcatccttatttatttcttcttttaatgtcaaacttctgtgttgaacaactgctgtataattctatcaccaaagttcttcaacagaattaggaaatatatgcatgggtgttacttgtttttaaatgcatgatggttatttccagcatgacactgcaaaccttatctaacattttattgaaacacatatggtggctaactttcacaygttgtttggtctccttttatctgtgttcgcttttctttctcaaacagaaacgtgattaatgttacttgaatttaattcttttcagtttcaatttaaatcttttcaacagctcaaagggttttgactggggtaccaaatggtaatgttcatgttaaatgtcctgctgcttaaatgttctgctggcctagctccatgtgctctaacctagacttcttttctgaagttttagcaaactttggagtttgttcggtactgaattctccagcctctggcatggtatttatttttgataaccaactaaacccagtataagggaacctagtggaaatctaacagtccaattcctaaggaaatgcaatagaaacaagatggtgttggtcaagtgcttagagttcctggaaatccatccattttagaattactagcaaaagaagttttgatagcagcacatcactttggtcttgaaacattttcagtattggatctgaggcatctaaatgcaattcgaagaattctgccattatcttgcactgtagagactccagatttggttaaaaatgtttttacaagtgcagctacgtagtcattgttgtttgattttcatatccactgaatattttaatgaagttctggggaagttttatttacaygctcccacctcccccacccccaggtgattatttggaaacctgtgtctgtgctgtgtggcagcctctctgatgctctgcgggtgcagtgagagagttgtatttcagcatgtaactactagtgtattgtcaggctgtgacctyccccagaactcatcatcttgaagggtacatccaggagaggatctgccatttctcatagtatttatcacagccaacaataagcgatccttcccaggaggtgctctagctacctttctaatatgaattgccatctgttcctaataactcagcctctccacaccatcttgtatttttacttacactgttactcatcacgattagggtcaaagaagataggcttattaatattattcctctgagcagttgcaraggataatgaattctgtacccttgaagagcaattgaagaattgtctctctaaaacatctatcctttcatcacatggagaaagcacccagaattccctcaaccagacaaggtgcagcattctcaaccgctgccccattgaaggtcatcaccaaatcatacatgaatttctgctaagattgtttaaaagagcccttttagagcttgtagacacacctacctcttgctcactcactgcactcatttaacactgagcttcatttatttttacagaattttaccttcaatgatgacttcagtcccagcagtaccagttcagcagacctcagcggcttaggagcagaacctaaaacaccagggctctctcagtccttagcactgtcatcagatgaggtaattccatggcactatgacagagctgctttgtcaaatctgacgttttacccatgaaccatcaccaggaaaatgtttttagggtagatattgcatagaaatcatcaggactgtggtttatgtttaatttgaagtcttcatgatttctctccctccctttctcaacagaaaagcaaagtcttgttcttaagctttccaggggccccttttacacgtatatgtaaacacacatgatggggaggctgggcagtgcagagttaaacatgggggaacagctcagaaatcacatagaagtttcctaattactcctttctttttttccttgcctcccctgacarccacactcactccaagattctgatactgcctctgattagggtgaggtctctgattgagaatcaatagttttgataaagagggaaaatagcatgagaaccatttatttaaaaacaagggtcaaaattagtattgctacaaattatcaggagataaatgtgtacaagagagtcaggaaatgaggttagtgatttagttccttgaaaaatggagggaggacagaaggcaccataaataaagatatttttgctctaaatatttgttcttactatttctttctaacatgattttttattcacaaaacttttttttttcttgtaagcttttctgcccgtattcttcaagcttggtgcaattttaattttattaaaattatgtactatatatgttgtgtctcctgtttctgtaacacttttcttcttgattcttttattgctccctcactcagagcctggatatgatagatgacgaggtgagctatcagtgggctgtgtgtggtggcttgtgtgctattgtttgaatgtgttttttcgctctttggagatgactgaaaaatcagacaatacaagaatatcttcctctgtagtgaagggtttccttgtgttaaatagctttactctctgcctttgtcatatcttagtttaaaagatgttcctaacttaagaggatctccgcattgcacctccagagttcctcgatttctcttccatcaccattacattgacatggtccattcttcttcctctcctttgccttcatctcagcttaccctatcccttcttctgtgttccctgtgtgggtcaccaaggtgactcctgtctttccttcaagacctatcatcaccttcatctcctctcagcttagtgggtctaggaaccaacctgtccctttgcactattaaaaggaatattctgcagtggacagagccagaaatttagaataaactcctaactattgagctctaccacttactaactgtgtgatcttgggcagatcacatagactttctcagcctcagtttccttgtttctttttttgttttttaagacagtctcactctgttgcccaggctggagtgcagtggcacaatcttggttcactgcaacctccacctcctggattcaagcgattctcctgcctcagcctctygaataactgggattacaggcatgcgccaccaccacactggctaatttttgtatttttagtagagaggggatttcaacatgttggccaggctggtcttgaactcctggcctcaagtgatccacccacttcagcctcccgaagtgctgggattacagatgtgagccaccatgcccagccatttcctcatttcttgaaagtaatgatggatattatatgccctaccttcctcacagtttgcttgctgctcaagtgaaataatggttgtgaaacttcccctaagaaggcttgagagcttaatgctctcctcttgcaagtgaaagatacctcagtatttgttaatatatttttacaaaattccaatgtcttattagaggataagtgatgcattgcatatagaaatttatgaaatatttattttctacatcttataatctgtccagactgttttgatgtaaaagcttgcaacattaatatattttcttcaatattaaacttcctacattaataatggtgcttttttattatggggaatttctaaacttctaaaaacataaaaacatataggtaataagtattttttctaacaccactagaaccattagcttatcatattttggtttaaasataaatgtggctctcataggttaagaaattccttttgatagcataatatgagccatagtatcttggtcctttaacaacactacgtaacattcctatcttagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggtaaagaattatatgtctgtcttaggttaccaggtataatttgtattactcatatcacctaaaatgttttcattaggtaagagcattctgcatatctgagaggtaattctcatcaatattcagcagaaaggatgttgaattctttctgagtagtaaatgaagtctcagaaagtccatcaggggttccaaatcaaatggtaggctgctgattaggagagtgagggacccactccattgcttccacctggcaacacatggtccatatattaactctccttacatctgatgtagtatgagttttaataatggccactgtggactttttcatcacattagaattaagacccagatccacgagtcttcttttccttgttcatttctccttcacctccactcttccttacacaccactcccaaactgggatgatgttctccccagaagttttttccccaaatatgtacacacatcttccctcccctccatggcactttcatttccacttgtccagtccatctctcttagagaccaaggtggcatccatccctttgggaaagggaaaaaggtgcttacagccaactccatgtacccccaagccccacccccgcctcagccccctgctgggctgacgggcagacgagtatctcttgacaatcttgaaaaggttagagatcaatcaatagcttgtgaatatgaaggcctcattgacaaggctgtccctgttggggagatagatagatgcatcctgctgttgattctgaaggtcacgaaacatttaaagtacataagcaactccccttattctgaattctaagttcatcgagcaacctcctcattataatcaacttcctttataggtctgcctacagggaaagaatggctagtcatgctgacacgagcattctggccccaaagacatttttggttctcattgtaatgaaaacattggcagaaaggaagccatttcaattcttcttgcccttcttggagccctctgtgacagcaggtgctcactcctatgctttgaaaatattgatgagtttagcaatacctttacccgtaaatgcctacagcccaaaggttggagaagtagaattgtgccctttttccattcattcacccattaattactcatttggaaagcatttaattaatgagctttagggtatactttgcaagggacttcaaagaacaaaagaaaaaataaagggtagcccccagtgtgttggtttttagcaaatgtaactagttcttcctctgttcttacctcttcaatgtttgaattagtttacgaacttggatatatggtatgttaacaccatcagagggctcattggttttcaaattcagtttgtgtgtgtgtttctttcttaggctcttggaatgacagcatcccaggaccgagcagtggtcaaaaagaaactcaaggaaatgaagatgtctctagagaaggctcggaaggcccaagagaaaatggaaaaacaaagagaaaagctraggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttcccccyacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttkctgcrttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccrtattggatactctattaatgtcttgagatgtctggtgctttgttattttttmacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcayctaatttatgatctattatattgcattttyttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgmacattttgttttcyyattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggycactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttytttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctmttagaatggtttacattatgatgggggatggggagctgggggagggctgtacattcccaaaagaaagtagtgttataggaaatccaaatgcrcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttkcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaamaatacctgtgattaaatttaatttgttagtgtaaataaatttcttgccaatgagtattattgttgttagacaacgaatgcaataaaaagaaatactgaggtctgttgaagcaattttttttccctcttccattttcaccttcaactaaaacaagccttgactgggtaaacctgtatcaattgtcaaagcatatatctgtcaatcargagcaaagtgcacatttttcatggaaatgaaactaagtcttaactgtggtaaagtgtaaattggcagctagaaattacatttgaaagcacaattatggaactgggcataaagttaaaagagcaaagcctgcactcgaagcttcctcgcccgtcattttgttcccctgtcgctgcttcaccatcaaagtctctgatatctctcagccaggaaaacctctgtgacaaatccattaagtagdcagtctcacatagcgaggggcaagctaaggaagaatcaggaccatcrtagagtatggggttattttaaacaatattctttctaaagccttaaaaataagtgagggctattaatttcattcattcttacacacgcaaactataatttatatgtgactaagcctatgtcagtgcgaaaatttagatctgggaatcacagaatacatgaattaagctgttttcctctttttcacaatgtatgttatgaaatttctaaccaagccrtgtccctttttgagtgatcttgagtatgtgctgtgtcaaattggataggcttttgtttcttcagtggaatttgcttatctatcatcaagaacaagaaagaacagaatgtggtcattttattgaagatgttagggagcctaactactcaggaaattctttctttctaaataatgaaatatgttgggggtgttccctaagcatcacactcattgataatttcaagacagtctttcagagaacccagcatcctgggctgtgagcagmatctcagaaaaattgagcccatgtagggcacgggatattatgtcactggaatcatgagtaactccaatcttgctgtgaataaagtggttttttgacccaaacaaaatgttcctgtttattacttcaagtcagtgattcttaaacaactgttggtggttctcaatttattggcaaaacattttcccgraaatgccagactatcatcataacaagtgccttagaaaaacttcgtttctggctgggtgtggtggctcgcacctgtaatcccagcactttggaaggccaaggcgggtggatcacctgaggtcaggtgttcgagaccaggctggccaacatggtgaaaccccgtctctactaaaaatacaaaaattagccgggcatggtggtgtktgcctgtagtcccagctatccgggaggctgaggcacaagaatctcttgaacctcggaggtagaagttgcagtgagccaagatcgcaccactgcactccagcctgggcaacagagtgagattcggtctcaaaaacaaaacaaaaacaagaaaaaaatttgtttctaaagtcactgccttaacaccctgaagaagtaattcatcatgaaggttataccttcaaatcagaaaaacaaataaatgaaaatgtgtaacctttatatatcagyttctataacaaaatgataaagtcatgttttcttcctagtcatgtctcagtagatagccaaaggggttgttgatcttttctatttatttgtttgtttacctttctattattttttttcttttcagcctccacaacaagaagtttaaatattaaacaaaaacccaccagcactaccaccacctcaacaacagtgtagtctttggggacacttttagcttcgcccatgtcaattatgggattcattctgtatccartcatcgaagtgaacaaacttcctttaaccaagtcaaagacactcaaatgtacaatttgtgccaagatcatagagactcataattttcaggtgtgacaacactcccaagaattttaagattttcctatgtgtcattgcaacaggagaattgaaaaagcaagagtacaaggggagttggaatarttcaggttaatatttactgagaaaaagtcayatatcgaagggaaaatgggagtaagtaagtctgactgccatagtcagacttactatgtgcatggagtagaggggaacttcataatgcatatgttttctggcctgtgaactggagtccctgggtgagtactggagttcyaaagacacgtgagctaacyctgctcccctgtgtcttctgaacaagacatggcaaggcagcgatacacacatgtgcttycaggcaacacatgttttagggtaagtacttttggggtcacacactgttatttaatatctgacaattgacatractgatttatccattttagtgagaaggatttttatggtaaatgaggttttcaagtattccaagactgatttgatagtgtattctcaaaaaaaagccctacacatcatatcactcccagttaaacagtgctttgatgcttcatgatgtccacatttagggtcagcattcattgttcagctaagaacactgggtcctcggaatatggcaagcggttgaaataatggcctcagtttctatggcatgggtgcaaatcggtctgttagagctcacagtaaagagctttgtgaaacactgtgccaatcagcagtttccctttgtacacagaggcaactgtactgccttgcaacactgtgccattttctgcataaacctgtgtcactttaggttcttctgttagaatgttctggattcgaagcacctgtggaagaaataacattgggttaatatttttgttaagtcacttaaaacaaccttatgcataatagggtcatcctccataagaagccatataatcttatacaatgagataaatcctattttgttccaaaattacacttaacacacctgtttcttcatttgggaacaggtgggtactgatctcaagtgatctttagcagaggtggagagtatctagacctacagggatgaggcaggaaatgcaaatgagcagcgcatcctggatgtgggacattagggagcagtggggatttcagtaaatgtggagggaggaagctgttactcagt

SEQ ID NO: 13397 - DNA, 7943 bp, Homo sapiens
gatctcggctcactggaatctccacctcccagattcaagagattctcttgcttcagcctcctgagtagctgggactacaggcatgtgccaccatgccaagctaagtttttgtatttttagtagagatggggtttcactatgttggccaggctgttctcaaactcctgacctcagatgatctacccacctcggcctcccaaagtgctgagattataggcatgagccaccatgcctggcctataaatttttttcaaaaaaaaaaattcaggtctcacattttttggaggccttctttaacactacactaccaccatctaaagtgcataccctcaccctcagacacaatgcctgtcacacagtagttactcaataaagctttactgaattatgttcatctcttgctggagtattccctatgacctgcatggaaagaggccagaaacaatttgaaggaagatgcttcacaaggaatactgaaagttttcttgacctcatgaatgctggtgaggctttatccctctctcaggaatttagcattgcctgaagttcctgacctctgcctttcacaagcaagagcaggttgtggcaggcgacgaaggtccatttccatggtaagaagcgtggggctggccagctccgtagtcagagtgtgacagtcactgatgagctgctccaaccagctcattgtcctacagatttcatcctgaagaattctgcactctggataattgtgtatttgtttcttcaattcacaatccagcttctgctcccatttcctccaaagtgacttggacaccatattggcaaaactacaggatttgcctcttcttggtttattatcttggcaaaatgaccctatgttccagctccccttgggtttccagtctccacatttgccctccaggggttctctagttctatgcatcccacctcctagaggctacctcttggccccaacacccagtggtctcctcaacactctaggagaagccaggatgtccagattgactgagtgtgttatgatcagagattgcctctatgtgtaatctcagaggctcatacctgtagagggactctggtcatcactgaactgggagttgaagaccctgggtcttgacatgcatcctgtgtgaccttgatcgggtcttttcacttctctaggttttgctttcctcttctgtaccgtggcaaaacagattgggatcaggtaaaaccacaggccatggatatactgaggaaaatgaaaaaataccaggacattttcaaggtcatgttactgctgtggctgctgggcctgtctgcagcctgggaggttgaggacaacatgacaagacaaatgtaaaaatgcccagaatggagttatgaatatagtggtggtcaaggatgtggagggggaacctctaaatgaccacaagtgagggggaaagaagggcttccctgctcagggtgagggggtggacctctgaatggagctccctggaaccaaggatgacccttgctgtcacttcttgcaaccctgagctaaaaacagttgagtccaagaatagtatccattgtgataaaactactggatgcgtgggttgagggtgggggagaaggggaagtaccacactatcagggctgaggaatcaccttttgggtggaatgtcagaacacccagttcattcatacttggtttactcatttggctatataggggtccacatcttgagtccatgttactcatcacattccctccatggagataagcataaacagtttctgcatcaaggagctcactttctagttggggaggcaaccacaggaatagataaatatgtcataggtggtaagaagaaatagttcaggagactgtaggagcacagtgaaggatacagagtttacttgggaaagaggtcaggaaagtttctctagggaagatgggaatcttttttgtcatgtatctgagagtcatttgttatcattgattattggctctccttggctttccagtctccacatttgccctccaggagttctaaatggcaccagtgcctaaatcttggggtgggggaagttaatatggctaaacgaaatgatacaagtcctttttactctcagtgtggacttccactggtgcagacatagtattgttgttaggatcttcatgaagatctctcaaaaccttttacccccatgagccaaagatcagatcaaggcgaggaaacaaaagtcaacagacaaactcattgtatggctcagtgatggctaatcacccattttatcaatcattattctcctgaagccccagaacaggcttcctcctaacccctccaccctgctcattcagacagctgctttagtggggattgagacttaacttgaaactactcatctacagctaatagacagccttctccatccttcagccttcctgacactttgtttcttcctctgacatgacacttagcttattcctcctcatgggatagttatttctgtcactgtcaatgccatcactagacatggaactcttcgagggcagggatggggcttcattcagctctgtctgccctggcaaagagcagatggttagtacattgggttgaataaaaatgtcatagataacgaagtctgtgttaatccagaggacatgagacacattctgcttcccttaaagtgaggtcctcgatgcatgaagatgaaactgcaccaactaggaaaggccaggagaggtactaacacatctgctatcagggaactcggaacattacagctgggggcgagggtcttggagaagatcagaacatttgaaaaaagagctgtacaaagaaaagggggagagaacagatgagagaagtgcagcttgtgtgtgcgggtggggagtgagggagagtgctgaggcaggatgaccttgtactttatttaatgaccctgaagtaccccaggatgctgctccaacctctcctgtggctcccagatgctgtgggtccctttttttcttaacttgtattttaggttcaggggtacatgtgcaggtttgttatataggtaagttgtgtgttgcggggggtttggtgtacagattatttcatcacccaggtaataagcatagtacccaataggtagttttttttatcctcaccctcctcccacccttcacccttaagtaggccctggtgcctgctgttcccttctttgtgtccatgtgtactcaatgtttagcttccacttataagtgagaacatgcagtatttggttttctgttcctgtgttagttcgcttaagataatggcctccagctccatccatgttgctgcaaagggcatgatcttgttctttttttttttttatgactgagaagtattccatgatatatatatatatatatcccaaattttttttatccagtctaccatcagtgggcatttaggttgattccatgtctttgctattgtgaatactgttgcgatgaacatacatgtgcacatgtctttatggtagaatgatttatattcctttgggtatatacccaataatgggattgctgggttgaatggtaattctgttttaagttctttgagaaatcgccaaactgcttcccacaatggctgaactaatttacattcccaccagcagtgtataagtgttccttttctccacagcctcaccaacatctgttattttttgactttttaaaaatagccatcctgactggtttgagatggtatctcattgtggttttaatttgcatttctctaatgattagtggtgctgagcattttttgtatgtttcttggccgcgtgtatgtcttcttttgaaatgtgtctgtttatgttcaatgcccacgttttaacggagttgtttgttttttgcttgtacatgtgtttaaattccctatagattctggatattagacctttgtgagatacatagtttgtaaatattttctcccattctgtaggttatctctttactctgctgataatttcttttgctgtgcagaagctctttagtttaattagatcccatttgtcagtttttggttttgttgtgatttgtttttggcatcttcatcatgaaatatctgccagatcctatgcccagaatcatattgtctaggttatcttacaggtatcatatttttatagttttatattttaggttttacatttaagtcttcaacccattgtgagttgatttttacagatggtgtaaggaaggggtccagtttcaatcttttgcatacagctagccagttatcccagtaccatttattgactgggaagtcctttccctgttgcttgtttttgttaactttgtcaaagttcggatggttgcaggtatgcagcattatttctgagctctctattttgttctattggtctatgagtctgtttttgtaccaaagccatgctgttttggttactgcagccctgtggtatagtttgaagtcatggctccctttttttactcttcttttttctttctcagagaagagcaggtaacaatgtggggttaaaggtgagcaggtgggttagagtagtggagctaaaggcagatagaggtcttgatccaattatcctcattcccttcatttgtccaaccttgcacactcctgtatgcagggcctttgtaagcttcaccttctgtacaggtgcccagcaactgtcaaaccagccagggcttaacatgagcatgggcattccctatggactggctgggacacacccacatccttagattacacattttgcctgtaacatagataaactaattactaggtatataattctgtttcgttttgttttgctttgttttgtttttgggacagggtctcattctgtcaaacaagcgggagtgcagtggcacaatcaccactcactgcagcctggacttttctgggctcaggtgatcttcccacctcagcctactgagcagctgggactacaggtgtgtatcaccactcccagccaaaatatttttttatagagacagtgtttcaccatgttgcccagtctggtatcgaacttctgggctcaagctatctgcctgccttgacctcccaaagtgctgggattacaggtgtgaggccctgtacccagctcaatcctgtttttatactagaagaacattctctatctgggtcttccaaacttgattcttactggttaatttgtcctgttcttttgctggtccaagaaaatatcctgaaatctttatttcttctccgtttcctccttgtcctaggacagactagccctatccccttcctgaattaagtccgaatatagtcagtctttgagtgtggaatagctcctagcagtctatcagtcaacgggttctctttgtggtcacattctatgtttattcaggagactacagcatggaaagaaaatggactttggagtcaggtgaatcttgattcaaatcttggcagtgccattcatcagctctgtggcattgagcgcatcagtggaccactctctgatccccaattgccttgtctgtaaaatgagattagacacccctgctcaagattatggtaggattatatataatatgtgtaacacagctttcccagtgcctggtacaaggtaagtgtccaataagaacttacaaatgttcctgagccaccctactgggtccctccgcacatccaatgctggactcttcatgcccaaggaaacatatagggcacaaaagtcagtggcactgagctcagcagaagaaggcacaggaaggggatgggggagtcctggttcccgctttgttcttggggccaggacagtggccagcctggaaagactggcatgaaccctccagcatctgggggtgccaaccaccaagagcagcacagttcttgtctacaagccacttgtagcaggtgtgaacatttcatcttttcctctggggtttgcaactctctccccagtctcggtcactgcttttggctgtaccacttcccttttcttctcgcctgcacctccctcatctttcctctatgatgacatcgccctggggaagagaagctgagaggaactcctcactcagctagcttcaggagcatgacrtcatctctaccatggaaattccactcactctcctgtgcccccacatttgtcctaggcctcagagtccctataaagagagattcccaastcagtatcagcacaggacacagctrggttctgaagcttctgagttctgcagmctcacctctgagaaaacctctttkccaccaataccatgaagctctgcgtgactgtcctgtctctcctcrtgctagtagctgccttctgctctcyagcrctctcagcaccaagtaagtctacttttgcagctgctatttcragtcaaggtgtaggcagagtccttttttctagtcatggctggcaaacagtgggatctggggatgggacaaaaggcagctaggaagattgccatgtagtctgctgctaaatgtagagtctagtagatattcartaacattcaagttcctattttcttaagaattagcaaccagcagaggaaaacgatgggctggaagtcagactgttgaattggctctgcctttaattatttgttcaagcaagcccctgtccctctctgtgccttggtttccccatctgtcatatgaagggagtgcgatgtgttctgagactgaatccagttccaatcttctagatttctttctcgttcttctctgaagatccactattcaaaataagactcctgctcatgttaggtgggaatggatatttggggttctggtagctccacagggatgctcaatgaagatrcaaaattagaagtcaaaataaacagctcccaygggcagtgttgatctcaccctggcctttcctttcagtgggctcagaccctcccaccgcctgctgcttttcttacacygcgaggaagcttcctcgcaactttgtggtagattactatgagaccagcagcctctgctcccagccagctgtggtgtgagtatcaacccctgggctgccctgggaggcaagggtgagggctggattttaaaagrgggcctgttttggggagggggtgatgagcrttggggaggcagctcccagggctgaagccttccctgagagcagtgaggacacaggtcatgaactcacttttcaagtgctgaaggcggcagagtgggagccgagagagaagggggttsctggggaggaagttattcagaggacagggaagcaggggaaggcagacaggtcccatgagatatggaccgattccttaaaccatgctagaaaaacatgtggaaaagtcactaccaggctggcagggaatggggcaatctattcatactgattgcaatgcccactggttcctaatctgggcaacccctggggcccacagctaaatccagtgagtggaagttacagggagtctgcttccagtgctgctccaggaaggatcccatccaccagagctgccccacatggaccatggtcaggcagaggaagatgcaaaggataaagccagatgacctcaaaggtctcatgrgattctaatctgtccgctccttgttctacagattccaaaccaaaagargcaagcaagtctgygctgaycccagtgarwcctgggtccaggagtacgtgtatgacctggaactgaactgagctgctcagagacaggaagtcttcagggaaggtcacctgagccyggatgcttctccatgagmcrcatctcctccatactcaggactcctctccgcagttcctgtcycttctcttaatktaatctyttttatgtgcygtrttattgtattaggtgtyatttccattatttatattagtttagccaaaggataagtgtcccctatggggatggtccactgtcactgtttctctgctgttgcaaatacatggataacacatttgattctgtgtgttttcataataaaactttaaaataaaatgcagacags

SEQ ID NO: 13398 - DNA, 21166 bp, Homo sapiens
ggagttgcgctgtcaccggcctggagtgcagtggcgcgatctcagctcactgcaagctccgcctcccaggttcatgccattctcctgcctcagcttcctgagtagctgggactacaggctcccacgaccacgcccagctaatttttttgtgtttttagtagagacgaggtttcatcgtgttgatcaggatggtctcgatctcctgacctcatgatccgcccacctcggcctcccaaagtgctgggattacaggcgtgagccaccgtgcccagtctcaggcttcctttttgcaaccccgtaaaaccctaagacgagacygcttgaggaaccagaggccccgcagacccattggaactttgcatcagagcttcctcctgcctgtgctgaaacccaccttgcgctgtcytagaggagaggcactcgcatcaaagtgactyggaggtgcgcgggaagtgatggacgatgccgccaggggacaaggttggaaggaagaggacatgggagccaacccctgcgctgggaactgaaggctcaagggatgattataaactaggcatccaccttttaagccaaaagccagagcatcaagatggactcatttctgctttgtaggaaygtgataaagaactggagagaagtgccgtcaggtggggactggaacactgtccttggatcacagaggctccaggaaatccagggacaaaaacaggtcagatcaaataggaacaagtcggagcagagaggatgcaggaaaacccagcccatgtcgcctctgaacctgcgaccctgcaaaagcrtattttcccaagggtcagggagacgtgttcctactgttggtttgactatctgtgaagtttgatagcacagttttgtttgtttgtttgtttttttgagatggagtctcactctgtcatccaggctggagtgcaatggctagatctcggctcactgcaacctccgcctcccatgttcaagmaattcttctgcctcagcctcctgagtagctgggactataggtgcacaccactaggcccagctaatttttgtatttttagtagagatggagtttcaccatattggccaggctggtctcgaactcctgacctcgtgatccgccygcctcggcctcccaaagtgctgggattacaggcgtgagccactgcgcccggcctgatagcacaaattttaaaggccacaatttstggccaaatgaaataaaatgagacaccccacccccccgacacacacatattaataaggaatgctaaagtactctgctaaatacctgaagtcaaagggaaatcaaatgatatttacagcattttagacaaggggacaccactcctccatctaacatgaaggagactgtctgttcctgggtggcgacgtgaggccgaggccccggacactcttgctgtggacataaaagaatggccacaaatgtgtaggacttcagttttagggaataaaacaataaaggaaatagaagaataggtatctaagagtaaggaaacctcagcataaaagctaaggggaggccgggcrtggtggctcatgcctgtaatcccagcactttgggaggctgaggcaggcggatcacctgagrtcaggagtttgagaccagcctgagcaacatagtgaaaccccatctctactaaaaatacataaattagctgggcttggtggcgggcgcctgtaatcccagctactcgcgaggctgaggcaggagaatcacttgagcccgggwggcagagggtgcagtgagctgagatctcacctctgcactccagcctgggcaacaagagtgaaactgtctcaaaagaaaaaaaaaaaaaaagctaagggggaaaatagcaagaagacagactctaaaaatggcacatgttgtactaacaaattgcatagaggaaatagctattatctctctagtgcaaaaggtaaatggtaatcttcatctctaaagagatcttagaaattaataacaaaaaggtaaatactccattcaaggatgtttcaagggtgtggcaccctgagcaggtaattcacaaaagaaggaagaaaactggctaagaaacatatgagtcaccccaggaaagaaccagggatttcagccaaaatatcttgattccctgtgtagccgtcaacgtgtaagatgctttggcggtttcggtgcctgcgctatggagtcccacacagcaacgaaaacatgcaaacagctgctcagggcagcttggcttcgtggtaaaagtgaatttatggggaaaaaaagagagacacagttccaaaatattctgcatttctctgggtggtggcactatgagtattytcaattttcattattcctgtttgtattttccaccctttttgtgataaatgaataaaggacattttaaaaatggaatttcatggtggccgacgaattatgctgaaattgctccttcggattccaaagctactggctttcttgttcccactgtgacgttgatgaggacgctgcttcatggcagtgggacctccctgctggcatgggcttgttgccactgtcactcacccattcacccatccatgggacaggggcttgccagcctctcctctaggcayggcgcaggggctgagagctgcactccaggactcctggactctgccctctgctgagactctcagcacctcttttccccaacacctaccccaagtttccatcacacacagaaacctccaccactcccaacaccaacatgtgtccccagcgaggctgtttacaaatcagctgggcaggaaggtgttcccctggggctaactcttctgcactctcagaccctgaatggccggagagaacacgcagcccggggtgggcaggggcctcagctcaggacagcaccagggccctctgtgcttgctcagggcctgggctccacacacatgggctcggaatcgacaaatgcaaccacctaatcaatgccccgtgtcagtgccagtttgtgccaagcagaatgggagggataattgctggcaccaggtccggcttggggtgggtatcacccacagctccataattgctaggcgcccactgcagagccccttgagttggggcttcccagcgacctggcctgtacctgctgggcaaatgcctgtgtcactgacccctgtggcagctggcattctcctccgggaacgggagccagcctccggtgacatggcctcaggcaggaccacggttctctgacacaggacacgagtgcagcaaggggggcccacacaggacctgttccatggaatcgccacaggcgtcacgctgccccatccacagaggcaaatgtcccacagccctggtacctggtggggcccggcctgggccagagtggacagacctgggcctggcaggagccctggggaagtgagttcaagttacacggttgactatagagacagctggagtgcrcacaattggccagaccacccctcctgtttcacagatggggaaactgagtcacgggggaccaaatagcctgctcaccccatgccccttccagacagggtgcagatagggcccctcccatctcctggatggccgcggcccctgtgcagaacttccttcatgggcacctcgctgtctgggggcctcttccccagggagtctcctggtggtggccgtgttgcctcaggctcactgtgcactaggcaggtcaygtcgatgccgcctgaggggcaggggttaccaccctgtggttcaggtgagaagctccaggctcaggagtgtccagctgcctgggcagtgtttggatctcatgccagcccctgccaggaggccctgcttctccagcccagcccacgcccaccaggaaatgcccctatttactcccttgaggcaaaggcccttgggtggctragcrtcccctctcccagcactcggagctgagcgtcccctctcccagcactcggagctgagcattcccctctcccagcactcggaggcacctgcagttgctcagctgttcattgagtgctgggagtggaaactcatacgctgagcggcagtgacgctgcggagctgacaaaccccacagcccgcccggtcacctgcttcaccgagggccrcagcccccccggggtcaggtggccacaggggtcctggccatgtgggacatcygttctgtggccctgctcaggatggcacccggcggggactggccctggggccgaggcatgggctcagccgccgccctgcagggacgtagccagggacctcttcccagcagagggactcccccactcatccccagaatactgaggggcacgctgggtgccaggctggcagggaccctggggattctgctgtgagctggatggggaaggagttccttcctraaatgtggagtctggaggccactcttggtaaagtgctggcccccggggattctgcagtgagctgggcatggattctgcagtgagctgggcttcactcatggtgaarcgctggggtgacggcagacagcccagagcttctagcagctcatttctgtgaagcctccagaatccggcctcagcccccaaacccgcaggcgttgcgccaccgtcacggggaaggcgagtgacagcgagtgtcccctatgcccccacagctygctcccaggctgagctctccggccatmcccccccttccccattgcagccatgccacccctccttctccccacccaggaactgacagaggagaggggccccggatggacagggacagcagggcagaatcccagctcccagatccaggggaggggggattgggtgtggggacggtggtgcaaggggtggtgccaggggtggaggatgcatggggagggctggccccaagagtgcagtgttgggggaagggggccaggtgggcctgggacccaggggcrtggcttcaatccccctcccaccaggaccttgggaatggcctccaggagcctgttgtggggaggccagggtcaccagctgaaccaactcgaccagaatcgcacagcggtgcccgctcccctacagcaagacgtcacccaggggtccccacggaggaggcagggaagctcgagggtcccagaggagcatggagcatgtgccacaccacaccacactacaytacacatgtgcaccatacatgtacatacaacagactccccacatcacatgcgcacactcgcacaccatacatgcacacacacacaccacactacgctatgccacacacgtgcaccatacatgcacaccatgccacactacacacacgacactacacaccacgaaccacaccacaccatatcacacaccacacactgcgagtcgatctggagatggaatcgctgtagccaggcggggcagcatgcagacaggagggcctaacacaggcaggcgcagcaggttcacagaggaggccccgggaacctgcctcctgcccagcccggagcaccaggaccccccagccgtccccctaggggcttgtgggcccagcctcttcctggccttgccggcctcacagccccttgtcctcccatgccggccccatcctcagccrcaagcgctcccagcacaccatgtggctctgctcttggtggcaggcacttccccttgccgggtctcaaaggggaccctggagcagacggtctggagaccccttcctgccagacacccctgggccgggrcyataagcagggccaccagggtcactccaggctggggcaggagagtgcttccctccaaaaatcaccgtggacatagcggggcctctgcacactcaccctcggtgtgctggagtcctcggcggtgctcctggctgggcgtgggggctttgctaccagtctgccctgggtcacgtctagaaacctcagctggrggcgcgggtcgtraagtcctgacacttcctgttcctctcagctcctccttggaggaagtggtgggttgcaccaccgtggcccttcacccctgcccctctccgctctacagcagctctgatgtcagagagcggccccttgagacaggtgggacatgtcatttctcacatgaggtcccggcgagaaggacctgcttccatcagattcacacttgggagaggggcccggcctccaggagcgccaggcagaaagggcacccattaggaagaagaacacagaggccatgggagtgaaaagtttgatgctrgaaagcaacagtagcacattctgctacagagcggaatgaaaaaccctggggagcaaattccygagccagagaatggagcggaggaaccagccaaggaggataaagaggtgggaacargcaagaaaacctgggtgcgtgcacgcattgacatccacctgcatgtgagggcgggaggggacagaacagggacagcgaggaggagacactcaggtcacaggaggaaggctgcggatctgggcggggacgtggattgcgaggccactgaacaccccagggatggatggatgaggtcctgttaactagggacattaggaggataccacagaacacgaaagggaaaatactacaggctcagagagagagagaagggagaggaggaggaggaggaagaggagggaaagagattatacctagaaaaaaaacccaaatcagacatcttcagagcaaggactcagacacattactaccctaaactctgttttatttatttatttatttttatgttttcagttttttttgagacagagttttgcttttgtcacccaggctggagtgcagtggcgtgatctcagctcactgcaacctctgcctcccgggttcaagcaattctcctgcctcagcctcccaagtagctgggattacaggcacatgtaccaccacgcctgggtaatttttgtattcttagtagagacagggtttcactatgttgaccaggctggtcttgaactcctggcttcaagtgatccatccacctctgccttccaaagtgctgggattactggcgtgagccatggctcccggctcctaaactctgttttaaagatgtcttgcagaaatagacatgaagaaatccatgagaaatacaagagcagatgatacaaagttgggcaaagaaataagtaaaaattatgatgtcataacctgttgatttaaaaaatagtggtaagaatattaaygctgtgaaacaaaacgcctagaggactgggttgggaggggccagggagcacattgccgttccatcctatctggggaggaatatagatgcttgtcagtgggcattttgatagaaaatatctaagtatatatgctaacaattcaagagtctccttaagaataaaaatagcatgtatatacctgaaaaaaaatatgacaaatctttattttgggcatggtggctcaaacttgtaatcccagcactttgggaggccgaggtgggaggatcacttgagcccaggagttcgagaccagcctaggcaacatttggagacccagaccctcatctctacaaaaaaattttctaagaattcgccaggcatggtagcacgcgatatggtccaggctacttgggaggctgaggtgggagaattgcttgagcccaagaggttgaggctacggtgaaccatgcttacaccactgcactccagtctgggtaactgagaraaaaaaaaaaaaaaaaaggcaaatcctttaaaagaaaaaagtaagggaaaatagaacaaacaagaaaggtaaataaaaaccaaacaataaaacattgggaataatttcaaacccatcaggaatcacagcacctgtgaatgggttacattttcttgttttaaatcaacaaggtcttgcgttgggttttagaaataaagagacaaaacaagttccaatgaaatgttctctgtcaagggtatcttctcattacagacttagcctagaaaataatgaagaaggacagaaagagaataccattctactacacccgctgatgacttaaagtaagcaatgaccctcgctgcgaacgtcacggacgcagcagacgttatgcacacacctttaatgaattagtcttgatgaaataacaatagaaatcaagaaaaatagaaagaacaaatgttactattgagcctgaatcaggtcgaactttttagatctacaaagaagcatcaggagggtgtgttagatgacatcgtagggatgcaattagcaaaatccaggctgaagaaaccctcacaaggcaaacagcacagtacaagaggagagacgaagggagagagaccctttagattaagagatttaatctcttaatagaaccaattgcaatgcatggaccatattttaaaatcattgttaattgttttaagtgtgacaatggtttgtggttatgttaaaaagtccccatcttttagagttacatgttgaaatatttgcagatggtgcagtataatgtttcagatttatttcccaataaagaggggtgggttgggttgggggagagtcgggagaggtgttgatacaacaagatcacctgtgagttgattatttttgaagccactgttggggacatggggcttcactaatctattctctctacttctgtagatgtgtgaaattttttgtagtaagattaaaaaaacatttcaaggaagtgtaaagttattatttcgcgggtataaagttcccgttttgcaagatgaaatggttttggagaagttggtggtgatggttgcacagtactaagtgtccttaatgccacggaaatgcataacttcaaatggttaaaatggtgaatttatgttatgtatattttatcacaattaaaaagtaaaaagtgtaagaaaggctctctatcagataaactgttaaaagagaacactgaaggctgaaaataaagaaacggaaaatacacgtatgtgctagaaaatactaacgaagatatcgtgtaacatcaaaaagatagaaatcaaagcaaaatgcatcaaatggacaaaggaagatgtagccaatgagagtcagaatccacagacagttcagcagccataatcctttgtgtgccgaacttcaaaatatataaaacaaagactgacaaatatataagcaaactgacacagccccaaacagcaaatatctctaacagatctctctcagaaataaacacatcaggccagtcgcggtggctcacacctgcaatcccagcactttgggaggctgatgtgagcggatcacctgaggttaggagttcaagaccagcctggccaacatggcaaaaccctgtctctactaaaaatacaaaaattagctgggcatggtggcgcatgcctgtaatcccagctacttgggaggctgaggcaggagaatcactcaaacctaggaggcagaggttgcagtgagccgagattgtgccactgcattccagcctgggtgatgagaaggaaactcttactcaaaaacaaaaacaacaacaaacaaacaagaaaaaatcaaatagaaatgcaaatttggcaggtagagaatttgaggaacgtraccattcgtctccaacttaaacacaattatgttacaaagtgggacaatgataaacacataattactagaccacaagggaaataaccacatattctaaagcacaaagaccataaggaggccaaattcacggacacaattgaatgaaattagatgctgtccaaaggatggcatgaaagaaaaaaaacagcactcctgaaaagtggacccaaatatagcctagatcrcatacatccatggtgccacactcacgctacggggtaaygaataagagcccttgaagtgctgctctgaagcctcgtgacccacagatccgtaacactgagattcttctgaaaagcaaaatgtagaaggaggcattgaagaataacatgcacctcgtccctgcagacccacacacccctagrgcaggacagtggttacccctgaagacagagaaggctacgggcctgggagatggaagcagagggcttcaaagttctattgtagagttttctttactaaaaaggaagaaaaagttctgggcaagtcaggcaacatgttaagatttggtaagatgagaggtagctgtttggggattggtactagtgctctccatgctgttctgtattcttaaaatagtttatatcttttttttttttttaaaggagctaggaggaagtgactgcaaatgagcagaaggatctttcagggggtggaaatgctctgaaattagattgtggtgatgattgcacaattccgtaaattttctttttgttgctgttgtttctttctttctttttttaatagagactaggtctcgctacgttgccaaggctatggtgagccaagatcacaccactgcactccagcctgggtgacagagtaagatcctgtcagaaagaaagaaaggaagaaggaagggagggagggarggaaggaaggaaggaaggaaggaaggaaggaaggaaggaaggaaggaaggaaggaaggraaaagaaaagaaaaaataaaaactgaactcacatgagaaccacagcccacaagaggcaggtctggacttgtggtctaaccctaaccagactgactgctagcaaaacaaaaagatcattgttgtccagaggattttagtagaatccagagtcttattaaataatattcaaaatgtccatgatacaacccaaaagtactcaaacagcaacaaagaaaaccttgagaacttgtaagagaaaagataactaatagatgccaactccgagataatcccaatgctgaaatgatcacacggagcattaaaacagctgttagaggccgggcgcgggggctcacgcctgtaatcccagcacttttggaggccgaggcgggtggatcacgaggtcaggagttcgagaccatcctggctaacatggtgaaacctcgtctctactaaaaatacaacaacaacaaaaataaatcaataaaaataaaattagctgggcatggtggcgggtgcctgtagtcccagctacttgggaggctgaggcaggaaaatggtgtgaacctgggaggcggagcttgcagtgagccaagatcgtgccactgcactccagcctggacaacagagcgagactccgtctcaaaaaatatatatacaataaataaataaatwaatwaatwaattaaataaaggctggtggagggagtgaaggggaggggctagggaccgtggggcttcccagagccgtgamcttgcwatggggggacccagacctccattccggggactcactcagcactcatcttactatcccccatctgatgtgcctgttgcacaaggctggaagtcagaggctgtgcacgtttttctttgtggagacaagtgagtaattggtgcgtttagtgtaaaaatatcaggtgtggctgcacggagtgaaaaatcacaggctccacggagccgggaggcctgctgccctgccctcttgctttgatgaggaaatggcgaccgcagaaggaaatgtagcagcaccggcaaccggcatccgtggggccacgccgggctgcttcccagggccctccagccaagcagccacaggaaagagtagatgttgatcccaagctaggactgaggagtccgtccctaagagccgagggagtcaggygggcgaaactggccgcatgtctgggtacaactgctcagggtttctcatctgctgaatcaccaagctaggttctgargccaggcgtgagtgagcaggactggagcaggattctgggaacaatcttttccctccagtcagcccagaaattccatttgcagtcactttcacttatgtattccagaaaactacctgctgtcatcaggggttggttggttgagcctttccctgtgcttgcctggcagacctgcgtgctctgaggctgcccgaccctgagctccagaacagaccatcgagttcaggagacaagcatgtcagccatgacacaaggcagatgagagggacccccagcgtccacacgtggaggcagcgggggcagccggtgagcatagatggggaaggagattcagagcctgagggctgctctcctgccctcccatcctggacactggcctgggccccccagcttcccttcgcccagcttccacccccataacacacaaccccagagcttgggaaggaggtctctctgtgacaggtgggattctggaagtttccacggaggagaccccataggascagggtttgaaggtcaagaaagatgctaaggatggagagggccagtggggagrgggtggttccaggctcacttcacagaggtgcttggggagctgcaatattttggcagcaccaagggaagagtcaggtcagtgaggttcataagggatgagaaaggagtctaaccagccctggagacccctggggtctggccccacagggagatgtccaagtggcagaaagtcccttyctgcctggagagcaccyccacgaggaccctggggccacccgggaaccgctgctccctcccagtcactcaccacacttccctctcccgcccaccctccaacctgcctgcaaattcccctgcaacccaactctggtctcctcccaaccctgcccccacgtaggcctttttttttctttttcacttcttccccccagtgacttccttctgcagtgttgattcagctccctttgaaggcgggtgagaccttttgcaggctgggggcagrggcgggggcggagaagagggctgcaggcagggctggcagaggggaggaggtgacacacactccctggaggcgagtggggagggctcggggcaggaaatggagttgggtgccccaggtggggtgctccaacgagctctttctcatgggatcccccacagatccatacaaacaggctgaccatcagggctggtcccaggccaccaggctgggtgcaatgcagaaatggagatctgccccggggaaggcaggtgagtgtaggaaggagggagggctgcgagaagctgggggcagcctccatccccctgtggcctgggtgggcctgtgcccccccaaccccccgacgcagcttcccacactgggagcacagttcctccctcctctgccttcctctgcgtggtgtggctcctccttgagggagagagctgaggaggtggcattcttgcttccctgactsacccaaaggaagatttcacagcccctggcaagggctgccagacaggctcacctgtcaccccctgtccagggacagactgaccggtagccttggctrggtggggagttatgctgggaagtcttccaggccccctgggggtgggaagatgctcaatgttcaaaggagatggaacgaggaaaacagttaagcaacgatggactccagggggaaaaccggagaagaagaaactgtaattccagtccgtccacatggcccagcagtgaacgacaattgcatggtcagagagagcaaaagcaccacgccgactgaaagcagctcgaatgtggtggggcagtgggagataatgccctcatctaccaaaacaagatctgccaccttcgcagaccactaaacctcattcctccacccacctccccacccccatgaaggccaactgaccagagagcagggctcccgagggtcgggtcgggtcgggtcgggttgggtcgggtgggtgcctcttaccctaactgaggctctgccctggactcggagtccacttgctgtcaaagcatgccactcttctttctgatacttgacatatttcttttcccgttcaattcatggtttctgcccaaacggagccacgtgaggacktctttggggatgtgtctccaagaaaagtgtgggctgccttcctcaccctggatgcctgtgggcwgccttcctcaccctggatgcctgtgggcwgccttcctcaccctggatgcctgtgggcwgccttcctcaccctggatgcctgtgggcwgccttcctcaccctggatgcctgtgggcwgccttcctcaccctggatgcctgtgggcwgccttcctcaccctggatgcctgtgggcagccttcctcaccctggatgcctgtgacttggtttccatgggggcttcctaagctcagggaccccaagcctccatcaaatctaatgacccgccytgtctctgaacacacctgtgttgtccccgagcccctcaccaaccccctctgcaacccggcccacgcatttcccatcctgaagggtccagctcataggccggcccatgtgttccctttacccctgctttgtccctacctggtggggagctgtcccttctgggccctagtgtggcacttcacacacaaatgtgtcctgtgggtggtatctgggcctccccctgcagtgaggggatgaccaatgtgcagagctcactgggcctggatatgggctcgggtggcacagaacagagagaaagtgctccgtaaaagtgagctgcgatgcggaggtgggcaagctcttccctggagggggaagagctctcaacccagagggatctgaccaggaaggttcaccccccctccacccaggaagcccctgcagacagtatgtgttttaggctttgctggccaaatggtctctgccgygactactcagctctgccattgtggctgcagagtgaccatagaccttctgaaagtgaatgagtatgactgtgttccaataaaactttattgacaraaacaggtggagggccagcctaagggcccaagtttgtaggtctctattctagaccagtgattctctggagaggaatggggcatggggagtggggacagtgtgtgggagaagrggtgggacacaggcacgtgggaatggtgcggacatggaggacattggaggtggggaagagctagagaacctaaacactgacgctggaccctggtcaacactaggtctctccacagcctcctcttttagcctctccctccagtttcaaaatgactcctcyyctgaggggactcaggctccccacccwgctccccagttcccaccagaaaccccaagtgggtgttccagcctctgccccacmaggcccccatggaaggcagcaccgccaggcagggacctttcctcgctgcccctccctcttccagttctgagtcctgkcccggagatgacctctcaacccagagggacctgaccagamaggtcyggccccctccacccaggaagcccctgaaggctggagggcagccctcccccctccctccccctgttagtttttctttctgatagaaacagcagcaaccgctaggcacctgctaggcagggggctgcacagcctcaggtcagttcctgaaaggcacctttttccatttgtaaatgaggtgacaggtctgcctcccagggatgagcagatgaagggttgggagtgcagagcctgggaacacggagtggcagtggggactggggcccagaggctgctgagtgagggaaggctaggggcagtgaagctggtgaatgaggcaggggcagaagacagggtgggggaacatgcccagcgaggctggtgaatgtggcactgcaggggcagggtgggggacatgcccagcggggctggtgaatatgccaccgcaggggcggggagggcagaatatgcccagtgaggctggtgaatgcgscaggggcagagggcggggagggggaagatgcccagcgaggctggtgaatgtggcactgcaggggtggggtgggcggatgcaatgatgagcatttcctccctggggccagcagagcaggggtgaggctgagtgggtatattactccgatttgggtgggaccccatgcagtcacacgtgggggacgcagggctgacagccttgcatgamcctttcacactttagccatagcaatgccaagcccagaraggctgcaaggccctggggagaacagaggccccggaaggggtggccagctgggcttcactgcagtcctcaccagacaggattgagattttaacgtgttaacttgttttctgtcttttccaaattgtttatggtagccatgcattaattttataatcagaaaagcatgttattataactcaagttaaatggctccaaaacaaaagtacccagaccccagagcctgcccctctcyagctggagagagggacgaagtataaggaaaaggaacggaaagctgaaaggacccccgggctctggaacccgacccaagggtgatgccgccagggctaccaggaagcggctccgtgctgggckcagccggtctcctacccaccccagcacacctcagcccccagcctcttcctcccgcgcctcccccgccctcaccacttcctctcaatggtccctggggattacagcacgattatttttattgcaagagtttcccaatgcgggaactcacagccccaaagagtttgcatctgagcttcctgtagcatcctggggcacggacaggcggaaccgggccatcagccgtccctgcgcacagaggcgcacagattggatccggcctcgcagtcccaggagccaagaggggaggcacgcgtgccggttctcggaaattcattatgggaatgtgcgcgttgtggagatgctcagaccgcgaacagtactgcgggaacccaaacgatcatttttaaccccagacgtccctgaaccaaagccaaagtctacaggtcactggggcagaggccgcccgaaaccagctgtcccctcccggcctakgcgcgccaggtccccgcccagccggggcgatcctttggtcggacagtgaggttgggagcccaccgcacccaagtgccgccgcatccacccggcgcaggcgacccccgacgggcagccgctcaccttctcctggccccgggcttcaggaaaactgcctggaggtggccggggtctccctagcggaggctgggcggcgggcttcgcgcctgcctcagtctcccaatccgtggcccgggggatggagcccgctgcgcgcagaggctgcggcaggtcccakccaggtgccctggaacgtggctcctccttccctgaggcgctcccctgggcacgaggatgggtctcgaagcaggaggaagccgccttccctcacccgctgtccggagctgctcagccggtgcgcggagcctcccccgccgcggacaccacgatccgacccccaccctgaccccgacccagacccccaccgcccgaccccggccgtattccgttgcgtttgctccctgccagctccggggccaccactgagcacgcgctgtgagtaggcgcttcctggagcttttcctgggggtcctcagaaaaacccctgccgtccccattatagagatggggaaactgaggctcaggaaggccagagcttgcccaaaacctgcggtccgcggcgggcagggattccacgctccgagcctggccgcctccctggggcgcgtgaagggagctttccttccccgggaaaggccggggccagagacccgcactcggaccaggcgggggctgcggggccagagtgggctggggagggctgggagggcgtctggggccggctcctccaggctgggggccgccagctccgggaaggcagtcctggcctgcggatggggccgcgcgtggggcccggcggggcggcctcgggaggcgtccaggctgcgggagcgggaggagcggccgtgcgggcgccagcgccgtgggtggaggtcgccgtccctcctgaggggcagccggtgcrtttgggacccgggagcagagcccgcgcctccccagcggcctccccgggggtctcaccgggtcwcccgagagcggaggccccggctccgcagaaacccggggcgsccgcggggaagcagcgccctcaggcgtcggaggagcccccagaaggacctcgcgcctccccgccgggctccgaccgcctgggttcggtgcgggacggcccaggccgccaggacccccaagcgcagctcagtctgcggggcacgacccagaggccagcagcagaggacgrggccggggccgggagagggcggggagggcgctcctgggaggtcaaggccagggctaggctttcagggtcatggcctggcccctcatccccagggaggtgagggggctctgtgagcagaggggccccggtggagaaggcgctgctagccaggggcggggcaggagcccaggtggggacttargggtggctgaagggaccctcaggctgcagggatagggagggaagctaggggtgtggcttgggsaggtgctgggggaccgcgggcgccctttattctgaagccgaatgtgctgccggagtccccagtgacctagaaatccatttcaagattttcaggagtttcaggtggagacaaaggccaggcccaggtgaaaatgtggcagtgacagagtatggggtgagaaccacggagagaggaagtccccgaggcrgatgatgggacagagagcggggaccagaattttttaaaacgcatctgagatgcgtttggcagactcatagttgttttcctttcacggagaaagtgtgggcagaagccagctctaaagcccaggctgcccagcctgcactggcagagctgacggaaggccagggcagagccttccctccctgtcacagacatgagccctggagatctggaatgaggcagatgtgcccagggaaagctgatccgccccgacccagggccccccgggtgcccctttgagcgtggaatcgttgccaggtcatggctccctgctatcgaacaccggacayrggtcgtgtgctgcacctggcagttgcaggaccgayacccrcaatgccttaagaggtgatgactgccttccaggggcctggctggctgacactttgcatggctcctggagaagagggattgagtggagtccacgggtcatggccacgtcctgggtgctgcctctgaggcagggcccggctggggtgagaaggggctggagacaggttcctgccagttcagcctctaaccggtggtcttcatgcctaggaacccactgggggcttatgaaactgcaggtggctgagtccttgccatggggtctctccttcagsaggtctgggtggggccggagactgtaccccacaaarggtcccaggtgaggcggatgtggcctggcgctgtgtggctctggacctagtccttgggcttgggctggcrcccagggcctgggcttgagacagctgtgacgcaggcaagccatttaccccgtttgtggggacattacatcttcctagcttggaacacacaggcagccagggttgttatccacattcctcctccatgttcttctcttgagaacttttaccaggtatgtcaggagctgggctccaccagggagactcaagtggaaagccctcatccttgtcctccaggagacaggaaaacctatggttacaattccagggacaagagcgatgcatgtgaggtgtggcaaatctcactgttcaactggagaaatcagagacagcttcctggaggcagtgacacctggacaggcttctccacaggaggaagcgagtgagagaagccaactgggatggacccatcatgtagggggaacagtgcgcgcagaaccaacaaccacccccaccctaggcccagagctcacggagagagctgggcctctcggggtgactacatagttccctgctggatcttaggtcttgtccttgggcagctctgctgagacctctatgcctgttccaggctgcaccaaggttttgtgactattgacccttgactttgagttgggagttgctgtatttttactaagggatggagagacacagcccccaacccccagggagcwgggctggctctcctatggctcagcccatagctccagccccagrgatgtccagaggatcagaaaactccctccctcctttaaagcagctactggcagagtccgtggagctcttgggggctgggagacaggcaggaaacccacctggcaggcaggcaggagcccatgggggagggttgatctttgatcttcctctgatggcccaacgggaactgtgagcacccagccgctcactgggacatctcggtgcagggaaagggctgaagctggygcagccacggcagcatcccctctcgtggcagtgctcctgaaacagagacrtggtctgggcagcatgctgaaaggcatttctgaatgaagcctcctactgacctagagccagcacacaccactccaggggcagagaggagagagcaggagcaggagacagtccagggcagaggcaggctctgagtccatggagaccctccctggggcaccccctgcatctgcaggggtccaagcctagcactggctctgcaaggattcagccactcatactgtgcccccccagcatggggcatctgtgggtctccctgaaggtgggcacctgggcagccttcctgaggggtcagagcatccttgcaggcatcagtgattccctctgtccctttcaccactggccatggctggagcagagcagcaccgcatggtttggctctggacagctgtgaggccccatgaggcccagcatgtctgcaggggcctctcctagccccctctctgcattctgaggcttcacttgttgaacagaaagaggtagcagaatcccaaataagagtgcaacrtgtcacctaccagctccagcgcctgggggccaagtgtggactcagagcttctgtccagcagaggcccctgatgtgcagctgcaccgagacacccaggcagggcgtcacctgcaaggtcagctgcaaggctgggactggggtttgtaatcgctgttgtctcttggcctgcaggatcctcrcrcgtgccgcttcggtcctgatgggcaggacgcaggtctctcactagaccagtgtttccctctgtgaggcctggagaggagccttctggccactcctgggtacaacacgaagggagaagcagrcctgagttttttatttttacttatttttttttttttgagacagagtctcgctccatcgcccaggctggagtgcagtggtgcgatctcggctcactgcaagctccgcctccccggttcatgccattctcctgcctcagcctcctgagtagctgggactacaggcgcccgccaccacgcccagctaattttttgtatttttagtagagacagcgtttcaccgtgttagccaggatagtcttgatctcctgacattgtgatctgcccgcctcggcctcccaaagtgctgggattacaggt

SEQ ID NO: 13399 - DNA, 16175 bp, Homo sapiens
gcagactcagttcctctcacattgctttcagtccagctttcctggcacccttactgattctccatcttcatggaacaccctgtccctgtggtccatgttcccaggttgctcaacattaacctccatactctctgggtcttcttttctagcttctccccacaatctgtctttaagaatttgatccccaacccgttctgagtcattttcctcttcctygtatttctttagcatccaagkgscatagctgtgtctctttctcttttctccttttcctctgtctcttctcacctttaatttccaaataggtaactcaggtattagtgtccctgatggtttgccaacccgtgtgacatctcttgtccatgtatccacagttgctggaagtgcaggtgcgggaatctctggcaaagtccagccaggtggccattgaggytctgtcggccatgcctacagttcgaagctttgccaacgaggagggcgaagcccagaagtttagggaaaagctgcaagaaataaagacactcaaccagaaggaggctgtggcctatgcagtcaactcctggaccactagtgtgagcacctgaagatgaatacccattcccttgtccttaagatgccgtgactccattcccattccyrtgaccctgctcccactcctyctttactgggaaatggttggttcagtattttcgtcctagcaacctgaggctcaatgactctactcagtgtccctagccccctccctctctttaaagatgctaggtggcttcctttcagtatggtacataaaatccacccaaccatgtggattggagagatgcgtgtcttccagtcctagggccttcctttgcctctcaggggaagtgcmgggmgccataaattcttgcacctgggmctgcttcatgctggtaccttgtagatttgttagtgagagtgatgggaatagtggaagccagggatgagggacatctgtgatgcactggaaagagagctacgccagtgatccgaagatcctggcttgatgatgcaatttacttgtcttgtgatcatgacaacaaatttaccttctctgagactgtttcctctttatttatttatttgtttgtttgtttgtttatttttacttattattattatttttgagctggagtctcgctttgtcgcccaggctggagtgcagtggcgcgatctgggctcactgcaagctccgcctcccgggttcacrccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaattgcaggcatgagccactgcgcccgactggttgtttcctcatttttcaaaaatggagtgatataaccttctttataaggctcttcatgtattagctgacatcacatgaatgaaagccttttgtgaagagtaaaaygctccccagacaaggtgatagtggtgatggtggtgaagataactgtgacttgcatgatgtgcattgagtcagactccatggggtctctggttcattctcctgtctgcctattgagcctgccgatgtcacttrggagacagggacttgatatttccttyaggttaatgactryggttctttgtgtcccctccagatttctctacctcagtccctttttttgtggtctctttatagatttcaggtatgctgctgaaagtgggaatcctctacattggtgggcagctggtgaccagtggggctgtaagcagtgggaaccttgtcacatttgttctctaccagatgcagttcacccaggctktggaggtgaggtccctccaccttcactccccagtgtgattccttcctctggcccagcaccatctgtgtgatktccttccattctttacccttcttgcttcacataatgmtggcaagcagactacctcactttcactattcttacctccctctaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatrtcttagtgctacaggtacaacctaccactccctgtattccactggccccaactgcaattctgccatcctaaattttcttcctgccttcagcctgcttactgccaagcatatatcctccctaaccctttaaaggcaatggtaggcatcatctgttccataaatcttccccaaactcaagaacccagtttgggcttccaaagagaatgagagaagaggtttcgaagagagtgctctcacgttccaaggaattgctgcagcaaaatctgtgtcttcggtcttccatctttccttttcctttgtaatttggaatgtgatttttccctttcctggtggtatctgacatcaagtgtgtggcatagtggtgctgggtctctgcccttgtctttgcygcttcttctatctctactccttgggraggcatcacccagaaatctgtgcatgtgggagggtaggagtttctrtatttccctgtttttsttctggggtaagacatcatgctrtgtaacaaggcartgacactctcaaggttagaggccttggtagcctcttatcgtgtgcttctctggcctctaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtatggaagcaggtggcttgaaggagggcagggagcatcaaatacgaagagcattcttactgagcactctraaagaggggttagggaatgataagagaccttgggtggagatggtggtgtagtcaggagggaggtagtatgattttgtgacatgttctcaataaagattttgagtcttcgatctctagataaccatactcccatgtgccttgttctatgactcttcatcatatttcatctcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacaggtactctctccactcatctcaccacccagccatctttacctttgctgaaaccccagtagtcttgcctttatccttcagttcctccttactcatggacatcaatttgaagttgtaagatcatgctcctatggcttcttcatcctgacatcctcaggattctgttcatcttcccagaatctcccctatccagctacaaccgtcagatcttggtgtgtgtgagtgcgtgaatgcatgagtgtgtctgtgtgcatgtacatgcgtgcacacatgtggctataccgttctcatcttggccctttgctctgcagaggtagrcgaggctgggagccagctgtcagggggtcagcracaggcagtggcgttggcccgagcattgatccggaaaccgtgtgtacttatcctggatgatgccaccagtgccctggatgcaaacagccagttacaggtgaggcagtcatcttcttaatggctrtatcccacccaatcttgcttcttttatacatcttctgttagttttactaacatcataattatacaaaccagtccttgcagttctcagttcccaaatccagttccattggatgcctccccaaggagtagagatagaagacgaggcaaagacacctagaaycagttaaaagagactatctacaaactacagactgaatttctttctttctttccttttttttttttaagacagtgtctcactcagttgcccaggctggagcgcagtggcacaatcttggctcactgcagcttcaacctgctgggctcaagcgattctcccctcagcctcccgagtagctgggactacaggtgtacaccactatgcctggttgrcttttatatttttagtagagatgggtttcaccatgttgcccaggctggccttgaattcctgagctcaggtaatctgcccccctcagcctcccaaagggctggggttataggtgtgagccactgcgcccagtcctatagactgaatttctaaagcgaaacataaggaaaagaccatcctcataatatcgtttatttaaaaaaawtattttttgtacagacagcgtcccgctatgttgcccaggctggccttgaactcctgggcccaagtgatcctccctccttgacctcccaaagtgctaggattataggcatgagccacygggcccagcccatcctaatcatattaatattaattaagctagtctgtttacatgcactgtcactcatttattcattaggaatccttctgagctaggcatttatcatcattctacagatgacaaaatggaggttaaaagaggttgaataagctgctcatatagaggtcatatagcttttgagtggcgcagccttgacccaaattcaggtctgcctgacttgaatgctcatctctttactactaagttatatttccttaaaatckaatataaaaatkccaagtccatgggtagagaagaggactattcaatagtctttattcttctgtcacgtgtttcaccctagggttctcatttttatcctacttttgcayccttcatgtaaaacagtccttaatgaaacaaagggtttgcggagaagtactcagaatgggaaacgttggtgtccttggggttgttagcagagccagcagtgatcctgtgaggtcagtcccagccctggaaacacaggtgtctccctgggctgagggtagtccccggctctgacggtccgatgtctttcctcaggtggagcagctcctgtacgaaagccctgagcggtaytcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtakgcagctgcctccaggatgagttacttgaaatttgccttgagtgtgttacctcctttccaagctcytcgtgataatgcagacttcctggagtacaaacacaggatttgtaattccttastgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgtactgtggtttcttatgtttccggcacaccaaacggcccactgccttttgcagcgcacttttcagctgcggrtgtctcctcttttatcatcctcaatgttttaccccctaactgcatcaccttttccctyaagctttttaattcctatgaggccccttccacttcccctatccccttaggcccacccccaagaatgtgcaagaccccagccacagggcccatcagggcactagcggccgcagctcagagccgtggcctctccgaagtggcagatggggcgggcgcggccagagcaagtgccaggcgggaacagagggactgggcgcgcctcacaactcaccacctcgcccgctggtccttcctggctcgcctggctctgaagctgcacctggaggggaaacctcararcagtaggcgggattgcctagtaaatatctcccattcagggaggcccaggtcrtgtgacgtcgacagttgctgggtagatgaggccaacacaggttgcaagaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggaggtacctcttactgtaacccatcgccaagtgggcttttgaaggcgcctgttcctttctcgctttcttcggaagacccttgacccatcattcccccgacccccataacgggagagcagagaagccggtccccagtgtgatggtcctggtccaggcactaactgtccttttctcggaaaaggcagggggatgtggaaaagagtcttgttccctccccttcgatctgtggctttcgctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgcyttaccccggggaatgmaggtcggggcagtagggaagcccctagggatgcagggaggcgggcgctgaggagtggagggtcgcctgagaggaggaggcgagagcgggagcgcggggkacagggtcgggggtagccttcagtcccggagagcgccagacccaaagaagaggccacatggggatggggcctgagaggaggaagtgcaagttaggacaaagagttacaggtgaggtgggggctcccaaaggaagacaagagaacttycctgcccttgtccacacacaaatggtggagcctttttcatggggttatcacatgatataggaggtgtgtggtgtcttgggaaacctatgaaatttgcctgctggcctcctctcagcaactcactgttgcgcgacttagaacaagtcacttagtctaggtcccaagcccctcttctgtaaagtgaggatactgttactaaacgtgttttgtgagggttgaatgctttatgcatggaagaaaccctttaagtcactctcaaaattttttagtaatggtaacatgtgcttgctttcatttctgttgtgctggaaaatggaaaaggttgatactggcatgcctcttcttttccttctcccaagccatttccttctagagattggttattaactgtttcatttattgatggttagatcatttctgcatatctcctcaccctcatactccctaaaaccttttcctggagcctcttactacagaatttttcattgcctttctcaacctcttttctcttatcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgagtgtatacgctccagcaggcagaatctggggagctgggctctcctttccacaggaggccaactctgcaacaaagtggaagtggatattgatttaggacacactgggggatctatggggtcatcccttctctcccaaagctccatcttcttccaggtgccttacgggtgaacaaggtgattgagattaacccttacctgcttggcaccatgtctggctgtgcagcagactgtcagtactgggagcgcctgctggccaaggaatgcaggtaagygaggcctctcatcttcctttcttagcctagtggttaatccctggatctctcagatcattgctccttactcttgtcctatgtggtccatcttagtgctaatagtatatttcacaaaacagctttytggtgataagacccttctcccaaatctcagcctgtgctccactcataagccagatagtacgtcaggtatttagcactgacacatccaccctggcgggacagtatcatttactaggctgcctttgtatgtttcagatactttaaattccaaatctttctctgatctttagatmctacaaaataattcctttccaaygcttatctctttaatcatttcctgccccatcaagttggaaagagctaacctctctttcctcactccaccttgtcctcacccaggctgtactatctgcgaaatggagaacgtatttcagtgtcggcagcctccaagctgctgtccaacatgatgtgccagtaccggggcatgggcctctctatgggcagtatgatctgtggctgggataagaaggtgggtgctctccattcttcatgytcccccaccatgttccctatggatgacagatctgtttcycatcatatactcctactccctccctgacaagatgcatggcatatagagtgcttggttatagaactgtttcagtatatccatggactatttattggcccagatatgaatcattgcatgtgttttgtaagcttgtcccttttgttaaacagttgatttcaagtttgtttttcctttttcatttctaaagttcgatgactttaccaaagtggtttcctaattccaatgttcttgtggtaatattaattcttttgttcactttttatgtmtcatatttgaaccyccatgttaccaacatcttcctctccaatttcagcctgaaatctttcatcttatagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatagtaagagaccaatgctcccaccaccatgcctgggaggagtcggcgggtggtggggggggtgatttaagattgagaaaccagcctkgccaacatggcgaaaccccgtctctactaaaactacaaaaattagccggacgtggtgacgggtgcctgtagtcccagctacttgggaggctgaggcaggagaatcacttgaacctgggaggtggagcttgcagtgagccaagatggygccactgcattccagtctgggccacagagtgagactccttctcaaaagaaaaaaaagaaaatgattgagagactcaaaggagggagagtagtagggaggaaattttcagagtcagaagaagggcattaaaggcccagtcatatggttttaagcttgcgcatgtgtcttgttgctgccttcaacataacatcagtgacaggaacttgctgaggtgaaaggtgactccatgttcttttctcatttgtccacagtgtaccacatgaaggaagatggttgggtgaaagtagaaagtacagatgtcagtgacctgctgcaccagtaccgggaagccaatcaataatggtggtggtggcagctgggcaggtctcctctgggaggtyttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaatacctctgtcttgtggctgaatggggttgggcctgtggttgttgggtggggcagaaagtaaagagacgctttttctggagaaggggctcagacccctatctaagaaatgtggcctcaccacatagttcttcctggggtttccttccacactcatctctccaagacctcaggaaggctgctcattgctgtccatggacacttgtttgcaatttcacataggttagggtcctttccatagagaggcacctggggactcctgtgtgytccattgttaatggtttgaggaacagggagtagggcacctaggataactgtttttgactttatagagtaggatgaaaaagcttccacttcactttaatatggtaatcatataaacaccataccatttatcccaaataacactttggagatattggatattgaatataaagacagacattaagggtctaatttcatgatgtgtcatgctgaattgcaagatggcaggactataattttagaggaagaagagatcaggaggactcccctaagtgaggagtgtggggaaaatgtaaaagatccaggttagaagaaagagacacacatcatgagattttcggaatcatgctggaactatggaccatgtcactttccagaaaataaaggaaacaaatgcttgaaagtaggagcatgagcttgagcatggagcttttttcattagagagagattcttaaaatgccagaatgaatagagttgtaaaactttagcgagcccctacttaaaatccctcctccccaccaccactattttaaactttaagtgactccttggtagtcacacaggtaacatttcaaaatggtgatctggaatccaagcgacccttcctttggggaatttgtttgtttgtttgtttttagtttgggaggtggtttcaatctgaagagtcctttctggaataaacgaatctttctgttgcataggaaggctctgggwcaggaaggatatttaaaaacctaattactgttctaaacagtgttaaaatagaacaagaaccaaagcycagtacsgggcatttccctcataggctgaaggtgcgcccaacataatttggagtacagactcagaggcacctgaacacgcgccagctcaaggtgctccggctgagaaggacggatgaagatgaacgctcagggcctactaaattcaaagtctgtacgtgaaaatcccctttggcctggtgagattggttggaaccttctatttaggagagcccggctcgctcgcctaaaactggagcttgcatggaagagggcactttttttttttttagacgaagtctcactcttgtcgcccaggctggagtgcaatgacccgatctcggctcactgaaacctctgcctcctgagttcaagcgattcccctgcctcagcctcccgagtagctgggattacaggcgtccgccaccacgccctggctaatttttgtatttttagtagagacagggtttcaccatgttggccaggctggtctcgaacccctgacctcaggcgatccgcccgcctcrgcctcccaaagtgctgtgattacaggcgtgagccaccgcgccggaccagaaagaaggcacttcttaatagtaggctcagagcttgaagtagtaactttgagaaaattcagtgattctccaattacaaagcattctccaattacaaagcaaggacaacagatamagttgcccttgagacaactgtattttacttaatgataaagaaacatttttgcagttttatatcccagagtaaccgccactaaaggcgagtgagactcattgcaggcctgtacagtgcgaaccagagttcgggctccagttccgctgtctgcgggtctcgcgcgccccctcccggcggcccagcccagaatgaaggccttggytggggaarcgaaagcgaaagctgcccgagccctgacgcccgccctggccgagcgtagctggcggaccagagccggtagcgaggttgggagagacggagcggacctcagcgctgaagcagaagyccccggagctgcggtctccccgccgcggctggtgagttggtgcggaggggaacctggagcgccaacaggracgcagcccaagtgactacccactccacgctcctgcttcccagtccctctgcacccggcgataggagggagcggagcccggaccacttagctcgccgcggcaggcgggggtgggggtgggggtccggggattttttttttttttttttttaagcacgaggctcctgatggtcatgcttccagctccccagaaggccgaaagctgtctgtcgtaggaggggtgtacggatgagcaccggttactcaggagagctctcagggttgaataggatraaatgagaagccgatggacgggttaggcggagccgggcgggtaggagggcagggacaaggattgggactccacccccatgatttctcatctcgtatccgttgacagagccatgyggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctragagggctgctgggatttgtggggacactgctgctcccgctctgtctggccaccccmctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagtcaggagaggacgttgtgagttggaggtggtaaaagggcmtgsgcaccagcacattcttgtgttatttttcatkcctctttcaggtgagacattaatccctcactattctggtcgtgtgattgacatcctgggaggtgattttgacccccatgcctttgccagtgccatcttcttcatgtgcctcttctcctttggcaggtaggtrrtgggcagctgggtccatttgctagccccaaatctttataggggtcttcacttccctaactccatttctaggccctttcaggcgcaaaacacaaaaatacttaaactaaaatatggtgaatgtagtcaccattctgtttcatctatccattcatttcttccttcgttcatattcatccaatatcttcaaagtttatctgatcttattataggaacaagttatgagtgaaggtagtacaaaaggaatttaagtctcagrtggaatgtctctcagttgtctctcaacattcctaggtccatgaaattccatttctttctgcctcctacctcctacccctaagtctgtctccaaagtatctctccagggtcactcyctcaggatgggtatgcttctccctytcactcttctttcccagctcatcttgcyartccctgaagatcttactctgaggcttatcacctttctttccagaatcattactcttttcccttcacttgctttcctttctytttctagacatactcaaacaaacaaactgtttgataaggctgggactgggatgaggtgagcgaggcacctggggtgcaaagtttaaggaggtgtgcactcaccttacccaaatcccagccggcctgattgtctctatttttatggtcatacttaatttagagtaccctcgaaaaccatttcattgtgccttcattccatcctggctgctttctgctgaaactacagtygtgcactgcataaygawgtttaggtcaatgatgggccacatataagatggtggacccacaagattataataccatatttttactgtaccttttctatgtttagatacacaaatacttacttctgtgttacagtcgcccacagtgttaggtgcagtyatatgttgtacagatttgtagcctaggagcaataggctaaactacatggcctaggtgtgcagtaggctatgacatctaggtttgtgtaagtacactctatgatgttcatacaacratgaaaccatctaaygacacatttctcagaacacatccctgtcattaaagtacaaaccctcattatatcatgtctgactmtyccaaacgcctcttcaatatggtaactaaatttgtattagaaacatatattttgtaaaatacatgcttttatgctttatattttttcctctaagtgttactgtagcatgtagttggtctaagagggattttccaactcgaaggatgamagatgggaatcacatgactctggggctccagagaattgtgggggcagggaatttattaytgcagttcccawgatgaagtatctaygatgacagagaagggctytgggtrtggggcaggaaggagaccaaggcggaggagacgcacagagggacaagcctgagggaygcygggacagaagcaagcactgggatayttgttttcacaatatcttttcccttctatygtagtyttctattgtgtctagtacagagtgcactccataaatacttgtaaatttgtacatgttatgattttgttctcacatctagctcaccatgtctcctctttcttcttcctctgtgtattccttacctcttctctctctgtgtgtctgtctctcatttctttctcttttgcccctcctggcatgctttccccygactttgcgcttctctgcactcctggcttgctcctctgtttcacccgctggcttgctccttctctgcatctcccycycctcttattctcctaccccacagctcactgtctgcaggctgccgaggaggctgcttcacctacaccatgtctygaatcaacttgcggatccgggagcagcttttctcctccctgctgcgccaggacctcggtttcttccaggagactaagacaggtggggcctggwgtccaggtctgagattcccatggacatcccttgcccctcagtgaccttccacccacagcctctcctcctgccttcacccgtatgccaggacytggggatgcttttctcttgtttgggacagggtggagaagcagcctccactgtccctctgcaagtgaaggaggatgttcagaggagggggctgtgtcagagggaacggtcaggagggagtttctgggggccctgcagtacacatggtttcctttttcctcacctgctctgtccttcttaggggagctgaactcacggctgagctcggataccaccctgatgagtaactggcttcctttaaatgccaatgtgctcttgsgaagcctggtgaaagtggtggggctgtatggcttcatgctcagcatatcgcctcgactcaccctcctttctctgctgcacatgcccttcacaatagcagcggagaaggtgtacaacacccgccatcaggtgagcgtgcatgtaagggaaccccaaagggagaataaaactgacaggtgaggaggcttccacatttgtggctagaggatcccctagagagagatgttctcttctcagccrttaggggagaagrtatattgtagtatatactacattttgtttgtccagccatccaacaatggatatttgacttcagaagattcatgattctccagaactgtaaacaaaaatgtaaagtgtatgtgaaggtatgggggagggaataggaaggggagatgataggcgatgataacttttcattagcttctcaaaggagtctgtacatcccccgcccccactgcgaagattaaaaatggtttcttagaggcttttaggcagggagattttccctttaaaatcagcagaagaagtctggatgcagcatagggaaaggaggcgtcatca

SEQ ID NO: 13400 - DNA, 18228 bp, Homo sapiens
  misc_feature (1)...(18228): n = A,T,C or G, or insertion/deletion polymorphism (see Tables 1-2)
cggggctgggggagggatagcattaggagaaatacctaatgtaaatgacgagttgatgggtgcagcaaaccaacatggcacaagtatacctatgtatcaaacttgcacgttgtgcacatgtactctagawcttaaggtataataaaaataaataaataagtaaaaatgccttcagcagcctgaagttctaagagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaayaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccgggttagttgtgtttctacagtctaacgcgtagcataagggttgggagaaatcaggtgtcctcaataataggctccgtgtggaagccgcttccggtttttaagtttaacgcccaaattcatagaaatgggactattgtggggctcggggactaaggagggatggtggggagagggcaaaaaagactcgggtgaggtgcacagtggggccagaccttgcggctaaaagcagcagttattttagggatacgcttccccagaaggtgacgtgtctccctggctacaggtgtttgttcacctggatgtgaacaaaaatcctcagggcgccaactcccagtccgcatctctctgcccccttcttcactcttcactgttttgtttgtttgtttgacggagtctcgctctgttgctaggctggagtgcagtggcgcgatctcggctcactgcaacctccgactcccgggttcaagcgagtctcctgcctcagcctcctgagtagctgggactacaggcgcgcgccaccacacccagctaatttttgtattttcagtagagacggggtttcaccgtgttggccaggatggtctcgatcccctgacctcgtgatcctgatccacccgcctcggcctcccaaagtgctgagattacaggcgtgagccaccgcgcctggcctcactcttcactctttcaagccacattagggctgaaaattcaagtaggtgttaactacagagagttggggagtttagctcatagttagaaacgggctgtcttctcagttatctctactgtggaaggtgagaaaagtttgtcttccttgtagtttctgcctgcttcaaagaccagcagttctagttctcctacctcatgtattcattcactaaaaaaaaaaaattactgtgcatatagaacctagggaggagataccaagccgaataaggaggaacttactgaggtagacaaaaccagatcattataatacagtgtttaagtggagagagactgagacagatatggacagatataaagcgagaaatggctaggatgttttgagagcataagaggagacatccagtttgcattcggtcacggaaggtttcctggaagaggtaatgcttgagctgaaacttaaagagtaaacataagctagcctgataaaacataagagtagaaggacattcaagccaaaagggacagcatgagcaaaggcatagaatctagaaacggcacaggcaccagcatgatgtgtttgaagaaacaaagtagctcagagttgttagagcatcaaatgtgaggcagggaatggtagacaaagctaggagacatatttgagcacttgaattttctcttggaggctttgggataccgttaaaagttattaagctgaggaattacatggccgatttgggtttagatcagtcacattggcaataaggggaaaatacaattgacagggacaagactgaaggtaagagacaagttaggctgtcattaatctcagcgaaacaaaaggcaatctaaactaggcagttgtgaggatagagaggagaggtagatttgtagaatattcagaaggtaaaattagcataacatggattagtgtagtaagggatagggagggtcaaagatgattcccaggtttttgccttgggtgaatgctcatactgccacctgaaattgataattcaggaggataattcaggaagtgtatccaaaggaatataaaaaattccagatggaaatgctgagtttgaagtacctgtgaaatgaaggtcaaaacgtcaacatacagttggatactaaaggctgaagttctgaggaaagatctggaccaaagatgaaaatctgggagtcattagcctgtgggtgttagttgaaaccaggactatatgaggctagaagggagttacccagggaaggagtctatcattaaatgagttgtgggctgagggcagacactatcagagaagtgagaggagaatccagatggtatcttcaggtcttttgtgcttgctaaattgagtggagcccattctattctctgttctgggcagacccccacttaccagtatagccttgtcttcagctttgctaatgttagaaaaattaggtaaacatattaagaaaaagtaggctgggcgtggtggctcacgcctctaatcccagcactttgggaggccaaggtgggcggatcacgaggtcaggagatcgagaccatcctggctaayatggtgaaaccccatctctactaaaaaaaaaaaaaatacaaaaaattagccgggcatggtggcgggcacctgtagttccagctacttgagaggctgaggcaggagaatggcgtgaacccaggcaatggagcttgcagtgagccgagattgcgccactgcactccagtctgggtgacagagcgagactgtctcaaaaaaaaaaaaaaaaaaaaaccggctgggtgtagtggctcacgcctgtaatcctagcactttgggaggccaaggcaggttgatcacctggggtcaggagttcgagwccagcctggccaacatggcaaaaccccgtctctactaaaaatacaaaaattatccgggcatggtggtgcacgcctgtaatcccagctactcaggagactgaggaaggagaatcgcttgaacctgggaggtggaagttgcagtgaacccagattgcgccactgcactccagcctgtgcgacgggagcgagattccatctcaataaaaataaaaaataaaaaaaataaccacatacttttcttttgaggagagggggactgcccttggccccaactactctctcaaagacctcattctctgctttcagtatgtggagaacaacaagaatgctgacaacgattggttccgactggagtccaacaaggaaggaactcggtaggtagaccctcttgggaggtgtggggtgggagtcttatatgagttaggcaatttggtatcctagcgcccactaccaaagctgccctgtcacatgttagctgtctccactcccacagcgccagagttccccagttcccatcctatgagtctcccaggctggtggcstaagccaagatatcatttgagtactggaagaataggcaaattggactgaggtttggtctttgttacaggtggtttggaaaatgctggtatatccatgacctcctgaaatatgagtttgacatcgagtttgacgtgagtgtgatagagtgggaaatatgaaggttagtagaaggggagggattagatgatgggtaacaagctatcctttcttgaagggaccaaagaaaactttaaaaatgggagagaaaagctgaggtttgaggcaagcataagttatatttactcatctccacatccagaatcctggtatggatgtgctccttggggagttttacttaacatttcagtttaaccaagaaatatgtatgtctgattatattagttcctttctatcctgattctgttttattaaggttttataatttctccagattcctatcacatatcctactactgccccagaaattgcagttcctgagctggatggaaagacagcaaagatgtacaggtaggactgaataggagatggcaaagagtcaaagaaagccttaaggaagaacttcgtggcgggagggagagcatcaggaagaatagctaatggatgcttggcttgatgtctgggtgatgggatgatctatgtgtaaatcaccatggcacgtttacctatgtaacamacctatacatcctgcatgtgtacctctgaacttaaaagatgtaaggaaaaaaaaaaaaaggaagaactttggaggcagagattttcccagggtctgctggcctagtggggtgccaggccctcctttgctgagcctaagcaaagtacttagctgaacttgttctcaattctgatcactagtagtcttcctatgcccccaagaggctgctgtgctttatggtaaactttgcatgtcaacaccttcttcatgtccctctcataggggtggcaaaatatgcctgacggatcatttcaaacctttgtgggccaggaatgtgcccaaatttggactagctcatctcatggctctgggggtaagttttgtgtatttggcataaaaggagaaagagggacttaggccctgagcagtacaagaaaagcagctaagaataaaaggaataacagtgatgtcccttaagymtgttcccccagaatctgtctccaggaaggagcttctaatggaacaagaagcattgactggtagtaatctcacaggattttccttgtattgcagctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtktctaaggckgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggtagcctgtggttctcattgggagctgttaacagagggcaagtgggctgaaacctgaggcacatgaacagctacgccgggttgggttgggaaagagtcggaaataggggatgctctggtcaggagtgggaatgaaatgttgactgttccccctgctgctcagatctacctttgtcctttagtggtgagccatgctttgccctaccgtgttagcctgcaagaagtggttttgccggaccagcacttcccgccctccagggatcttcccagccctctgtgaagtgctagatgcttctccactggtctgcgggctggacccaggcctgcagttkgccatacttgcgcccctgctgtttgggaaggatctgtgctgtaagcctcgcggccatactacgactgtcagatctccatccctatgggctataggatggggcgacggcaccctatacctcagggacttgctttggagtcatggattaaagacctctctgggcagcgttgagaaccagcgaccctraacttggctgcgtttccatggtgtcgatcgcggagccgtgggggcgggctcacgcaagcgccaagggaccggtgggaggakttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtacgggccggggcgttatggcatggcggggtgtgggggggcgcagagggaagactgctccagacccgagaggacactctccacaaaggcgcgtggggcccggcggggcctgggagaactgggctggagggacagcatccctggaccgcggggaatacgccgccggattccgtagccaatcagcggtctcggcctttctgccctcgaggggggcggacccggctaaagccctgctgtggtgggagaagtgcagagattaagggtcaaggagttgttcgtcctcyatccccgactactgctttctgaacctcgacaccrtgtcggaggtcggaggtgggggagggaatggatcgtaagtcacccatatagtctgcttcatttgcagcccagagaggcagggattcgaggatggagggctgtcttttgggctgttattcttgcatctacactaccatttggctagggtcttaagtgacccgaggcacatcctactttactagccgggtatggggtcccatgttacgttagagccgagataggagttatcactggcttttcagtaaagatgtgttctgcagggaggggtcgggagtatagaaagggtcaaagccatgggctgcttatctttcattcatttgtttacccaatagatactaagtatttactttgtaccaaacacgatgccaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtatggaatggggcaaagcaataagggaaaattagtgtggcagggttcagtacagcagcctgggttcccatttccccccatattcaaatgctgacactctcttctcctcccaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgyctggctcaccacccccaacagtggctttgcctctcccatctcggaccaacttagcccgttccaagtctgtgagcagtggggacttgcgtccaatggggattgccttgggagggcaccrtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggtgaggacttgccacacacatggccttcatgcccatgttcctctgtgctttcctgccatcctctgccttttctgtcccccatttccctgaagttcctttctcagcccttcattacagcagtttggacatgcctctcccttgcttaaatacccttgagcctcctagacccttttttgggttgttggtgactcttcagcatggtgtgccatttcggtccccaggggattaccccaactatttagaattcttctttgggtccccaggcccttcctttcccttgcttgcaccttctctactgggactctgcctaggcctaattaatctctggagctaaagagaggcaggcacagaacatcttagcaaacgtggttgcacattttctgagctaagtaagctaggctgattgcaattggagccagcaggagaagggcaagaaggggccacgggggcaggagggggttttgggggcagaaaggtgggagtggtgagcagctgggcaaccatgccggtgctgggggagttgccccaggagctgcaacgtcarctagctgagcagaggagtaagtgggcaacaggtgggacagccatggctgagtcygtggtacattcagctgtgatgggcttactgctcatgaccagtgaggtagggagactagaatacctagtgaggggaatagggtagagtttggggatgaaacatgcatgggatgggggaggcagtgggcagcatgctgttgaaaggttaaagtgccaggtaggatatataggaacttgccgattgtactctgaccttccaggctcatcacacactccttctgggctctggtcatgttggccttcgaaacctgggaaacacggtgagagctattctcctatctttcctctctaaaaggaatgtgaaatggtgctgggggtggggaaaacccacgagcttggggaaggcatgtggaaggagagctctgaagctcttctaaggcttcctgggcagtggtctggagagataacagcagtgtccctactgctccccagtgcttcctgaatgctgtgctgcagtgtctgagcagcactcgacctcttcgggacttctgtctgagaagggacttccggcaagaggtgcctggaggaggccgagcccaagagctcactgaaggtggggcaacaactcctgctccctctgttcaagtccctttttccccaaccacttgcaggtccatctgccactggtggtggcccccaacccttaaatctggcagttgtatctacttttcccagtgcctactttcctaaaggttattttctaccctctgagccaccttttgcttgcctcttccagacattaacctttgtttgccttccccactcccatcccaacagcctttgcagatgtgattggtgccctctggcaccctgactcctgcgaagctgtgaatcctactcgattccgagctgtcttccagaaatatgttccctccttctctggatacaggtgggagagctggaggctatgggatttctctctggccatgtctgggggtagggccaagcaagggccctggcagcattgttctgagccttgagatgttcttcatccaggaagtggggaccaatatctgggcagggaatagtgtctgtggactaggagaggagtcagttgcccatactctttgtctggctgtagccagcaggatgcccaagagttcctgaagctcctcatggagcggctacaccttgaaatcaaccgccgagrccgccgggctccaccgatacttgccaatggtccagttccctctmcaccccgccgaggaggggctctgctagaagaacctgagttaaggtaagggtcgttccctctacctcctttccccgtagtttatcagcatcattcacacttcatagaactaaactagtaaagattgaagatgtagggtccagggaaaccctttagtatagaaaatagtatgagaagcaacatagaagtagaaggaaggaaggaagagggggagtctaagggagcagatggaggcagaagatcatgctagggatgtcaccaaattgaagaaggggataattcatttacaggtagaggaagacagcatattcttcccttatgtacattcctttcttttcctctcacctcggatttccctagaaagttcattgaggcattattcttttgacttttccttgaaatttagggaaggagcaggggtgtggatggggagtagggctctgtaggttgtttcagtgggtgttgggggtgcccagtgttcctgctgtctcatgggtgctccccacttcctttgatctgtggtagtgatgatgaccgagccaacctaatgtggaaacgttacctggagcgagaggacagcaagattgtgggtatggaatggggcaaagcaatgagggaaaattagtgtgtgaggggggtacaggcttggggggaaaaatcgatactatcaaggggtatgggaacaagactggatgatgcaaatgtgaagctgtgtgaagagttgattaggagtgttggtagtgggaaaggaagggtcaagcaaaggggcaggaagagatggaaatccaagaaatcatctcataacatccaacaatgaccttttctcctgtccctgtgcttctgtctagacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagtatgtggaggttcacargggatacagtaagggtgggagacctggggggactccatgtggataaaagggattgcatgatgtcttcatatggggaataatatttatgtatctgggtttgtgttggagtctcagatctgttctagtactcctagagcaaaggggagaagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaaktctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggtgagtctggtggggaaagtcctaaggagccaaaggagtgggggcacagctctgattatagaacttgatcatctccaaccccgcaggaagtcctgtataccagctgtatgccctttgcaaccactcaggcagcgtccactatggccactacacagccctgtgccggtgccagactggttggcatgtctacaatgactctcggtgagaatagcctcctatttacatcctgccccattcccactcagccctgacaccctccccttctatgaagctccaggagagcagagtgccaggtgaaaggagaggtggaggtcttgcctgatcatttcctggatgctctgaggttcggtcttgtagggagaagggagtaaacaggaatgaccacaaccctttcccgatctccttttttcctagtgtctcccctgtcagtgaaaaccagktggcatccagcgagggctacgtgctgttctaccaaytgatgcaggagccaccccggtgcctgtgacacctytaagctctggcacctgtgaagccctttaaacacccttaagccccaggctccccgtttacctcagagacgtctatttttgtgtctttttaatcggggaggggggarggggtggttgtagctccattattttttttattaaaaaatacccttccacctggaggctcccttgtctcccagycccatgtacaaagctcaccaagcccctgcccatgtacagcccccagaccctctgcaatatcactttttgtgaataaatttattaagaaaaaatgatgtgcttatttgtatttttgcttagggggtgatagagaactgrgccaaattggagtcttcttgggacccaagttccctctctaacaggtgggggcgctctcagagccgagggggaaggtttcggggatggtgctggacccggacctgtgtcccccagcagtgaaggttatgtactgggaggaaaagaggaaaggcatacttgagtgaggctgcgtgcaggytctggggcgactggtttggtcggcgatgggggagtgccactgttgacaaacacygggtacgttgccgggcggccctagctcccgtaggcccggtctgttgctaacatcaaggagctgtttatggagccgcctccccgtggactggccttaagtgtccctatctattctccctacgaccaaagctcctgcggccttccctctagggttgtcaccctagctggacctggtaagcttgtgctggggaacgctaactccagcattaagcgctcgccgcctcggtcctgaggagggcagtgacgggtacggccgctcactcccagctcggcgctaacacggttaacctccagctcttacagctgccgtcgctccgcctctgccagttcaatgttttattggtgaacgtgatccggggccttccaagtcccgccaatccagatgtaggagaggtagggttaggcgcgtgccgcgagaacagagtggacggagmgtaggagagaccgaaaaggctgggggtgggagtagcggatttgaagcacttgttggcctacagaggtgtggcaagcagagcacctcagaactcaggcgtactgcccgccgcccgagccstgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcanvggccggaccgtggtcgtgctgggcggargcaycagcggcttsgccgccagttaccacctgagccgggccccctgcccccctaaggtgagtgctccacttgtgccagagggagcttcatttaatgctcttcccatttccatcaaaagctagatggatcctggccctctgaatatgcctcttcccctcccctcctgacctctcgscggcggctacaggcggtgctgcagtgtctctccctcttgtcgccaggtggtcctagtggagagcagtgagcgtctgggaggctggattcgctccgttcgaggccctaatggtgctatctttgagcttggacctyggggaattaggccagcgggagccctaggggcccggaccttgcycctggtgagaggcttgtgggatgtctaggagaggttgtggagggggcttccattggggaatagagtttaggggaggaagtatgtttggtgggtcagatcttcccttagtttctcctcttctgagggcatgtggagagcaggtttctgagcttggcttggattcagaagtgctgcctgtccggggagaccacccagctgcccagaacaggttcctctacgtgggcggtgccctgcmtgccctacccactggcctcaggtaacaccagcacctccgctccttttactgtgccctcatcctcatatgccttccatttctttcttcttttctttttttttttttttttttttttttttgagacggagtatcgctctcgcccaggatggagtgcaatggcgcgatcttggctcactgcaacttccrcctttcgggttcaagcrattctcctgcctcagcctcccgagtagctgggactacaggtgcctaccaccacgtctggctagtttttgtatttttagtagagatggggtttcaccatattggccaggctggtcttgaactcctgaccttgtgatccgcccgcctcggcctgccaaagtgctgggattacaggcgtgagccaccacgcccgacctgccttccatttcttcatctccctgtcagccttcccagcaaaaggaagccaaatgagtggaaatgaccccagygcctggagctggggaggyatgtcaggagcttccccctcactatgcctttctccatgcagggggctactccgcccttcaccccccttctccaaacctctgttttgrgctgggctgaggkagctgaccaagccccsgggcaaagagcctgwtgagactgtgcacagttttgccyagygccgccytggacctgaggtgacacttgcccagaggccccaaacctcttccctcctaaaccagctgcagagctccctgttcaaatctaccacctaggggctcttctgtatcatttggggatgccctcttctcttcataccccaccccctcataattcccaaaactcattattgggagtgaaggccttcatttccatccgtcacagtgggaatgtcccccaayccaaaccctatccyaccctcattccctaccaaataggggctgtggaaatcagtcagtgtagattattttttcgctccttagtcctagtctcacccttaagvtggcgtctctagccatggacagtctctgccgtggagtgtttgyaggcaacagccgtgagstcagcatcaggtcctgctttcccagtctcttcyaagctkagcaaacccatcgttccatatkactgggcctgctgctgggggyaggtgaggggggattgattcagagggtgaaaatattaagtactgccaaagtgagggagtggggacaaggggtgctattcaatgattctttttttcttttttgagacggagtcttgctctgctgcctaggctggagtgcagtggtgcaatctcagatcggctcgctgcaacctccgcctcccagattcaagcaattctcctgcctcagcctcttaagtagctgggattacaaacatgtgccaccactcccagctaatctttgtatttttttgtagagatgcagtttcactatgttggccaggctggtctcaaactcctgacctcaagtgatccacccgcctcggcctcctaaagtgctgggattacaggtgtgagccactgcatccagcctcaatgattcttctttgcttcctctgcagggcggaccccacagccagactcagcactcattcgccaggccttggctgagcgctgragccagtggtcacttcgtggasgtctaragatgtygcctcaggcccttgaaacccacctgactagtaggggggtcagtgttctcagaggccagcsggtctgtgggctcagcctccaggcagaagggcgctrgaaggtaggggaacccctggagtgtaatgaacctgtcagtgtttccatctttatccaagtggcttaactaggccagggccgataggactggagttcctcattgtttttgtgccttagaagctacttagacatgggctaccccagaatcctaggccctatttgtgaaccttcctcaaagagcctatgcaagtctgtggatagaagtagtacttataagtggcttagagataggggaaagaacccagcttcactgaacatttcagaacagccacactggcctgtctggtccacttcctggagtacacagaggaatgattttttgtgaagtctacatagtcacccaatctcttcatcctgggtcagtacacagtctccccggccacatgggtgcctgggaaactgagagtgaggcaccagaagtctcttttcactcatcaaattctcattttctgggtctctcaaatgttttcatgctctcaggtatctctaagggacagcagtctggaggctgaccacgttawtaktgccattccagcttcargtaatggaatagccaccttccccttccccaacccctaccagtgagaagcaaaagctataccttcctgggtcagcaggaccacaccatgcccctgaactggtcatctctatgggagtctaatcccaaagaggactgacaactgtaatgggaatgccttctgagtcaggcctctgcctgatctctagtgctcagtgagctgcyccctgctgaggctgcccctctggctcrtgccctgagtgccatcactgcagtgtctgtagctgtggtgaatctgcagtaccaaggagcccatctgcctgtccaggtatgataaagggacggagaggctgggcatggtggctcacacctgtaatcccagcattttgggaggccgaggtgggcagataacaaggtcaggagttcgagaccagcctggccaacatggtgaaaccccatctctaygaaaaatacaaaaattagccaggtgtggtggcttgcacctgtaatctcagctactcgggaggctaaggcaggagaatcgcttgaacccaggaggtggaggttgcagtgagctgagatctcgccattacactccagcctgggtgacagagtgagactctgtcccccccacccccccaaaaaaatgggaaggagagacagcctcagctagagccctttccttctgacgcatgaatgtccttctctccagsgatttggacatttggkgccatcttcagaagatccaggagtcctgggaatcgtgtrtgmcycagttgctttccctgagcaggacgggagcccccctggcctcagagtgactgtgaggaggaggaaactttgcctagtggcatttccagagggctcctctgtgctccattgtaggcaaggccagactgatcagtgctatattccctccttaggtgatgctgggaggttcctgrttayagacactggaggctagtggctgtgtcttatctcaggagctgtttcaacagcgggcccaggaagcagctgctacacaattmggactgaaggagatgccgagccactgcttggtccatctacacaaggtaagttgggataaacttccctcagctctccactgaaggccttgaagacagagactggaacatttgtcactgtatgtcagccaaggcctaggacatcaataataaacttttccctgcatcctctcctctcttctcagaactgcattccccagtatacactaggtcactggcaaaaactaggtaagttgggaaaacagctgggctgaggagggccaaggacatcagacccccagctaaaacattcctttcatcctttccttccagagtcasctaggyaattcctgactgctcacaggttgcccctgactctggctrgagccycctatgagrkagttgctgttaatgactgtatagagagtgggcgccaggcagcagtcagtgtcctgggcacagaacctaacagctgatccccaactctcattcatgaaaataaaaattgctggagcttggcttggtctggctgttctatcacctataggcataagaatgcggggcagcaaagaggcaaagtgtgcctgggatgcagraagcaggagcagatgcgagacaaagtcctttattagaaaatatatcaaaatcccagccccctgagccaggaccagaagagggagctattccagcataggcagaaaatgcccagggaggggcttccttcaccaaacaacttcccgggaaccataaatagaataaatattcacagaggtccgaggagaagccagatcactcttctctccatggaagagggaggggcttggggtccagccctgctcctactctaggggcagggactcctaggaatcgtcacataaaatcatgacatcaaggattcrcagtcataagccctacaggagaccctagagagagggacccctcaggtctacaggagcccagctccagtccagcagtgagggagaggcccctaccccctagcacggcaccagagttcagttcc

SEQ ID NO: 13401 - DNA, 18705 bp, Homo sapiens
  misc_feature (1)...(18705): n = A,T,C or G, or insertion/deletion polymorphism (see Tables 1-2)
ggaggaggtgcctgtctctccttctagaagtgagcagtaaggctgggcacagtgacccatacctgtagtcccagcactttgggaggccaaggtgggaggatcacttgaggccagaagttcaagaccagcctgggggacatgatgaaacctggtctctacaaaaaatacaaaaaaaggcagggtgcagtggctcatgcctgtaatcccagcactttgggaggccaaggcaggtggatcatgaggtcagagttcaagatcagcctggtttgagaatctggtctctggttcgagaccagaccaggagttcgagaccagcctagtagatagaagatgaaaccccatagctactaaaaatacaaaatttagccagcacggtggtgggcacctgtaatcccagytacttgggaggctgaggcagaagaattgcttgaacctgggagacaraggtggcagtgagccaagatcatgccactgcactctagcctgggcatcagagcaagactccatytcaaaaaaaaaaaaaaaaaaaaaaaaaaaaaaaaaattagccaggtgtgcttgtgcacgcctgtagtcctagctactcagggaatggggtgggggctgaggtgggaggatcacttaaactcaggaggtggaggctgcagtgagctgtgattgtgccactgcactccagcctgggtgacagaatgagaacttgtttccaaaaaaaaaaaagaaagctgtaagactgcagggaacccatggatggtgggagggtgtcaggggggcatgatttctgtttgctaggtcaggttcaggttcttctatgttatacaaaaccaaagtgaggtaaagaggtaaagagaacagaccagaaaaccagaaactggaggataatatggtaagagaaagagctgagtgggagagagatctggaacaacagtgtaggctgaggggagttggaagggatagttttgggaagaaataacatccaagtagaaaatgttgaatggaagagggagaggaatatttttttttttgcaacagagtctccctctgttttccaggctggagtgcagtggcgccatctccacctcccaggtttaagcaattctcttgtctcagcctcccgagtagctggaattacaagcgtgtgctgccacacccggctaatttttgtatttttagtagagacagggtttcaccatgttggtcaggctggtctcgaactcctgacctcaggtgatccacctgcctcggcctcccaaagcgctgggattacaggcatgagtctctgcgctcggccgagacagaggattttaaagacattgggctgtccattaaaatgtgctcctaatccactgcccctttcccctgtctctgatatttccttgagaaattaagtagagatttaaattagtttttgattactaaactgggtttcttctattgtgttatgtgccatgactgggccagtgtgggccccaggatttattcagaatattgaaagacaggatgttgtggtggaaaccagcatgttaaaatttaagttttcagaaacataacagttctaggtgatgactaagtccagggtgtggccagggtgagacagagcagaagggaaggttcttgaaaacagggagcttacaaattaatgtaaaggaatggccagaagatagtagataggcctttgtggtggctcacaggaggctcacttgaggccaggaattcaagaccagcctgggcaacagagtgagactccgtctccacaaaaaactaaattagctaggtacacacctgtagtcctagctacttgagaggttgaggcaggaggatcaccttaacccaggagttcaaggctgcagtgggctataatcatgccattgcactccagcctgggtgacagagtgagtctctgactctaaaaaagaagatggttagatacagaaggagacagaaagtgaaggctgggcgyggtggctcaagcctgtaatcccaccactttgggaggccgaggtgggcagatcacctgaggttagcagtttgagaccaccctgaccaacatggagaaaccccgtctctactaaaaatacaaaattagccgggcgtggtarcacatgcctgtaatcccagctacttgggaggctgaggcaggagagtyacttgaacccaggaggcggaggttgcggtgagctgcagatcatgctgttgcactccagcctgggcaacaagagagaaactccatcccaaaaaaaaaaaagaaagtgagsgtcagtcctgtaagacagaacgcgatggaggarcagaggctcaaaggaagggtcctctgggagaaccacattttctctctttctctctttctttcttctttgagacagratctggctctatcactcaggctggagtagtgcagtggtgcaatcagctcactgcagccttgaactcctgggttcaagtgatcctcccrcctcagcccygtgagtagctggaactacagctgtgagccaccatgcccrgctaatttttgtatttttcttggaagggaattttgccatattgcccaggctgatcttaaactcctgaactcaactgatccacctaactgggcctcccaaagtgttgggattacaggcgtgagccatgatgccaggccaagaaccacatttcaatgatctgtttaagtctgtcttttccactacacagtgatattcttaaaaaatcaaggctttttgagttatactatatcagaagctaaaaataataataaaaaataataaaagtaaaacaaacaaaaaatcaagtttgggaggccatagcgggaggatcacttcaacccaggagtttgagaccagcctgggcaacatagtgagactgtctcttcaaaaaaaaaaaattataataaaaaaaatcaaggctttgtcttggcttctatttgtgctcaaaagttttccatagttctaatgatcacaaaaccccttaaggctagagttcattttacagatgaaatccagagtgtattgctcagtacacagccaatgggtttcaaagttggtattgtatttaaacccagcattatctcattttgagccttcacaggcacctcaaactcattatgtctaaagtttgtcatctctaccccttccccaaaatgtgcttcttcctaagttttgtttctcattaaatggcaccacccagtggtccaaattagaaatctgggtgtcctcttggagtccaattcyctaacttggcacatccagtcaatcttcaagtcctgtttgcctcctgaaagttcccaaagttactttcttccctccagtcccacgggtattacctattctgcatgagcttcatcttattcctggatttctgcagtaactttctaaatagtctccctgcctctggtcttgactacttcaattagtgctccacatttcctaaagttctgatcatagcactctctatttacagcactttaatgccttcttcttgccctctggataagacccaaactcttttagcatggtttgtggagtccttcattatttggcatttgcttacctctccagtctcatatctcaacattcccttcactctactgtccagccttgcgggcccagttttaatttcccaaactccctaatttcttcctcatttccagaattttgcacttatggtttcctctgcttggaacactattcatctgttaaaagttaattttctagctgggtgtggtggcgcatgcctgtaatcccagctactcgggaggctgaggcaggagaattggctgaacccaggaggcggaggttgcggtgagccaagatggtgccattgcactccagcctgggcaacaagagcaaaactctgtctcaaaaaaaaaaaaaaaaggtaattttcagaagaaggtaaaattatgacccttaaactgttgaagaaaaaattattctgacacttgttawaacagtaaggaagactattgcaatagtcaatgagcagaatcagagtcagtggatggaaggaaaattacattaaggctaggaggattcttgctaaactgacctaacaggatctttcctgaaggcaggtgagggtgatcagatagatcagctatcaagggtggagaagcgggcagggaattatccctaaactgacttggcaggattcttgctataactggctaggcaggcccaagacagcgcataaggacaagacctagccaaaaagaggccttagaggagcctgttgaaagtctggttaaggagatggtctttgtcaataccaacataaaaatgaacacataggccgggtgcagtggctcatgcctataatcccagcactttgggaggctaaggtaggtggatcatgaggtcaggagttcaagaccagcctggccaagatggtgaaatcccgtctccactaaaatacaaaaattagccgggtttggtggcgggagcctgtaatcccaactactcggtaggctgaggcaggagaatcgcttgaatccgggaggcggaggttgcagtgagctcagatcgcaccactgcactctagcttgggtgacaaagcaagactccgactcaaaaaaaaaaaaattctccttgaagactgggtatttggraaaaaaaaaaaggaaaggaaaggaaaaaaaagaaggaagggaagggaagggacgaagggagggagggaggaagaagggaaggaaggaaggaaggaaggaaggaaggaaggaaggaaggaaggaaggaaggaaaaagagaaataaaattaagaggcctgatgctgtggctgacgcctgtaatcccagcgctttgggaagccaaggtgggcagatagtttgagcccaggagttggagaccaacctggacaacatggtaaaactctgtgtcttcaaaaaatacaattagctggatgtgctgttgtcccagctactcagctactcacgggtctgaggtgggaggatcccttgagcctaggaggttgaggctgcagtgagctgtgatcttgccactgcactccagcctgggtgacagagtgagaccctgtcacaaatttttaaattaaaaaaaaaaaagtaaacaaaaaggccgggcgtggtggctcacacctgtaatcccagcactttgggaggccgaggcgggtggatcwcctgaggtcgggagttccagaccagcctgaccaacacagagaaaccctgtctctactaaacatacaaaattagccgggtgtggtggcgcatgcctgtaatcccagctactgaggaaggctgaggcagaggtcgcggtgagccgagatagcgccattgcactccagcctgggcaacaggagggagactccctctcaaaaaaaaaaaaaaaaagtaaagaaaaaagaaattaagaaaagaatgaacacgtgtttattttacctaactcatgaagaaactagcagatgttataattaatacaagagaaaatctagagaacggacatatttatggatcaggaaaacagaaatgaatatgaaaatggacgccaaaactgctttttttccccacagtgtggggaacagcaggttaattgaacctctaccagacaggatagaatttgcatacagatcagttacctacatgaattgtaaaataactcccatgaaaacagaatctttaaagcagaaggatatgctatagacaagtccttcaggtttcccattagccatcacttctgggaagcctttctagaatctccacgtatgaatgagttgccacttctaggccagcatatttatcacgttatattgtttacatccctccctccatacaagatacacaagaccatgggctttttggggcagattctgtgagttattcaagtctctgattgcttcttcagcgtgaatatctgcttctaaggaacacaatatgctaggcggtagtgtttgtcgtaaggtaaacatattgcatgttaacggagcatccattttactctaatatctggggaaacatcatttgactttaaagaagacgctgtctttccctccaccttcaatgtttcattgttttattaactaatcgcyttttatttccaggcctgcgggatacaacgggaatacaaaaatgcgctagagcggtccgcaacgctgtagcctgcgtaaggaacaattgatactaagtggcactaggctgcagggggtgccactgacacactgggagagggctcagccaaccacaaggtgataacgaggtcagcggagcaccagaaaccggctcactagcctcctgatcagtctcggcccagaggaaaatgaagggcttgagcttctgcttttacaaatctgaggggcaggaaatgaaatcccactagcagtctgcgtagtggagttgaaccctagcacccgctccccagggggtcgcctacaacgcgttccaggtgggcaggctcaggcgctgctccctcacaagcccccggccacgcggtgtctgggaccgggtgcctagtcagcccgggtggctccgccccgaggccccgccccatgacgcgagaccccgcccccgcagcgcccgcttccaagatggcggcagcgatgcctgcccggctgttggggtggcggtgacgacaggcagcaaaagaccaggtatgtgcgctgggaatgcgtcgacacggaggcctgggataaaggtttgggcattcgagagagtgagaagttttgggtaacgcctggagacgagcctgagcagggacggggtcctaggtggaagtatggacgggggccgggcgggctcacgttgctagtaggtagggcaaaagcaagagactgggataggatgggcgtgctccgaaagagctgggttttaaccccctccacagcgcggaccacgcccctctaggtgagcccttccagccacccctgactgtctctgcccctgctctccctctccctttctcttcagcagtaaccctcctccccacccccgctagaagaggggaaaggtagaaaaggtagaggacgccwcccccaccctactctccgccgagctccggggctgttcgcttacagcccccaggtggtcacggtccctgcacctgaggagttggcacccaggcacatgaagaatagaaggagcctgtttcctacttcgccctgggtactccttaggccactccacggtcctgtcatgactctgtcgccacttcaactggttcttggtctgggggaaaacaatgtttccattagctgtcctgtccccactccccaatctgtcctgttggggtgggggtacgggggtggttaagtatgaacctgacacttatcattccagggtagcacgggagataggcgagggacctaccatctcctgctcctcctcttcctttccaaccactttccttcacttcgcctgctgggaaaccagcttcaccctgatcctgatctctggcggtgcaggtagctagttatcctttaccacttctgttccagctggtcccagattcgctgctggagtgctggatggagcctttctctgccctctgtgacatttccaattttagataatgcctcacatctctgtccccccgggaccccctggagcccccatgatccctaagaagacagcttgaacctaggtgagtctatctcttcccttctaaaattggaagagggggttctctagagactttctgaaatgaacatgagatttgaatgatgtaaacatttttgggggtgaggactgacagtagatggtgggagtggtttggggggaggtagaggagagcgaaacttgggctgaagtgacaggtggtagggttactggtggttacattctgtttccttgcgtgactgtgcacctgtgtgctcccttctgtgactttgttttctgctttttcctctttacccctggcatcaccttcaaccctacctactgacctctctgctggcttgctctcttcctgcctacccccagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttaggtaagtgcaggaggaaggaggtggtgaaaggaaggacaaggtgcggagacagggaggcttggggatagggaggcatggagtggcagaagtggaacttagaagaggataggtaggctgaggctgcaggtaggctgaggttgagatagagggctgaggttgagatagagtagactctgaattgggagtttagattagactattgggtttccactttctactgcttgtccctttatgggctcttcctgccccaggctaggaattgttttccttgtagatgagccctggtttaattagttgcaagtctctccagccttcaactatagcttccaaccctgtaagacaggagaaagttaggcaaccctaaaataagaagagaaggctaggtaaggatcctgcaccttccagcctttgtagagctgtcccagtgataggtaatccaaggcatgcgagatttctgagtgagccctgagaaytaagccccagaaccagactgccagtgtcagaggtattcccaaaccctagtttgattcttttctctttgcccctctgatccctctacttgccattccttcccaacagtgggtcctgtgtcrgtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggtacccccaatctccacctcattttgactgactttcttctaaggaagcctcaagcacatgccacttcactttcatctaaatgggtccctagaataattttaagaaggccagactgttagagtgtggagaagcacccggcactgctcttccaactttgttagtcccatacttttccttaatctgcttaggttattcccactgtcctacactctcctgtgattttttctttattgaatggcttgtgcagagttggaattggacacaatagggctaaaattctagttccgtcacttgttacatgtatgactctgagcaagatacttaaacatctaacatgaggaaagagcataagataactaatataccatctgttccacaccacaccattgttggttgccaattgtcaggattaaatgttagacagcagcatcttaagtatcaggtccataccaatacacaagcaagatttgtcaaatgactaagtggaaaaatgaaaaagatagtctttctttttcattctccttgccctccaccccactttgatttccctcttttcacttttattcttttttttctttttttttttttttgagatctcactctgtcccccaggctggagtgcagtggcacgatctcggctgactgcaagctccacctcccgggttttacgccattctcctgcctcagcctcctgagtagctgggactacaggcgtgtaccaccatgcccagctaaytttttgtatttttagtagagatggggttttaccgtgttagccagggtggtctcaatctcctgaccttgtgatctgccygccttggcctcccaaagtactgggattacaggcgtaagccaccgcgcccggccttcacttttattctttagcccccttttctccgtgccacctacagacatagtctggttcccctccattatcttccaggctggaaatggaacatttaacagggcaaaactgttgaaygttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacaggtagagggcatggaagggtactgggaaacaggraagcctactatcctgtggaaggaggagagccaagcggattgtggttggggatgtgtccccagaagactcggggtatgcaaggatctttctctccctagcctcccgtacccccagtacttcggaggagtctcagcacttactcctgaccagtacctgaagatgaatggcttccccaatgaatactggggctggggtggtgaggatgacgacattgctaccaggtcagacttcctgccacttcctccctcctgaccccagtctggatccctgtcctctaagaccacctttgaccatagcccttcarcactaacctttagctccctggtcctgcactgagcccattcctttcccttagtctttttaggayacccaggtcaggcttgcatgctactgcccattgtgtcatccttcagtctcctggttagtttgttcttgggagaggacataagatcaataggaaatagtatcgtcggattccagaactggaaaggggcccagagacagcttagtcttgccttctgctggggttccagccaggccacttcctatggggttaggagagaggggctctgctccatgttcccagaatcgctttgtaaaaggcctgtgccattggcacagggccaactcatttttagcatgtgaaacattctgaccttcagcctcagctgacccaatttcatgtctgtggtatgaatatttgggcttggtatgcaggaccaattgcctccattccccctgtgtcctctgtgatgacatctctgtgaattctcatcctctgtatgtgtgtgaaatacccagtgaattgtaaatatacataagtattcttctagttccttcccaggccatctgcactccatgcttctgtgtgtcagaagtggagtttgtttcttttaaggtcctgattacctggttctacccttttcttttctttctttcgttttttttttttttctttttctctagagacaaggtcccattattttcccaggctggtcttgaactcctggcctcaagtgatccttctgccttggcatccaaaagtgctaggattgcaggtgtgagccactgcacctggcctacctttttcttaacatgggggatgtgggagagaagctggggtagctcagtcactatthtaagattctcagcaactcccagtcttctcttattcttttgacagaatggcctctctctgcgtccttcctagactgcaagggcagctcctaggagccctttaggaagccaagggaataggttgccaactgtttaaaggccctagggtgactggcactgggccctgaggatttggatacatccagcttttatattctcttcagccatttccttctttctgtttgacttctgtcctgggctttttttttcttttgcctactaagtaatagttgtttttttgtgtgtacagaaacatttaatcccttccttgcttttctctactctggatcccccatgataccctcacttttcccatagggtgcgcctggctgggatgaagatctctcggccccccacatctgtaggacactataagatggtgaagcaccgaggagataagggcaatgaggaaaatccccacaggtaggaagaaggaaggactgcctgggaattgttactggatcctcasggttctgtacccctagccaggaaaatcctaaaggtccctagatttctggctgttcctttctgggtcttagtctccaacctctaaccctcagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctsaggggtccctctctctagggtctcctgtagggcttatgactgygaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgcatctgctcctgcttyctgcatcccaggcacactttgcctctttgctgccccgcattcttatgcctataggtgatagaacagccagaccaagccaagctccagcaatttttattttcatgaatgagagttggggatcagctgttaggttctgtgcccaggacactgactgctgcctggcgcccactctctatacagtcattaacagcaactmyctcataggrggctcyagccagagtcaggggcaacctgtgagcagtcaggaattrcctagstgactctggaaggaaaggatgaaaggaatgttttagctgggggtctgatgtccttggccctcctcagcccagctgttttcccaacttacctagtttttgccagtgacctagtgtatactggggaatgcagttctgagaagagaggagaggatgcagggaaaagtttattattgatgtcctaggccttggctgacatacagtgacaaatgttccagtctctgtcttcaaggccttcagtggagagctgagggaagtttatcccaacttaccttgtgtagatggaccaagcagtggctcggcatctccttcagtcckaattgtgtagcagctgcttcctgggcccgctgttgaaacagctcctgagataagacacagccactagcctccagtgtctrtaaycaggaacctcccagcatcacctaaggagggaatatagcactgatcagtctggccttgcctacaatggagcacagaggagccctctggaaatgccactaggcaaagtttcctcctcctcacagtcactctgaggccaggggggctcccgtcctgctcagggaaagcaactgrgkcayacacgattcccaggactcctggatcttctgaagatggcmccaaatgtccaaatcsctggagagaaggacattcatgcgtcagaaggaaagggctctagctgaggctgtctctccttcccatttttttgggggggtgggggggacagagtctcactctgtcacccaggctggagtgtaatggcgagatctcagctcactgcaacctccacctcctgggttcaagcgattctcctgccttagcctcccgagtagctgagattacaggtgcaagccaccacacctggctaatttttgtatttttcrtagagatggggtttcaccatgttggccaggctggtctcgaactcctgaccttgttatctgcccacctcggcctcccaaaatgctgggattacaggtgtgagccaccatgcccagcctctccgtccctttatcatacctggacaggcagatgggctccttggtactgcagattcaccacagctacagacactgcagtgatggcactcagggcaygagccagaggggcagcctcagcagggrgcagctcactgagcactagagatcaggcagaggcctgactcagaaggcattcccattacagttgtcagtcctctttgggattagactcccatagagatgaccagttcaggggcatggtgtggtcctgctgacccaggaaggtatagcttttgcttctcactggtaggggttggggaaggggaaggtggctattccattacytgaagctggaatggcamtawtaacgtggtcagcctccagactgctgtcccttagagatacctgagagcatgaaaacatttgagagacccagaaaatgagaatttgatgagtgaaaagagacttctggtgcctcactctcagtttcccaggcacccatgtggccggggagactgtgtactgacccaggatgaagagattgggtgactatgtagacttcacaaaaaatcattcctctgtgtactccaggaagtggaccagacaggccagtgtggctgttctgaaatgttcagtgaagctgggttctttcccctatctctaagccacttataagtactacttctatccacagacttgcataggctctttgaggaaggttcacaaatagggcctaggattctggggtagcccatgtctaagtagcttctaaggcacaaaaacaatgaggaactccagtcctatcggccctggcctagttaagccacttggataaagatggaaacactgacaggttcattacactccaggggttcccctaccttcyagcgcccttctgcctggaggctgagcccacagaccsgctggcctctgagaacactgacccccctactagtcaggtgggtttcaagggcctgaggcracatctytagacstccacgaagtgaccactggctycagcgctcagccaaggcctggcgaatgagtgctgagtctggctgtggggtccgccctgcagaggaagcaaagaagaatcattgaggctggatgcagtggctcacacctgtaatcccagcactttaggaggccgaggcgggtggatcacttgaggtcaggagtttgagaccagcctggccaacatagtgaaactgcatctctacaaaaaaatacaaagattagctgggagtggtggcacatgtttgtaatcccagctacttaagaggctgaggcaggagaattgcttgaatctgggaggcggaggttgcagcgagccgatctgagattgcaccactgcactccagcctaggcagcagagcaagactccgtctcaaaaaagaaaaaaagaatcattgaatagcaccccttgtccccactccctcactttggcagtacttaatattttcaccctctgaatcaatcccccctcacctrcccccagcagcaggcccagtmatatggaacgatgggtttgctmagcttrgaagagactgggaaagcaggacctgatgctgasctcacggctgttgcctrcaaacactccacggcagagactgtccatggctagagacgccabcttaagggtgagactaggactaaggagcgaaaaaataatctacactgactgatttccacagcccctatttggtagggaatgagggtrggatagggtttggrttgggggacattcccactgtgacggatggaaatgaaggccttcactcccaataatgagttttgggaattatgagggggtggggtatgaagagaagagggcatccccaaatgatacagaagagcccctaggtggtagatttgaacagggagctctgcagctggtttaggagggaagaggtttggggcctctgggcaagtgtcacctcaggtccarggcggcrctrggcaaaactgtgcacagtctcawcaggctctttgcccsggggcttggtcagctmcctcagcccagcycaaaacagaggtttggagaaggggggtgaagggcggagtagccccctgcatggagaaaggcatagtgagggggaagctcctgacatrcctccccagctccaggcrctggggtcatttccactcatttggcttccttttgctgggaaggctgacagggagatgaagaaatggaaggcaggtcgggcgtggtggctcacgcctgtaatcccagcactttggcaggccgaggcgggcggatcacaaggtcaggagttcaagaccagcctggccaatatggtgaaaccccatctctactaaaaatacaaaaactagccagacgtggtggtaggcacctgtagtcccagctactcgggaggctgaggcaggagaatygcttgaacccgaaaggyggaagttgcagtgagccaagatcgcgccattgcactccatcctgggcgagagcgatactccgtctcaaaaaaaaaaaaaaaaaaaaaaaaaaagaaaagaagaaagaaatggaaggcatatgaggatgagggcacagtaaaaggagcggaggtgctggtgttacctgaggccagtgggtagggcakgcagggcaccgcccacgtagaggaacctgttctgggcagctgggtggtctccccggacaggcagcacttctgaatccaagccaagctcagaaacctgctctccacatgccctcagaagaggagaaactaagggaagatctgacccaccaaacatacttcctcccctaaactctattccccaatggaagccccctccacaacctctcctagacatcccacaagcctctcaccaggrgcaaggtccgggcccctagggctcccgctggcctaattccccraggtccaagctcaaagatagcaccattagggcctcgaacggagcgaatccagcctcccagacgctcactgctctccactaggaccacctggcgacaagagggagagacactgcagcaccgcctgtagccgccgscgagaggtcaggaggggaggggaagaggcatattcagagggccaggatccatctagcttttgatggaaatgggaagagcattaaatgaagctccctctggcacaagtggagcactcaccttaggggggcagggggcccggctcaggtggtaactggcggcsaagccgctgrtgcytccgcccagcacgaccacggtccggccbntgcggaaacctgggggaaagggggcgatatggacaggcagaccggggacaacctgcgctccagaagccccgccggttttgagttctatcccggccactcactgctttaggggaaactaagtgtgcacggatgggctggtggaacagcgaggtccccgtccaggggccaggactcacccacaataggtagggatgagagaaaatgagggagaaggagatcgaggtcctaagaccgtaccccgccggcgctctgctgggtgcagataagggccacaccctcgctatcggccctcgcasggctcgggcggcgggcagtacgcctgagttctgaggtgctctgcttgccacacctctgtaggccaacaagtgcttcaaatccgctactcccacccccagccttttcggtctctcctackctccgtccactctgttctcgcggcacgcgcctaaccctacctctcctacatctggattggcgggacttggaaggccccggatcacgttcaccaataaaacattgaactggcagaggcggagcgacggcagctgtaagagctggaggttaaccgtgttagcgccgagctgggagtgagcggccgtacccgtcactgccctcctcaggaccgaggcggcgagcgcttaatgctggagttagcgttccccagcacaagcttaccaggtccagctagggtgacaaccctagagggaaggccgcaggagctttggtcgtagggagaatagatagggacacttaaggccagtccacggggaggcggctccataaacagctccttgatgttagcaacagaccgggcctacgggagctagggccgcccggcaacgtacccrgtgtttgtcaacagtggcactcccccatcgccgaccaaaccagtcgccccagarcctgcacgcagcctcactcaagtatgcctttcctcttttcctcccagtacataaccttcactgctgggggacacaggtccgggtccagcaccatccccgaaaccttccccctcggctctgagagcgcccccacctgttagagagggaacttgggtcccaagaagactccaatttggcycagttctctatcaccccctaagcaaaaatacaaataagcacatcattttttcttaataaatttattcacaaaaagtgatattgcagagggtctgggggctgtacatgggcaggggcttggtgagctttgtacatgggrctgggagacaagggagcctccaggtggaagggtattttttaataaaaaaaataatggagctacaaccaccccytcccccctccccgattaaaaagacacaaaaatagacgtctctgaggtaaacggggagcctggggcttaagggtgtttaaagggcttcacaggtgccagagcttaraggtgtcacaggcaccggggtggctcctgcatcarttggtagaacagcacgtagccctcgctggatgccacctggttttcactgacaggggagacactaggaaaaaaggagatcgggaaagggttgtggtcattcctgtttactccc

SEQ ID NO: 13402 - DNA, 56054 bp, Homo sapiens
  misc_feature (1)...(56054): n = A,T,C or G, or insertion/deletion polymorphism (see Tables 1-2)
ctacagaggctcacagggtgtcatggagcacgaggaaaggtgcagggaatcctagagaaagtcttgtgtttaaggagcaagacaggaaggagaaaccagtcagtgagatgggtcaaatgtaagtggagaaaggaacgtccaagsagaagcgggctgtcgctatggtgaatcatgcagagatgaaggcgggacgatggagcagtggccccttgggcttggcaggtgatcaaattcgaggtcatgatgaccttcaggagagcactgtgtgcagagtgccagcagtgggaagggaccgggtgggagggaggaygtggaatgtgagggtggtctcccctgcaggaagtttggccttggaggggatgaaaatgaagggcagggaggagtcgcgagcgaacaagcaggagggtgttcgactgctagagctgagctaagcgatgcctaaatcaaaggaacttgtttcttcaagctcttctggcagtgatyctgacagtgaggttgacaaaaagttaaagaggaaaaagcaagttgctccagaaaaacctgtaaagaagcaaaagacaggtgaaacttcgagagctctgtcatcttctaaacagagcggcagcagcagagatgataacaagtttcagattgggaaaatgaggtacgttagcgttggagattttaaagggaaagtgctaattgatactagagaatattggatggatcctgaaggcgaaatgaaaccaggaagaaaaggtattgctttaaatccagaacaatggagccagctgaaggaacagatttctgtcattgatgatgcagtaagaaaactgtaaaatccgagtcatacaaacaaaacctgtacttttctagttgtttkaatctgtctttttacattggcttttgttttctaaatgttgttctccaagcaattgtatgtttggattgcagaagaatttgtaagatgaacttttttttaatgtgcattattaaaaatgttgagtgragcaattgtcacstttattaaggaggattgctttgtgcccaccacctagtgtaaaataaaatcgagcaatacagtcttaaatgttgtggccttttttgatcataagagttggtactgtttaaggccaaaagtaatagtttttataaatcttttagtytcaactsagcttttacaataaaaaggatttgtattgcattgagtttataaacttttggtttgtgaaatccatatttgatctgttttcttccaatcaaatgtttatttggaaagtcagtgaaactgtcaaaatgttacctcaataagatatttataattgtatgagaactacaatcaccaaatcractgtcttcagtattagcagatctagtttgataaacaaatggcttgtgtgaaaaccgagcaggtgtttgtcattacccatagtgttctgtgtagttattgcttagtctgcagaaaataatgacctagatgagatgtctgacttgctttcacttattaaacatgttcaccatgggatgatgtstgtaacgtcagatattgttaaactagactaggatttaataaaaattgtgaaagcttactggcctaacaktttattttataatattgagtatgaattatatgtagccagagatgtcaataaggcttactgtcrgtasgtaatatggttagtttgtagggaaaagagcgtatgagcacatgcttgtgtatttcggcctttrccccagtagatcagacaatgacattctagtcttgatgttactaagttttagcagacactagcaagtggtttgtatttaaccacasccatgaagcagacagactgaggcacagattttagtggctttgtggcaataaatagggcatggtgtgccttaggaaaagaatgtttataaagggaactataactgaaattaaaggaggcggcagtgaagaggaaataattatcttctatctaaatgatatacatatgatattttgagatttttataactgcagtgsaacacaattctgggtagagtagaaaaaggaawggtttaaagacatataaaagattcttgttgacaatttatttttggtagcaaatctcaaatgattacctgctattaagggctgccatatcagagttttgcactattttgctaccaagtttgattcgtacatctaaaacattttgtagttgattgtcaaggacttaatttgaaaatcatttgccaggccacatagttatcaattttctttctagcagctattctgttgtatttttaaaacattttttagatgactttttraagtctatttagcagtaaccttaagaggtgcawattagtaaaataaatctcttgtmatttagccttcatcaaataataggtaccaatgtattaaaaatatgtggtttttttttttttggcagccctttgaaccagagtargttcagagaaactcccaaaatttgtattttagacacgtcatgcttgattggtaacttccctccttttttggggaacatgtttgtgtcctattaacttaattggatagatttttaagtatttcttatttttggcacacaggatggttagaatacagaactttgatttttggtgtagatacggagagaatgatgggtaaatttcctaggtttatatgaatttagggggtgtacgcattttgaaacgctattaacagatggtgctgaaatctattgcctacatgttttctagctctttagcattatgttaatgaagcctccatataaggagtgtttctctggcacagttggtaagttgactgctaacttcattgaaatgtgttactggatatgcagtatactgaaattattgatcttttttgtgtataggaaaagagaagtgggttaaaagaagcaaattaacttgttctgaaaagaaagtatagattaattttgttttctgtttaaattttatctccttggtaagactttttttccaaggcagaaagcttggcatttttaggcatagatcccttaccttataatgtcaaaatgaatttaattccagtactcaggtttttccctttaacagactctatgtgtatcagggctttctaatgggtttttcctctttgtttttaaaatgtgagcagcttttgaccaatttccagtgctcttagcattttacttaaagaacaaccactaaaaaagaaaaacttcgtaatttgcttgtcttttgctttgctttattaatgtctaagaacttaagaatactcctacctcattagctactcaagatgctgtgacgaccaaatctattctacataatgtgtttagaaacaaagacttgggtgaaaaatgaaataagtatattctgacttggctattgagggtaaaaagaaagaattaagtattaagtgttccttgtaggagataygttagtagaataccataaaagtttgaaaattttaaaaagtactaatatttaggtatcctgaaattatttgcagttcattttttatggaaattaatccagtgaatcacgcaaaagttttttttttaaatggtgyttttccagatcaactctagggtaaacattcacataatcacaaatatgcaattctgtaattgtgaaatgcctgtatgttttgttttcatacatcttccttggagatgtctgaatataatactccatctatgaatattttaaatgttgaaataaaagtaagaaatgtgaaaaaaaaaaawgaaggctagggaggagagcaaaggatgaatataacgtgaaaatgtatgtatagttagttcaggggagaaaaccaggagagagagagagaaagctcacaccagagctgtcgcttaaagatgactggactaggrtgggaagagaaagaataacaagtccctagaaaatttgctaaaagtgaggcctttggggtacagaagagtgggcaggtttgtaacggctgtaagggaaacgtgatcacttcgggttagagggaagggctgtagagccacatggcaagcccaggacacctgtgcatttcctgactttccctgacagcatccagtggcttaggataaaaaatggagacattggatgttggattaccccacaatggacatggacgtttgtcagggtaaggatggtgggagacctaagggacaaggagaaacattatttttttaaaattacagacgtcaaaagagtcacacaatacaaagtttatagagtgaaacatgaaagaatgaccttcatccctgccttaggaggatctctggagcagctttgctcatagtgtctctgactgcagtgacttacggaaaaaactaataattgggaaaatamtagtacctaacagttgagactaagtgttgtggttggtgccgttggaactccatggaacatgttcctcatggaagaggtggggaagggggaatgtgggcaggtaacaayccacactcccatgcttctctcccagtgagtgagatctaattcaccctggcagtaggtyctcagtgggtttcaggttggttccaaaaggaggtagggcctggtgcagtggctcacgcctgtaatcccagcactttgggaggctgaggcaggaggattgcttgaccccrggagttcgagaccagcctgggcaacatagcragaccccatctctacaaaaaatacaaaaattagccaggcatggtgatgcatacctgtagtcccagctactagggaggttgaggtggaaggatcacttgagcccaggaggtcaaggctgcagtgagccgagatgatgtcactgtactccagtctgggtgacagagtaagaccttgtctcaaaaataaaaaaataaaaattttaaataaatacataaaaggaggtaggcacgatatgttgtaagtggactgaaagagaggagatggtacagagacagcagggtggagtgtgaccagtggcggttatgccttttgtgcctgtgcctgttgcctggaaggaggagaggttttcgcttgacaggactgtgaaggagggcacggaaatatggggggtcgggggtgaatctaggcttccatcttagtaaggagaggcgggatacgtgtgagaggcggcagcatgctggcagccctgcagcccttgctcgctctcggtgcctcctcggcctcggcgcccattctggccgcgcttgaggagcccttcagcccaccgctgcaccgtgggagcccttctctgggctggcctagtccggagccggctccctcggcttgcggggaggtgtggagtgagaggcactggcgggaaccagggctgcgcgcggcgcttgcgggccagcgcaagttccgggtgggcgtgggctcggcgggccgcacttggagcgggcggccggccccgccggccrgggcagtgaggggcttagcacctgggccagcagccgccgtgcttgatttctcaacaggccttagctgcctccccgcggggcagggctcgggacctgcagcccgccatgcctgagcctccsccgcgccgccgccgtgggctcctgcgcggcccaagcctccccgacgagcgccaccccctgtyccacggcgcccagtcccgtcgaccgcccaagagctgaggagtgysggcggatggcacgggagtggcaggcagctccacctgcggccctgcgcgggatccactgggtgaagccagctgggctcctgagtctggtggggacttggagaatatttatgtctagctaagggattgtaaatacaccaatcagcactctgtatctagctcaaggtttgtaaacacaccaatcagcaccctgtgtctagctcagagtttgtaaatacaccaatggacactctgtatctagctaatctagtggggaggtggagaccttttatgtctagctcagggattgtaaccgcaccaatcagcaccctgtcaaaacggacaaatcagctctctgtaaaacagaccaatcggctttctgtaaaatggaccartcagcagggtgtgggtggggccagataagagcataaaagcgsgctgccttaaaaaaaacggtggcaacacgctgggtttgctttacaacgcytgggaagctttgtygtttgcaataaattttaatwcttgtctgtttcggtctgcactgcctttatgagctgtaacactcacrgggtaggtttgcagcttcactcctgaagccagtaagacaacgaacccactgggagaaacaaacaactccagacgcgccgacttaagagctrtaatactcgctgtgacggtctgcagsttcactcctgagccagcgagaccacgaacccaccagaaggaagaaactccgaacacatctgaacatcagaaggaacagactccggacacgccgcctttaagaactgtaacactcaccgcgagggtgggcggtttcattcctgaagtcagtgagaccaagaaccaaccaattccggacacacttggactcgacagactctaaggtgaaagattggtttagttcatgagttggggttttgtgataactgacattgtgaaaaacgggggatttaacatagattttcacagtggctttagacatttcataaatatttcttaaatgcctcctaaatgctaggatttggcaatacaagrctaaacaaaatacaaagccaaatcctactgtaaygggagtatgtaaagtgtttctgttaatggaaaaagtgctgtgtgaggatgggggttaagtgactggactgtttgtgttctgagctttctaggactgatctgattacgctgtaaacactcygccagatactgtgtaggcccagcycttgtgcttgagggggccactgtgaggtggcgaaacagacaagagattattagaatacagaaagttcaggttgggaggaaccactgaacatggtagaagtactgaggtctgtgaaagtaaagatcagcccaatgaacacaaacaaataaggttcttgattcggagcttgctgtagtaagggagttttgtacttagtggacactccgaggcaggcaggggagtgggaagctttacgrtggaaaaggggaaggctgcagcagtgctctgattggaggcttctggcctggggaagttggaagcagctgatagaggtaggtgtcttcagtgattggtttgaggagcctatttgtttttctgtggttgattctgagttgcaagagtcctgaccatttggggctgattgctgctgaggttgtggttttcttgcaggacaggcaagccccaaattgggccttagcccatgagggttcctggctttacccaggaaagaattcaagggtgagccagtggtaaggtggaagaaaacaacttcatkaaagaggcagtgtgmcagctccgtgacttttcctgcagagtasggctgctccgcaggcagtgtgctgaaagcagctcagggcagttgtgcagtcagatctatayctacttttaattgcacgcagattaaaggacagtttctgaagacatctgtaggaaaagggtagtaacttctgggttgttgggtcattgccatggaaaggggtggtaaatcctgggtgttgcgatggcaatggtaaactgacatggcaaactggtgggcgtgtcttaaggacggctgcttcggcccctccctgttttagctagtcctcaatttggtcggctgtctgamccccacctctggagtcgaatctcgccttctatctcattttgagttccttggactgcctgcagcagcggttgtttaagccatrgttctgttatatagtgtctggctgttatccattcgtatgttcagcttccaagtggacacctaagtcagactgagggagctggattaggggctctctaacaaatagcaccatcacataacatgtctgtttcttcctctgcattgtaagctccttggstgtggaaccttatcttactcatctttgttttttcccatgtctcctgccacattgtagatgttcagccaatgtttgttgcatttaaagaacagataaagaatcacagctactagggaagctgagatgggaagatccttaatcctaggagtttgagccagcctggacaacataagaccctgtctgtctctcacacacactcaaaaaaaaaaaaaaaaaaaaaagaaacaaacaaaaaaaacggtgggggaggggaacagataaaggagaggccaggaaacacyagaaaaggattcctgaagcagattccacctgagctgtaatggaggcgtggcaggtggctaggcaaggagcaggaagcctattccaggcaggtgaattgcttgggccaaggccggatgtgaagtactgtagcctgttygggggacaataagtgctgctaggactggatcagggtgtgaaagtagtacaagaatgggtggacaggaggctgaaatcccaacaaaggatgtagatgccaaatggcaaggacgtttttattctatgccagaaggcttgatttcctttaaatcaatccattgattcgaagacatttcattggaggaatttaaaatggaaggattataatcaastgtgtgtttttattttttwwttttttgagacggagtctcactttgttgcccaggctgcagtgtggtgtggtgatctcggctcgtgggttcaagcgattctccagcctcagcctcccgagtaactgggattacaggcacccacaaccacgctcagctaattttggtatttttagtagagacggggtttcaccatgttagccaggctggtctcaaagtcctgacctcaagtgatccgcctgcatyggtcttyccaagtgctgggattacaggtgtgagccactgcacccagcccagtgtgtgttttagacgaataactctacctgccatatgggaaaggacaggggaagtcaacttcaacatggtttgggaaagaagatgtggcttaaaccaagatggagcagagaggagagattaaaatgaaaggtatttgttttcttggactccacaggacttgatgaatgattttgaaggggtggatataaggagagaaagggcgttatcaatgacacctggattttgtgattacaaaactgagaggctgttaaygctatccacaggagaagcagatttaatggaagagagatttaaagaatgggcacgttaactaactttgcattgtttaggcaccatcgtgtcctatacgcagctcaattcaataaatactcattgagcacccaataaatattcattgagccagtatgtgctrggcactattccagatggttgaggggacattagtgagcaaaacaaaggtgtgtcgtcactgagcttagatttctmgtgttgacttaaaaaatatgatttatcaatttagaaagggagaagagcctttatttcttctaaagggttacagcatgcttccagcttagaccacagacgggcactttgaaggaaaaggcgtttgasgtaggagctttatgctgactgggttggctaaacgtacatatttaacagattacaagaggagctacgaatatttatgatggcggacctgacacattgaacaaacatgtatgtaatatatgacccatattcactttgggatagagactcaacatgtgaatgcattacaattacaccctataggtcaaaaggtctttttaggacaggaaggcgccttgagtgtacagtttctgtaaactggccagaccagtccacggtcggcggtcttatcaggagaaagttactgagatcaatctcttgaccagtcaaagctgtagttatggctggtggaacaggggttcaattagtcactgtctggtggagctgcaggtgttttactattgcttatctcaaggccagcgtttagctgctggagaaaaagaagagccctgtggcagttagagcttagttgattcttyaagtgtaggggtgcctgacttcaccattgcctgcatggccttaggtcctgtttataattgggtatcttattgccacagagtctgttccgttagtsttatgatctctgttttaatgttaatgccagccagttgtgtatgaactccaaaaggaagggggtacaatgagggctatctgatctcctgtcccgttatttgaaatgctttttccctggtgctgkaaagaaatagcacttgtaggctgggmgccgtggctcacgcctgtaatcccagtacctggggaggctgaggcgggcggatcacgaggtcaagagattgagaccatcctaaccaacatggtgaaaccctgtctcaactaaaaataaaaaaattagctggccgtggtggtacatgcctgtagttccagctactcgggaggctaaggcaggagactcacttgaacctgggagccagaggttgcagtgarccaagatcgcgccactgcactccagcctcacgacagagtgagactccaytwaaaaaaaaaaaaaaaatgwagaagaaatagcactcgaaggctgggcgcagtggcttgcctgtaatcctagcactttgggaggccgaggakggtggatcatgaggtcaggagttcaagaccagtctggccaacatggtgaaaccctgtctctactaaaaatcgaaaaattacccaggcgtggtggttgggcgcctgtaatcccagctactcgggaggctgaggcaggagaagcacttgaacccagaaggcagaggtggcagtgarccgagactgtgccactgcactccagcctggcaacaagagtgaaattytgtctcaaaaaaaaaaaaaaaaaaaaaaaaaaaaggcgcttgaacattaatttactaagcaggccattttyacttcctgcagaaagggtacactcgccagcagttttgccatgggagtataccaaacaaaggagacagggtcatttataacctsactcgtccaccccactgcttgtgtctagtttccattggctggaacggtgcctcacgttctgtatttgtcccgattggctagcaacttagaagtttttaaaagaggcaaaggtagaggagaacaaaggaaggaggaagtaacttgtggaatggtgacaaaggttgaaacaccttcaaataaggaagaggaacaggctatgacctaatgctytcttggaccactataagcatgccagggcaaatatttaggctaaattgtgagagctaagaacatgaagtacattgatttctttatcatagctagcagatatttaagaatgttagcacaggtctttgaataaagtttgcttctaagagaagttactatttattcctaattaaatggggaggaaagtctttgaagaggaacctctactttactttttataccgtcatggctggaaactaagtttttaagatttttctggggttcccttggccgaggtggggagtgggagggctgtccagtggtagggacttaggatttttagtttacagtagtaggggaaacactctgtaatctaatacataagtaaatgatgtattagaatatggtaaatataggcaagtagacccccactgggattagcagtggtggaaatgtgagagagggcaaacaggtgggtctagatgaggtgtgagcagactcgaggggcacaggagttagtcaagcyagtatctgggggatagtgcaggaatagtgaacagctagacaaaaagtcctagggccagagaaagcaaaagcataagagatggaggccagagaggtaatctgggtggaaggctgcagcctctcaggatccctataggtgctttggcttttgttggagagacactgaacagctttgggcagtgaacgtacctgacaggtttcctgtttgtttttgagatgaagtctcgctcttgtcccccaggctggagtgcaatagcgcgatctcagctcactgcaacctctgcctcctgtgttcaagcgattctcctgcctcagcctcccaggtagctgggattataggcgcctgccaccatgcctggctaatttttgtatttttagtagagacgcagtttcagcatgttggccaggctggtcttgaactccagacctcaggtgatccgcccgccttggcctcccaaagtgctgggattacaggcrtgagccaccgcgctcggctagacctgacaggttttaaaaggattactggttgctgtgttaaaacagactgcaggatggcttaggtagccagtaggttttttttttttttggagacgtagtcttgctctgttggcctggctggagtgcagcggtgtcatcttggctcactgcaaactccgcttcccgggttcaagtgattctcctgcctcagcctccggagtagttgggactacaggcgcccaccaccacactcggcttttttgtatttttagtagagacgggtttcaccatgttggccaggatggtctcgatctcttgacctcgtgatccacccgccttggcctcccaaagtgttgcgattacaggcgtgagccaccacgcctggacgggtagccagtagtttctagggctggagagatctaggatgagagaagtttccacattcctgttacaggctctctaaggcttcagctcctttttctaggactaagctggatctcaagtaaacactagagagggggcagctgaagctccaggagtgtgtggggctccctggggctggatggcggtggcgggcaggcgagctgggctgygctcgggtgtgttacagtaaagacgcccagcttggcgctggcccggccttttcacggttttaggctctacagagagcggctgcagagctcacccggctggcaggagccaccgaggccggacacgtgggcgacttattgaccaagtggggaggaagcagccccgcactgctctcccgactgcggaccaccgttgggctcmtgcgcatcmtaagccccaccgcctcacctccagtccccacagcgttcgcgctcccagccggggtaagcggaagaaaacaaaggcccggctccatcagggcaccaatcccgctcgtcggcctctttctcggcctccaatgagcttctagrgtgttatcacgccagtctccttccgckactgattggccggggtcttcctagtgtgagcggccctggccaatcagcgcccgtcagcccaccccacgaggccgcagctagccccgctgscggccgaggccggttgaagtgggcggagcggcgggcggggcgtcgccgtactaggcctgccccctgtccggccagcccctcgaagcacctactscacaggtccagccggccggtgagcgcctggggaccgcagaggtgagagtcgcgcccgggagtccgccgcctgcgccaggatggagttcgtgaaatgcctyggccaccccgaagagttctacaacctggtgcgcttccggatcgggggcaagcggaaggtgatgcccaagatggaccaggtgggccgagcctccctgcttgcccggggcggggaaggagctcgctgggccggcctcagggcctgagcggccgggcccggatctggggcaaggggcgcggcgagcagggccgacgcctgggtgttcccgtccccctttcctcgagccttccccctgtagggcccgggtggacgyggccgtcctggctgacctgtccctgcccccgcaagccgccctgggcatgagcgacttttgcgtggttcccggtggttgcgctccccgtttcgtcccctccgtgagcatcggcgcttaccggtattttaacccgagggttacacatctgasgcaatgtgggtgggttacgcgggagaggacgagtgagttttttggtaagcggaatgaactatgcagataacatcacatgaaggccgtttctggaatgaagtctgactcctccagtttcaccacctcttccggagctctccccgccttgctgycttccatcgcttcatcctcggtgcttcctgagttttaaaatcgcctatctacgcttccaagttccaatgagttatctaacgtctatggattagctaggtggttggtggaaggtcagaacttggttttacttagatttttatctgcctcatgcctgtactatttgtttaatgaatgcataggaggtgtttttattccaacaagaaaattattcgtacgcgattattgaatgaatagacaaattcagccaagttcttctggtctggaccagcctggctgatttctgtaacttttttgggccaacaggacagtagcaaatgtgactcaggccgaggcttgataggtgcctgaacatcggagtctttctttcagtgtccatgtgcttcagtaaacacactagaaaataaatttctggtttttgtccccagtagactacaccctcatttggtgttatttttcacgtgctatctttaatacaggtacatccttcagtctatttgtagaacattcagttttcttcatcttttctttgccggtgctacattatttgaawtattttgctacagaataacttctattatttgatatggcagatgtcactttttatatttagatatagcattcatttatttaacaaatatttgacgaccasttgtatatcagatagtgttctaggtgctggaggtacaacagtgaacaagctaggtgaagaccttgattttataaaacttactttttagtggaagagagacaatttaaraaagcgaatgtacagtttttcacgtggagaaaagcactgcagaggaagatactagcagggcaagggatctgagtgcagtcagacctcatttgggtccagacttcattcctctatgtctctttcctttctacagaaagactgttagagaaaatggtagcattggtttcctgttgggagggaaagtgggtggtcatggtaagtgggtagagaaagacttcacagtatactgtttttgtacattttgartttttttaaaagcgagacttgagctattctagctctgataatatggtgcagtatttgttatgttagttgtagtctttctgggcagtttttacatccccatgagccgttaaaaaaatacctgaacctttaattaggggaaataaattggaaaaatacatttcccttcacttaacattatcttagtttctcttttttttttttttttttwtwgagatggagtcttgctctgttacccaggctggagtgcagtggtggcgggacctcagctagatgcagcctccgcctsctgggttcaagcaattctcctgcctcagcctgctgagtagctgggattrcaggcacctgccactacgcccggctgattttttggtatttttagtagagacggggtttcaccatgttggygaggctggttttgaactcttgacctcaagtgatctgctcgccttggtctcycaaagtgytaggattacaggcgtgagccactgcacccggcctttttttttttttttttgaggggggggtctcactccatcgtccaggctagaatgctgtggcctgaacatgactcactccagttttgacttccttggctgaagccatcctcccacctcggcttcctgatccygagtagctgggactccaggcacgtgtcaccaatgcatggctaatttttaaatttttttgtagacacaatgtctcgctgcattgcccaggctggtcttgaactcctgagctcaagcgattttcccacctcagccttcaaagtgctgggattacaggtgtgagccactgcacccaaccagtttctctctgcaaactagggaaaaaatttacgcttagcagataytgagggctgattatttctatcacagaagcatttggctatagaatttcagggtttagtaaacttgatttacactgaatttttaggtgcatatcagtaaatctacgggcatatgccrcctgcaagttgtgtggcatcacccaaaagccgagagtaatggaaagagcaggctgttagtaatcaggcagatctggctcctgtccaatctaaatcctgttatttagactaatatcttaagtctgttattaagtccgatttctgacgctattaagttaggtgaacaaccttggtaacttaacctctgaacyacagttacttcatctgtaaaatagggatgtatgtatggtaacgattttttaaccacaacttcccaactctaagatggtctgaaaagaattttttswgwgtttggctcagaatcacttggcagcaaaacctgacttgaagttgaggcttcattcatcccacttagtatattcaaatgttttgctaaagaaataattatgaggtgctacttcacactgactagggttgtatatgcattttattgcctattttctaaaacactaaaaatgctaaattctgccccaggtcttgccacagatgtttcagtggactatgggcctktgagaccttaaagggttgattgagtaaggatcacaggtgatgtccgcattgtgcttggcatggagttaagtgcttgataaatggtggttatcaatctgattatgtaaatttatgtaaattcagttctcaagtttgtggtttttttcccctcctggagaaatctattctattttaaagtgaggaaggctccgtggagggctggtagctggtagctgttcacttgtggaactttcagcctgaggctggagccccttcctgggagtctggtcttgtcgtcttcctgaccacccccacacccttcctctaaattccctccatccctgtttttctcccgcttgcgagcttttgggagtgtgctgaatctcagactgcaatagataaacccaagagggacaggcaccagtagcctgagcttgctttctcccctggctcatgggaatcaagcagtagaaatttttagtgagtgttgttttccatagtatgcttactagttgtgtcttcctgttttgttcttggtgatttgaagaaacctgtttacaaggtaagggactgaaacaaataggtgacaggaaaaagagcagcaggggtacgagctggaggagtaagtggcttggcttgctctctttcagaatggagggctgtatggaaaggaggggtagtgttcttgaagagtgttggggtttaaatctagggggaccgtgtcttggcattgattgaaactcctggcttaacatcaccccgaaactgttagttggactgaacatgacatttggcagtgcagttaaaaacacttcctgctgtagcctggtaatggtcaggctatgtgaagagctgctctggagctcagtccagagcgggtattctgtttctttcactctgaaatcctgcctctcgatattttgagaaggaaggagttggtgaattgttttaaaatcctcgatgaatgtcttcatttattcatgacaccacttctgaatatatttatgtgccagacgctgaagtttactaatattatggtgcccagtaaatacttgtttttactaatattttttatggcaataaaatgactttttcaggattatgtgatttaaaagattgacccttttggcaaaatacgtattcatgataggaaatatatacaawatagttcacttaaacctcccaccagagcccagggttcactgttaccattctgaagtgactggaatttcctagaagtggatatgccatatttttttaaccactcctattggatatttgttttttatttttttgagatggggtcccactctgcagtgtacaatatcatagttcactgtaacgtgtatctcytgggctcaagcgatcctcccacctcagcctcctgagtagctagtcttcagtagctagactataggtgggcgccaccacasctggctttttaaaaamttttttatgaacacgaggtctcactatgttgcccaggctgccctcaaaytcctgggctcaagtgattctcccaccttggccttccgaagtgcagggattataggcgtgcgccactgcacccggccctgttggataaatgattccagtctctcccaaaaagaactgttgtragactgkggggtgaggggagggaagggacaaataggaacccgccgtattttccactccctgtgggcctaaaactgctctaaaaaatagtccatgaaaaaatacatagtacaaacagcaactctttctgatatgcttgcatttaaaatcaggctttttctcccttttggaaaaacacagtccttgtttgctttagggaagartaaaggtcagtgcgctgcattgcattaatttcgaagggaaagatgagaagacatcttgaaaggaatggctggctttctagagaatagtagaggcttaataggtgtcatagaaaaaccagggttggacagtggtagtaaaacggcaaaacagattttattcagaaaaactactgcagtaagaggagagagacctcggtacagaactgctccactgcgaatacaaagaaaagtaggaattgatggcgggggagccggatgtcagtggatggaaaattattacgaggaaacacaggggtgtgcrttcttgctgaaggcaggccagagttatcagacatcacctgagggatggagggggatgtggaacctaatcggctgtctagggtgatcagatactgaagttgggggattctggtcaaatcaatttagcaggattcttggtaaaaytgggcgatgcaaagacagatgcgttgagtacaaagtccaggcyttattgggaagaggatttcagcggagcccgagtagagtttggtctagggagactctgtcactgggaggacgagcgagccgctcggaagtgcgctgggttcycttagcggccagtgggttctggtgagaagggcaacagcgggaggaggcgccggtgcggagcgggaggccgggggcggggctgcggggctgcggggcgggcccgttgtgggtcggcccagcgcgtattcgagtagagggcgagcccgtcccgccyctcgtcgggcgcttcccagatctgcttgagtctatggaggaaaaactccgcggggtccgcgattcccatggccgcagccgcctgcggcaccaaggccatggccctcttcaagcgcaccttggtgctgagtcccgccgcggcgcccaggggcccgggcgcaggcascgccccgcggggctgctgcttgcctcctgccgcctggccctgcaaggactggcctcggggagagggcggcaggctgtgragccgcytgccccagtcccactcccactcccactcccactcccactcccactcctgctcctcgacgtctcccaccgccgtgtgtgttgtctgcccgcaggactcgctcagcagcagcctgaaaacttgctacargtatctcaatcagaccagtcgcagtttcgcagctgttatccaggcgctggatggggaaatgcggtgagtgatggaggcagcgcctctggcttggaggaaagcttgtccgggacytttgagtgtgttggaagctaccttttgatatagcgctcagcgttgcagcctcgttgctgtggcttatccagaacatagcccggccctacgtgtttactttagaaagcccttccaggctctttgccatctagtagagtccctgcgggcccagcctttcagagaagvgggsggagggggtgatgtttattaactttttttagtcttggcagctgaacctgcctgtgagcaggtcgtgtatttctcggcttcccttatccaactttgcatttctatttctagcatattgggttgattcttttgaagctgcctctgtgcasattacacccatgaacttagaccmgttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatgtaaggaaggaaaactaatgtaactttcgttaagtatgaaaagcgttggatatccttatagttctttagagttaagggtgagatgggtttagaaagtggccaggcacaagttattttaaaataaaaaatctttggctgtttgttccaatatattaatagttttcccttttttacagcaaygcagtgtgcatattttatctggttctccgagctctggacacactggaagatgacatgaccatcagtgtggaaaagaaggtcccgctgttacacaactttcactctttcytttmccaaccagactggcggttcatggagagcaaggagaaggatcgccaggtgctggaggacttcccaacggtgagtggggttacgcatcttgtctacggactgttgtgttcataattgctaacgtggttgtccggtagcctccatacatgtggagaaaggttaaataagcattctgagggcagcataatgtgagggttaaaaactcyggtagccaagactctgaagccaggctgcctgggttggaatctcaaatctcccacttactaaactgttggttacttacaaagactctctgtgcctcagtttcttcatctgtaaaataggggtaataataacacctacctcatggtattctgaggattcaaagaattaacgtaggtaatgctcttagaatgttagctactgctgttattatcagtattggaagtccagtgtttcttcctgtgggaagacgcagtcaaattttagtgttgtgaaagattctcaggctagctcacaaaagcctgccgactgtatgatgcagcctacctgtaacactgctggcctcttgactacccggagcctggtagcatgggactgctgctcacgatgggcagcagcctggyatgggggcggtgtctgttggcagctagggcgagcctctgccacttcacctgtgatcctgggcaagttccttatctgctttgtgtctccgtctcctcgtttgtaaagttagagctgagaggattaatttcgcacatataaagtacttagtgcctggtacagggtaagtattctgtaagtattagctatttggtctattttgttggagtaaagtgggttatagttaaaatcctaagatttttaaagtccctcaagttcaygtggacatctrcctaggtcctactatcctagaattcgcatgtcttatcacayaaataactgattcttccatatcttataaataaaggtttgatttagcaaagtcacatgttgtgtaatagctcgaagaagccctttttgtccacagttgccagagcttttggagaacagtccttatgttattgaaacaaacctaatctgtagctgagttgggagggagctaagtggacagagagtcctccacccaaacaaaagaatctttgattyttgggcataatgggagcaatatttaaaaaaaaaaaaaaaaaaaaaaaaaggaatgtttggggaagactcttgcggtgcaaaggctgtttcagattgctgagatcagaccttaagtaccaaagcccaaatatagtacaacataatacaaatgagaagaaaatagctgaagaataattcgagtttatacagtacaattcaagagaagaaagaaaatttatgacgactagctgggtgagaattaraactgtaaccctgggaaggtcctggtgatttgactctcacaggacacctgatgaccagaggatgggtttcctttgatgggaaatctgtggcgattcattgatgggcytctgaattctgctgaagcagaggaagtagtaataccccatttataatggaagtgcattctcacttaaaaacaactaatattattctagctggacctagcctctagaaacagccaaattacatttgacttgagtggattcataataattaaaaaatttctggggcatgggataaatgtgttaggtattgctaagtcaaggcagccctatcccctcagcagaagtgagggaatatgaaagtgtgtgaatgctaacataattttggggaatatcgccgtcagatttccagatgatattccaacatgtttgtgaaacttcagtgtcttcctgtgttcatacagtgttccagtggaaaaataatgcttagttctggaaggtttcagatgtgaacactgaactcatcgttttcttttttgggtagtagagttagagattccatcctcttgaaagcacagttgccccgggaagagtaaaagggagcagaaggcgtaagccaggcacggctgttttcactgttgttcaccttttgtatccttacgaatatgaagatgtactaagttgtgtgttttgcgtgcatatataattttaagctacttgagttgtaggtccctccagtctgtgattcagtttgagatgggactgtatgggaattaacagtgccttgtcttcttaagsagtgatttgtgtatgtgctgatatagctcagtatgtctttgaaaccagttgtctggggctaggcctgcaatcagcttttggctaagaggtcccaggatggaacaagtagtgtgaaagaggactgataccttggcctcacacacagtactgctcttagactggggcaagtgaaactcctcacttcagagtgccccattctaggccccctcactcccaaaggggtgagggatcactggggccatgggaatgtgcttgttcagctctcgtgggctctccttctgtaccacgttctggacatctggagttccttgccccaaatccctgagcccacgtctgcgtccgcacagtctatttcctaaggtcagtccatctcctccaggtgggaacgtgccaccattgactgtgcccttgggcctgagtgatggccaagggctgtgttggggagtgttgtggatggatcctggcaccgagggctgggatatcctctcaaatgaatgtgaggtgcctcccagtgctggagagagcgggattcaggaagcagtggaagggaagagcctgggatatggggatcagctgtctgtgccctgctgcattctggaataaaactctgagggactaagaattctaaattcaaacctgaatcaaccaggttgttacaaagatawgtttgtcagtgcaggaggatacaatatattttacttaagttactagctcgattgatcatttttaaatttttagctacatatagtatgtgggcctccatttgtcctcttatcccaggccttgcagaatttaggaataagcctcaatacagtgttctaacccagtgacytccgcctcratgtacagtagattgaacctgatcctttatactttagtgatcattagttgataccagttcaagtcaggctttctagaaatctcattgtatgttaggggttcgattagagtacagtcatgcatcacttaatgaatggccacaggatacattctgagaaaygcattgatagatgatttcatcattctgtgaacatcatagagtgtacttacacataccaagatggcatagctactacagacgtaggctctgtggtacaggccattgctccaaggctgcacatctctacaggatggtactgtactgaatactgtaggcaattggagcacagtggtaagtatttgtgtatttaaacatagaaaaggtatagtaaaaacagggtgttacagtcttaagggcccaccattgtatttccagtctccgttgactgaaacatcattatacagtacatgagcacgtatctttctcacctggtactagtggaaagctagaaggcttagaagtctacctgtaaacatagcttaagtaataatacagccttatttttaaatgataatagcaataatagtgttcacttattgagcattttactatgagttacttactaaatatatttcatcgttaatttactctttgtgttatttgatctataayatcgtttaacagggaaattacctagtacataatgtactgttatctacattttatctagatgaggaaactgaggcacagagaaattaagtactttgcctaggattacccrtgaagttaagtgacagaatcaatgaatctggaaggtctggcttcagatctcttgtgctgagtcactcgcatactttactacctctaaggtttctaatcagaggaatttgtatctgtattccctgctactcttaccctctatgtgggatttggcctttctccattatccctgtgaactcgctctgggaccttccttcttgtacttggaaccatcagaaagtgatctgagaacatagaaatctactgtgttgtgaaacagaattacctggaagcggaaaaagccctcctggctcaattcacatgtcacggcttatggtcgtayccggggaacatatgaaactgggcactgagtgcggagtcaggaaagccctgtccatcctctgggtttctggggaaaacgtggaccccttcattgtcactttctcctgtatatttttgtttttacttttagaactgtacaattacgtaataaataataaaaagtcgttggaaggataggtgaagttcagaagtgaaagtgttttggaggagtctaagctccttcccaccctcattgacctttcctctctaataaatagaactggtctaaccaaggatctgtggaatgagcagagtccaacggagattcagggattctaataacctcttgtagaatcactggtttgtttcagccacaagaaggaattaccttttgacattggcttgaacagctgttgtgcaaagaaaaactttttggaaagttctggaagtaccagattgattttataggtttttttttttttttttggagggacatgggggtattgacagttgatgttaatcagaaatcctaaattatgtgtattcctggtatgttgcaatcagccggccacctggttttcctctgggctcttaattttaggtgtattccgaggaagtttttctaacttttctgtaaacacagaccaggtatattgcatactttcaatgtttaaccaaatctcttcactgtttgcagtattatctgtaggctctcatgttttaagacttcccatggtgtttttgtattgtattttgctaacctataaacaattctttgaacttaaaacaagatatttgggcagtaacaataaattttaaaaacatcaattcaacttttttacattagggcttggactatggaaaaagtattgggcagcatgcctcatactgagttgtttaatgaatttaaaagtatagccttaatagtgagagaaactctatagcttcataatataaattgggtaactaatgagataaaatggttggcagatctgctcactagaatytaagctcttcaagggtctgagtttttttttttctttttcttttattatactttaagttctagggtacatgtgcacaacgtgcaggtttgttacataggtatacatgtgccatgttggtttgctacacccatcarctcgtcatttacattaggtatttctcgtaatgctatccctcccttggccccccaccccacaacaggccccggtatgtgatgttcccctccytgtgtccatgtgttctcattgttcaactcccacttaggagtgagaacatgtagtgtttggttttctgtcgttgtgatactttgctcagaatgatgatttccagcttcatccatgtccctgcaaaggacatgaactcatcctttttttatggctgtgtagtattccatggtgtatatgtgccacattttctttattcagtctattattgatggacatttgggttggttccaggtctttgctattgtgaatagtgccacagtaaacatacatgtgcttgtgtcttcatagttggacgagttataatcctttgggtatatgcccagtaatgggattgctgggtcaaatggtatttctagttctagatccttggggaatcaccatactgtcttccacaatggttgaactaatttacactcccaccaacagtgtaaatttagtcctgtttctccacatcctctccagcatctgttgtttcctgactttttaaatgatcgccattgtaactggcttgagatggtatctcattgtggttttgatttgcatttctctgatgaccagtggtgatgagcatttcttcatatgtctgttggctgcataaatgtcttcctttgagaagtgtctgttcatatcctttgcccacttattgatggggttgttgattttcttgtaaattttttttaagttctttgtagattctggatactaccctttgttggatggataaattacaaaaattttctcctattctgtaggttgccttttactctgatgatagtttcttttgctgtgcagaagctctttagttgaattagatcccatttgtctagtttggcttttgttgccattgcttttggtgttttagtcatgaagtctttgcccatgcctatgtcctgaatggtattgactgcatttycttctagggtttttacggttttaggccttatatttaagccttcagtccatcttgagttaatttttgtataagatgtaaggaagggatccagtttcagctttctacatatggcaagccaggtttcccagcagcatttattaaatagggaatcctttctccattgcttgtttttgtcaggtttgtcaaagatcagatggctgtagatgtgtagtgttatttctgaggcctctgttccgttccattggtgtacatatctgttttggtaccagtaccatgctgttttggttactgtagccttgtagtatagtttgaagtcaggtagcgtgatgcctccagctttgttcttttggcttargattgtcttggctatgcaggctcttttttgcttccatgtgaaatttaaagtagttttttccaattctgtgaagaaagtcattggtagcttgatggggatagcattgaatctgtaaattaccttgggcagtatagccattttcacsatactgattcttcctatccatgagcatggaatgttcttccatttgtttatggcctcttttatttcattgagcagtggtttgtagttctctttgaagaggtccttcatatcccttgtaagttggattcctaggtgttgtattctctttgtagstattgtgaatgggagttcactcatgatttggctccttgtttgtctgttattggtgtatagsaatgcttgagattttttgcacattgattttgtatcctgagactttgctgaagttgcttakcagcttaaggagatttagggctgagacgatggggttttctaaatatacaatcatgtcatttgcaaacaggcaattttacttcctcttttcctaattgaataccctttatttctttctcttgcctgattatcctggccagaactaccaatactgtgttgaataggagtggtgagaggacggcatccttgtcttgtgcaggttttcaaagggaatgcttccagtttttgcccattcagtatgatattggctttgggtttgtcataaatagctccttattattttgagatgcgttccatcaatatctagtttactgagagtttttagcatgaaagactgttgaattttgtcaaaggcctttcgtgcatctattgagataatcatgtggtttttgtcataggttctgtttatgtgatggatgatgtttattgatttgtgtatgttgaacagccttgcatcccagggatgaagccgacttgatcgtggtggataagctttttgatgtgctgctggattcaatttgccattattttatagmggattttcgcatcaacgttcatcagggatattggcctaaaattctctttttttattgtttgtctgccaggctttggtatcaggatgatgctggcctcataaaatgagttagggaggattccctctttttctattggaatagtttcagaaggaatggtaccagctcctctttgtacctctggtagaattcggctgtgaatctgtctgttcctggactttctttggttggtaggctattaattattgcctcaatttcagagcctgctattggtcatttcagaggttcaacttcttcctggtttagtcttgggagagtgtatgtgtcgaggaatgtatccatttcttctggattttctagcttatttgcatagaggtgttgatagtattctccagtggtagtttgtatttctgtgggattggtggtgatatcccctttatcattttttattacgtctwtttgattcttctgtcttttcttcttgctagcggtctatcaattttgttgatcttttcaaaaaaccagctcctggattcattaatttttttttttgaagggttttttgtgtgtctrtctctttcagttctgctctgatcttagttatttcttgccttttactagcttttcaatttgtttgctcttgcttttctagttcttttaattgtgatgttaaggtgttgtttttagatctttcctgctttctcttgtgagcatttagtgctataaatttccctctacacwctgctttaaatgtgtcccagagattctggtatgttgtgtctttgttctcattggtttcaaagaacawctttatttctgctttcatttcgttatgtacccagtagtcattcaggagcaggttgttcagtttccatgtagatgtgtggttttgagtgagtttattaatcctgagttctaatttgatttcactgtggtctgagagaaagtttgttgtaatttctgttcttttacatttgctgagcagtgtttttcttccaattctgtggtcaattttagaataagtgcgatgtggtgctgagaagaatgtatattctgttgatttggggtggagagttctgtagatgtctgttaggtctgcttggtccagagctgagttcaagtcctggatatccttgttaaccttttgtcttgttgatctatctaatattgacagtgggatgttagactcgcacacaataataatgagagactttaagtctttttctaggtctctaaggacttgctttatgaatctgggtgctcctgtattgggtacatatatgtttaagatagttagctcttcttgttgaattgatccctttaccattatgtagtggccttctttgtctcttttgatcttagttggtttaaagtctgttttattagagactaggattgcattccctgcttttttttttcgcttggtagatcttcctccagctgtttattttgagcctatgtgcatctctgcacgtgagacgggtctcctgaatacagcacagtgacgggccttgactgtttatccaatttgccagtctgcgtcttttaactggggcatttagcccacttatatttaaggttaatattgttatgtttgaatttgatctgtcattatgatgtttgctggwtattttgcccattaattgatgcagtttcttcctagcctcgatggtctttacaatttggcatgtttttgcagtggctggtaccagttgttcctttccatttktactgcttccttcaggagctcttttagggcaggcctggtggtgacaaaatctctgagcatttgcttgtctgtraaggattttatttctccttcacttgtgaaacttagtttggctggttatgagattctgggttgaaaattctttaagaatgctgaatattgrcccccactctcttctggctwgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatrtctttgtggtgttctctgtatttcctgaatttgaatgttgacctgccttgctaggttggggaagttctcctggataatatactgaagagtgttttgtaacttggktccattctgtctatcactttcaggtacaamartcatagcattggtcttttcacatagtcgcatatttattgaagcctttgttcatttcttttcattcttttttctctaatcttgtcttcttgctttatttcattaatttgatcttygatcactgatatcctttcttctgcttgatcgaatcggctattgaagcttgtttatgctttgtgaaattcttgtactttggttttcagctccatcaggtcatttaagctcttctctacactggttattctagttagccatwtgtccaaccttttctcaaggttttaagtttccttgcgatsggtcagaacgtgctsctttagcttggagaagtttgttattaccaaccttctgaagcctacttctgtcaactcgttaaactcattgtccatccagttttgttcctttgctggtgaggagttacgttcctttggaggagaagaggcgttctgtttttggaattttcagcytttctgctgtggtktctccccatctttgtggttttatctacctttggtctttgattttggtgacgyacagatgggttttggtgtgggtgtcctttttgttgatattgatcctattcctttgtttgttagttttccttctaacagaggcccgtcagctgcaggtctgttggagttgctggaggtccmctctagaccctgtttacctgggtatcaccagtggaggctgcagaacagcaaatatcgcggcctgatccttcctctggaagcttcgtccaagaaggacacccacctatatgaggtgtctgtcggcccctactgggaggtgtctcctcccagtcaggctacawggggctcagggacccacttgaggaggcagtctgtccgttactggagttcaaatgccgagctgggagaaccactgctctcttcagagctgtcaggcagggmtgtttaaatctgcagaagccgtctgctgccttttgtttagatatgccctgcccccagagatgcaatctagagaggcagtaggccttgctgagctgcggtgggctccacccagttcaagcttccttgctgctttgtttacactgtgagcatagaagtgcgtactgaagcctcagcaatggcggggaggcgcttcccctcaccaagctccagcatcccagcttgatctcagactgcttggctagcagcaagcaaggttccatgggcatgggaccccccgagccaggcactggaggcaatcacctgctctgccagttgcgaagactgggaaaagcacagtatttgggcagagtatactgttcctccaggtacagtcactcacgcctttccttggctaggaaagggaaatcccctgaccccttgcacttcctggatgaggtgacgtcctgccctgctttggctcaccctccatgggctgcacccactgtccaaccagtgccartgagatgaaccaggtacctcagttggaaatgcagaaatcacccatcttctgcatcgatcttgctgggagctgtagaccagagctgttcctactgggrcatcttggaagcaactctgggtctgagtttctgtttgttgccctgatgtatatccccagtgcctagaatgatacttgttacataggaagtgcttgatccatgtttgcacaaatgaatctttctcataatgaggtttctctaaacaagctgttctcccaaaaacttamacccagctttatgttgaagcatctcattatacattggaaagatgaaatgtgtagtgagactttgaatcttcttttgaatctagaaacattagcatttttagaccattctattttaatatttatgaaatttatgaaataataagaaacatgaggccgggctcagtggcttatgcctgtaatcccagcagtttgggaggccagggctagtggatcatgaggtcaggaatttgagaccagcttggccaacatggtgaaaccccacttctactaaaaatataaaaattagctgggcgtggtggtgcatgcctgtaatgccagctcctggagaggctgaggcaggagaatcatttgaacctgggaggcggagtttgcagtgagctgagatcgtgccattgcactccagcctgggcaacattgcgagactccatctcaaaaacaaaaacaaaaacaaaaaaaatgtgtgacctaaattaggcttatagatgaaccattgcagtcatgattaattccgccattgtttgccttgtgatctttggtgccatgtctgtacatatttcatgatttctgtgtttttacggtttccatttcagatctcccttgagtttagaaatctggctgagaaataccaaacagtgattgccgacatttgccggagaatgggcattgggatggcagagtttttggataagcatgtgacctctgaacaggagtgggacaaggttagtctcataaaacagtgtctgtgtgtgatgtattagacagagctggcagtcctcatagtgaagctcagaacaagaaaagttrtccagtattttcagcccctctggttttacaattcatctgtttaggttgaatgtctcatcataaacagtttattccagagttaattccaaaccagcagctatgtaggatatcagccaggctaggagtaggrtactggagagaagtgcttatctagacaaagggatgtaattgaccatgaagattaaaactacacatcaaaacataaggtagggttaggagtcttgcctatttttcataggaatggtgtttgtgagacttactcatcacttctgtggaagtaaagacattttatttatttattttaaagccartcagatttagcaggcagagacatttcagacatctaaagtgttgatgtatttcatacctttaactgtgcttaaattaggatctccgaaaagatgctgctacatggtcactacgttagtgtaggtccaaggtcttgggcctcttaatttttcaaacctcaaaacttgacagcagttatctttggaactgctgatttgtgcttcctaagttaacagcatacaatgaytgctagaaatcaatttctgcatttaaggtgaagttagccgggtactatggtttacctgtaatctcagcactttgggaggctgaggtgggaggatcatttgagcccaggagttagacacaagcctaagcaacatagcgagaccccgtctttcaaaaaattaaaaaatgagcagggaattggtggcatgtgcctgtggtcccagctactctggaggctgaggtgtgggaggattgcttgagcccaagagttgaaggttgcagtgagccatgattgtgccactgcactccaacgtgggtgacagagcaagacaccatctgaaagaaaataaagttgaagttaaaacttctggccaagaaccagcactggttatgatagtaactcattttctgttgtgcagatttattcaggaaacttaattttaggttgttgaatagaagttttgatcagataaaattgaattaaaaaaaattttttttgagacagggtcttgctgttatccaggctggtgtgtagtggtgtgatcacggytccccgcagcctcaacctcctgggctcaggtgatcctcccacctcagcctaccgagtagctgtaactacagtgcatgacaccataccaggctcatttttgtacattttttgtagagagagggttttgccatgttgcccaggctagtctcaaactcctggcatcaaacagtcctcccactctggcctctcaaatgttgggattacaggcatgaccagccaattatttcaaggagttattttttttcttctactttgggggaagatgaattatataagtctccattttaggagtatttctaccaaaagaactattatcttcaaatatatttttggatagtactatagatatactaatttttttttaaatttctagtaattcttttgaagattttgtatagctgtccaaagccaatttctgtctacctaatttcagcaagatttcactcttttcatgttacttttgtcccagaacaaatttcaagtgctttctcttcacctgtgcattcttccccctgattagtctctggctttgtattactttcagtcagagacgactttttttttttgagacagggtctcactctgtcacccagactggaatgcagtggcacagacaaggcagccttgaccttctgggctcaagcaatcttccttgccctcagcctcctgagtaactgggaccacaggcacgttgccaccatgcctggctartttattttaatttttattatttttgagacagggtattgctctgtcacccaggctggagtgtagtggcatgatcaaggctcactgcagccttcacctcctgtgctcaagcagtcctctcacctcagcctccccattagctggractataggtccacaccactacaccaggctaatttttgtaattttttggtagagacagggtttcatcgtgttgcctaggctggtcttgagctcctgggctcaagcgattcacctgccttagcctcccaggtgtgagccactacactcagccttttaaaattttttacagagatgaggtcttgctttgttggccaggctggtctaaaactcttgggctcaagcagtcccctctccacagcctcccaaaattccgggattacaggcgtgaacttcggtcatttcctaacttttacccttcctaatgacactccagagcttaccttctttacttttgcttcttaagttaactaatagacaattattgtatgtggatattgcattaagttgtcttaggatacccttttcagaggaggacagcttttgacaaattgctgtcgcggaaaaaaaaagtatttggcaattaagagttgcatttactgaaatctctgttgagagaggggaagttacgttgtctctaaaagaaaaactaaaaagaaaaggggaagttttagcaaagttgttaaagcctgacacttaagtcatactacctagttttgaactcttagcccctgccacagacacggcagccccttgaaccttcctgggttcaagcgagcctcctacttcagccccctgagtaactgggaccactggcctgtgtcactgtgcctggctaattttttttttttcctcacatgggcaatgttgggcaagttaaatcgacttctttgtgcctcagtttcctcatctgaaatggagatcatactgctatgtacctgatacaatgtttgtgaggattgaatgtgcagagttctttttttctgttgttgttgttttgagacggagtctcactctgtcgcccaggctggagtgcagtggcgcgatctcggctccctgcaagctccacctcctgggttcacgccattctcctgccttagccttctgagtagctgggactacaggcacccgccaccaggccagctaatttttttgtatttttagtagagacggggtttcaccgtsttagccaggatggtcttgatctcctgayctcgtgatccgcccgtctcagcttcccaaagtgctgggattacaggcatgagccatcgtgcccggctgaatgtgcagagttcttaaaacmgtgtcaagaacataaaatagttatttgttctttcatataatgatgattttgagggcctgcggatcttgacatgttatcagattggtcaaaaaaagattaaaccatagttggtattgtcctagttcctgttaccagaatattccatctttcatcgttgccttctctcatagttttatgtatcaaaaagtttattgtaaagctaggscgggcacggtgtcttgggctggtaatcccagcactttgggaggccaaggctggcagatcagttgaggtcaggagttcgagaccagcgtggccaacatggtgaaaccccgtctctactaaaaataaaaaattagctggatgtggtggtgggtgctttaattccagctactcaggaagctgaggcaggagaatcacttgaacccaagaggcagaggttgcagtgagttgagattgtgccastgcactccagcccaggggacaaagtgagacttgatctcaaaaaaaaaaaaaaaaaaaagttattgtaaagctagacacggtggtatttgcctacaatcccagctgttcgggaagctgaggcagaaagattgcttgggtccagtagtttgagtctaacgtgggcaaatatatgagactccatctcaaaaaaaaaaawaaaaaataaaaataaaaaaatgtttactagtttttttcagtagccttttattatagtagcagtacatgtgtattgtagaaatttggaaaatacaagtgaaaaataaaaacatcaaattcccgtcagccagagactgctrtgaaatgttttgagcacatccttcttgaatgttttttaaatcctggtatgtatatttgtattttaaaatcaaaatgcattcttacccattctcttttgaacctgcttttttgtagctaatgatctctagtgtgtccatttcagtaaaaatkscattattaaagtgctttaaaaatcgtctcttacagtactgccactatgttgctgggctggtcggaattggcctttcccgtcttttctcagcctcagagtttgaagaccccttagttggtgaagatacagaacgtgccaactctatgggcctgtttntgcagaaaacaaacatcatccgtgactatctggaagaccagcaaggaggaagagagttctggcctcaagaggtaacagattcagggtattttgggggaaaataactttagacattctctgaaaaatcctttaactcttgtggttgcgggtgacagaaaaacaagycaggcctcccccaggcagcataaggggatgtggaaaataggataghttgacatgagtttgcttcaggtagactggctgactcccaggattcacaccacgtaatcagtatattcaagccttgctgtccttgatttctttcagacggtctttctccaagtggtggatatggtaacaacccaygtgcactagcttaacaaaaagttcttaggaatggctttgttcggcctggcgcagtggctcatgcctgtaatcmcaacagtttgagaggccaaggtgggcggatcacctgaggccaggagttcgagaccagcctggccaacatmgtgaaaccccgtgtttactaaaaaatacaaaaattagccgggcgtggtggcaagggcttgtaatcccagctacctgggaggctgaggcaggagaatcgcttgaacccaggaagcagagattgcggtgagctcagattgtgccactgcactccagcctgggcgacagagtgagactccctctcaaaagaagaggaagggcttggttcttctgctcagccctgaatcagttactgttgctacacagctgagttctctggcctcrcctggattacgtctacacagtacacacagaatggatttcccccaaagaaagaattctgcrgcaggaaggggaaagggatggcaggtagacaaaaactccaggtgtctgtaataagggacagggtcgatctttaattaaaacatggacagggaacagaaagcttttgatactgattttgttcagaaggaaagtagaaaattttatgactgttccctgaatttattccagcatttaccttttgctttccataaaagtgtttcctgcagccaagtactttaaagttttaaaaagacgggtgaggctaagtgtggtgtctcatacttataatcccagtgctgaggccaggagttcaagaccagcctgagcaacacagcaagataccatctctataaaaaattgttagaaaatgattctgctgaaagagcaaaaataaaaattaaagaaagtagaaaaaataaaactaaatttaaaagattaactgggcatgttggcatgcacctgtattcctaggtattcgggaggctaaggcacaaggatcccttgagcgcaggagctcaaggttggattgagttgtaatcacaccactgcactccagcctcggtggcasaatgaaactgtctcaagaaaaaaaaaaagtgacagagggaaacaatatttgcaattcatagagcagatacagggttcatattcctaatattaaaaaaaacttctaaaagttaagaaaaaggccaactgccccacagaaaaatgggcaaggagataagaacaagatwgttcacaggaagagacacacagatgattattaaaaatctgaaaagatgctgagtcttactcctaagaaaaattcacatttaaactactctgggggctgggcaaggtggctcacgcctgtaatctcaacactgggagaccaaggyaggaagatcactgaagccaggrtatcgagaccagcctggacaacgtagtgagaccttatctcttaaaacaaaacaaaacaaaacaaaamaaaaaaaacagtaaaaattggccgggcacagtgactcctgcctrtaatcccagcactttgggaagcccaggtgagtggatcacttgaggtcaggtgtttgagaacagcctggccaacatggcaaaaytccgtctctactaaaattacaaaaattagccaagtgtggtggcatacgctggtagggccagctacttgggaggctgatgtgagactccatttaaaaaaaaaaaatcaaaaattagctgggtatagtggcacacccctatagttctcgctccttgggaggttgaggcaggaggattgcctgagcccaggagttcaaggctgcagtgaaycatgatcrcaccactgcattctagcagcctgggagacagagcaaaacccttgtctcaaaacaaasaaacaacaacaaaaaaacaaaaaacacttccctcagctcagacatggccttttaagtttcctaggtgactcgtgtgcagccagggttgagaaaccactcttgtcttacccctcttttgcagacacagggctcagagaagggaaggggattgtctggggatgtatagtgaggsagtggctgccttgraagtggagtctcagtctcccggctcctaggccagcccctgaccactgttccattgtctcccagacagaacatcagccacgggcatgtgatgcaygagcgtgagccacaccatcttgcacacacaggagcagagccctgctcttctcattcacttactttatctgtaaaatagcatcatttctaccacacggtggtggtgtgaataaaatgagatgaacttctagcatagagtgcttagtaaaggttctggacatttcgtagtagttgaatcatgccaaatgtggtcctaggtgattggcttcttttgctagcatgttttcagggctcctccatgctggggcattgcatcactgctttattcctttttatcgcctagtattattccactgtgtggatagaccacatttatccattcatyagttgraggatatttgggttcttcccattttttttggctatggtgaatagtastgtgtacatttgcatataagkttttgtgtagatgtgtgttttcctttttcttgggtctatgctgagaagtggaattgctggttcatacagcagctcgaaccttktgaggagctgccagacgcttttccaaggtcgctccaccattttacattcccgtcagcagtgtgagagtcccagtttcaccagcacttgttgttatctctttttaactgtatgtatatatacttaacattttatttataataaatgtacataatagagaatttgccattttaactatttttaagtctattattcagtggcattaagtacattaatgatgttatataaccatcaacactatgtttccagaactttcgctagcttcasagaatcctctaaataatatcattaaaaatcatcaagccgaatcccactgttagaattaaaggttttatttcactttcaagttatcaggatccagggaggtgtaatacacttagaggatagactcagctcatttcccagctatgcctttcagcagcwttcttaccagagtaggaatataatgttagtcattatttagaggcctggccatcttgagaaggtttactgtttagtctgcagtacaattataactgtttttgtatattgggttatttttttcagaagtaggccagtagctctaacaggagcctctttagcctgaattcrtccaagtagtgcagtgttgcactagttgtccctcgggacatgctccccaatacgtaactcacttccaggttgcaactggacacttactggtagtcagaaatagctattgcatggagcttaaaatgaacttgatcttcgtgaaagatgagtctgcagctaagagactttactgtatatcatagtgtttttttttgttttgttttgtttttgtttttgtgacggagtctcactctttcacccaggctggagtgcaatggcgagatcttgactcactgcaacctccgccccctaggttcaagcaattcttctgtctcaccctcctgagtagctgggattacaggcgcctgccaccgtacccrgctagtttttgtatttttagtagacacagggtttcaccaccttggccaggctggtcttgaactcctgacctcgtgatccaccctcctcggcctcccaaagtgctgggattacaggcgtgagccacggcgcccagcctgtatcatagttcttatgcacaaagaccctttaatattgtttgtaaattctcccctatgcacacgctgacctgttccttaatcttcttatctgtctaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtagggaasggggctcctctgggtggatayggggctaaagggagtggggtaggagtaagggtggattttgctgtgctatattcaaggatatgattccttaaaaagacgatgactccagtttattacgctgggagtttcatagcacccgcctttgcttccagccaccaaactcagctcagccttgaggttaagcctgctccttttcagaaccttctttcyggatttactattttctacagctatcctaaactagttaggttcttttcctcacagttaagtcaaggtctttggcttagatttatggggagtgctgggtaaaacctgggtgaagctgttatcattaaaaagtcttcattaagcacctaattactgctgtccttttcctagacccggcataaaaagaacctggtccggtagacctagcctctcagtatgctaggaacttacactttttagttgcctttaccaagtattgcagatactactgcaaataagtgaagaaagtaacagcatttaactgatttgggaacttggtttgatcttgttctaatgaccmacttcgaatggtggttgaaagtaaaatctgtatcgccgtcttatgtttccatttacctagaaatactttacctttgagcacaggaaattaatccccttctggttgttctccccctggcattggttttaaatatataatgattatgtttgttgtakgaaaaatagaaaaacaactacaatagaaaattcttcccatatattattttgaaatacatatttccgatccgataatccattgctctagcatggaaaatgttggatttacttgtgtttgctttttccaaataaaatggaacttttgtggctacattatagaattgttttagactgcttaattctgtgtgttgttgaraaagggaggagtggggaaggtaaaaatcttgacatactttcttcgtgggtattttttcttgagcgattccatcttagttgattagcagttagcaattgcccattcaacagaaggttttcttacctttttgtgataatgatagctaacgacatcatttcttcttttttccctctcttcttgttgtctctaggtgatggccattgccactttggctgcctgttataataaccagcaggtgttcaaaggggcagtgaagattcggaaagggcaagcagtgaccctsatgatggatgccaccaatatgccagctgtcaaagccatcatatatcagtatatggaagaggtgggtttttatttaactacttggataatttgtagctacttttatgatktagtaatgtcactgtttaaccaggtttggatattagatgatcctaacaattcactatcctgtggcctaaagagacaggaattgatatcctttataaggaaaaaagtctattcacaggagccgagcagattgctcactgctgtgtagtaccctggtgagaggagataaatggagsaaggctgtaggttggagcccctcagtagaatcatagattttgagctgcaagatgatgcaggaggccaaccaagcttcttgttgctggtgaggaatgtgaggttgaagcttgtctgtgctgatgcagtgcgtgattgagtggatctctggctcccgtccatgtgtcctgacacccagtctggtactttcattatgccacaggcctcaattgaaaaatcacagtagggaatttaggccaaggaaagccatcaagttgcaattatttcctaaattttctttggaaaatttcatttcaaataccaaaaccatcctataaaaagaaaacttaccttcttaggtcaaatctctaatatttgactagrttcaaaaagtttatttctggccaggcacagtagcttactcctgaaatcccagcactttgggagaccaaggtgggaggatcacttgaggccaggaattcaagaccagcccgggcgacatagcaagaccccatttctacaaaaaatttaaaaattgtcatggtggtgcacgcctgtggtcccagctactcaggaggctgaggcaggtggatcacatgagcctgagaggtcgaggctacagtaagctgtgtgatttcatcattgcactctagcctgggtgatagagtgagactttgtctcaaaaaaaaaaaaaaaaaaaaargtcttasagaccagaagtctytgtaatctctaataatctctaggccctagagcagtggtttgtaaatggaggtgatttgctcccctccccccagaggacattggacaatgtctggagacatttttgattgtcctaaccggcaggaatcgggtgctactggcatctggtgagtagaggcccaggatgatgctgtgatcctcaggtgtgatcctgttgagaatgaaacactgtagactttatgaaaacatacaagaccctcatcatttttcctttgcctgagctccctccccagaggttacctctgttcatggttttgtgcatccgtctagtccccctrttacgcgtttacaggaatatggtttgcaacagtgttttcatctaaatagaattatacaaaatagcgatttctgatttctcttgcatattgcacattcttcttatacttcctccctacctttatctgacacagaaatgctgtatgtccagaacttctatcagaggcacctatggaagtctaagggaagaccacatcgcttttaaaaaccctaaaattttgtagtcactagatgaaaatattcagccagtgacccaaaaaattgctaccaatgagactctccattttgccatgtagccagaacttactttgatctatgtgcctggggtagtgaccaagtaggtgggtaggagtaatctcagggaaacttgaggccccagcctcatggctagggtcataatttgaacccaggtctgtctgacatcagaatccatgatgttaaccccaattctaaggggttcaactaccctttctaaatggaatcctgctatattargcactatttattcattttatataaactagaaacattttatgtagtaagtagttgagagtgttttggttttgcagtttgatcactagttttagaaaccagtttttaaacactttgtggccaattccattactatattaaaattcagatttatttggtttttccttaactattgggattaaatcctggttgtaattcatagtttgagggcgagggtgggcagtctacakttggctgagccctgtttttgtgaataaatgttatcagaacacagccacacccatttgcttctwtgtcttctgtggctgcttttgcaatgtgacggccgagttgaggagctgcaacaggcgatgacttgtaaagctgaaaatattttttggcccttgaataagaggttkgctgacttctgacttagggyatcagttgttctgttatcccagtaaaactcaaggcattaggggaraaatgttaatattaatacttaagttgatttgatttagggaaatctttgaagatttctaagtcttaagcagtagaacctgttaatggttttagtttcagcagtaaggacattttacaagtaaagttttaaatgaaaacattttgtatgaagccacaagtcgtctggcctcttgctggtgtccagatattaacactgatcctatttctccttgctgaccaagtctgtcctttgtagtaagaaaggaagaaacgttgactctgtccgatctctggacttagtgttgtagcgagcatgcacctggaagggacttgccagaggacctcctcatgcttctccagtgcttagtgggggcttggagtgcagccccaggtcttcacgagcagttggccacactgcagggccctcaccccactctggagcagcctctgcttcaaaccagcctggatgcttgtcagctggggagaagatcaacctgctattttgggatagaaataaatgctcagccaaacggccagaaacccccattcccctctctgccaaagtgaattccttggcagggagaakcttgttcgtgtctctgcacacttcctgtgccctcctgtggttaagtcagagaatcatccggctctttgagccccaggtgcctagctgctcaaggatggtccccagccagcagctgccaggaatcacctgggagcccattaagacatccagcccccacccaaacstatcgaatcagaatctgcctttttttcccaaatgatgtttttgctttaatggaagtttagatgttcatagacaagagttttaaatgatgatcaagctgattccatattcgcagttgtaagtagaactgctgagacgtggaagtaccacatggactcacagaggagctgctgtatgtagcacagcattgcacaagagcttatttcagtctagtaaacatttataggagcctgtgtcatttaatcatcaagcctcgcactgtggctcacacctgtaatcccaaaactttgggaggctgaggcaggcagatcacttgaggtaaggagttcgagaccagcctggccaatatggcaaaaccctgtctctactaaaaatacaayatttagccaggtgtggtggtgcacacttgtcatcccagctattccggagcctgagacatgagcatcgcttgaactcgggaggtggagkttgtagtgagctgagatggcaccactgcactccagcctgggcaacagggtgaaggccctttctcaaacycctcaagtatttggcttcaactttatgycgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtcyctttggccttacyggctctgttttaggtaagtccacgtctgagtaccagtgactgcagctcttccagttgtgctgtcatgyttatatgttagaaatgatcatcaaaggactcaaaagttttgccactaattgtattaccggggactgtcacaaccaagatttctcttaatttattcaccttacttatctcctggaagggcatattgragtgctcttggagttctctaaaagggtttttgttggttgtgtatattcacttgggtgccagcgattgattccaaataagtaaatcttttttcccaaaaggatgtaagatggcttatggttataagtacaacaggctaacaaagtmcaagtagatgagaaagtaaaatgaagaaataaagtcataggagccmcagaattaacccaggaatgaataagtgtgtagtttggtgctgatgttatcatcctttatttgtacattgcttgtacagttgctytgagaaggtaagtcttaaattttcaaaagtgaaatgtcmccgagcatggtggctkatgcctctaatctcagcactttgggagrctgaggcaggcggatcacttgaggtcaggagtkcgaaaccagcctgacttatgtgatgaaaccctgtctctactaaaaaaaaaaaaaaaaaaaaaaaaaaaaaaatmcaaaagttagttgggcatggtggcaggtgcctgtaatcccasctacttgggaggctgaggcaggagaatcrcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagtagtgtgtgagaccctgtgtgtcactgccactcatcttggccttcggccactgctgtagcaaccagtttccaagtagggctggaccttgccttctgctccagagacctctcgcttcctgcccttgggcttctgacgagctgcaggaactgcctggcacgtgggtccccacaacccagaggaggtgagggccacctctctgctcctcagggccacctttcataaggctccttgaaggtccctcaagatcaagccaactcaacacatccttgataggccttcctgccttctgtttcacttctccactcgtttccaaataaatggctgcatgcaagcttttgcctcaggttctgcttttaggaggaaggctaagacaagcagtaaagcaacatgggcaggcagaaggatgacttctaatagaattatctcatcactatatatttyactttatggatgcttgtattgaaaagtcttggctgggtggagtggctcacgcctgtaatcccagccctttgggaggccgaggtgggtggatcacttgaggtctggagtttgagaccagcctgaccaacactggtaaaaccttgtctctattaaaaatgcaaaaattagccagggatgcacgcttgctgtgtgccagcacagggctaggctggagataaaaaggtgagtaagtaggtgcggtgtagtcagggtgaaaactacagatggtccatttccacgtaagtggaaaggtaaaggtatgtacaatagggtggctcctggctgaacctggagctgcagacaggttttctagaaggcataatcctgaagttsagacttgggggcctaggtaggagccagttgaagggacgtgggaggygcattccagagagaaggagtggtatgagactggaacagaggtgtgcagcagcatcgcatgggcgaaacaacagtagacagttgttcttttgtttttgtttgttttttgagacagsgtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattytgtagaaacagggttttactgtgttgtccaggctggtcttaaacgcctgagcttaagcagtctacrtgcctcagcctcctgaagtgctgggattccaaacatgagccactgtgcctggcccggcaactgttactagactrtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttggtgacagtgtagagcagacaggtagatttgggaatttaagcttagactcacgttggagactgagatagctcatctgagaggcactcagggcctaatctcaggcagtaattttagggatgtaggggaagagatggattctgcacatacttgggaggcttgtggaggagtggggagggaggcacagggaggactccagggtggttcatacggctccctgcttctgttcctgtccccctttgtcaagctgtggtctgtactgcgtgttccatcttgtttctaagctgcttttgcccagtctttccagcatttccctttcgtcatgttagtctgtgcctgtctacgtgaactatggtgacgtttattgggcctggcactgtgaggtgctggggatgtgaagatyattgtggctcagcygctgctctcgagggcctctgggtgcagtatgcacacctgtgcctcctgtttgctcaggaagacaggctttgagatgagctggggctgacatccccaccttatcattgggatggctttgggtaagttatgttcatgttctctgagcctccctttcctcattggtaaaatgggtataaaatacctgccagtggagggttgttgtaagtagccatggaaaatgtaaagcacatagcacttaycattttttcctgtgtctttaacagatttatcatagaatccccgactcagacccatcttctagcaaaacaaggcagatcatctccaccatccggacgcagaatcttcccaactgtcagctgatttcccgaagccactactcccccatctacctgtcgtttgtcatgcytttggctgccctgagctggcartacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggaccttwaggaaagtgaaatgcaggtgagaagaacctaaacatgaaaggaaagggtgcctcatcccagcaacctgtccttgtgggtgatgatcactgtgmtgcttgyggctcatggcagagcattcagtgccmcggtttaggtgaagtygctgcatatgtgactgtcatgagatcctacttagtatgatcctggytagaatgataattaaaagtatttaatttgaagcaccatttgaatgttcgtamtagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcstattctcatttaaaggagtttagctttcagagagaaacagcaggattgcttttgaccttttagaagattggtctccagtaaaggtggacatttttgagatttttataataaagaatttaattgctctgcatttgtcaagtacagttcgcttgaaagcctgcctgactgtggaaaagatggagctcaagaatggagttgatggcccagcgtggtggctcatgcctgtaatcccagcactttgggaggctgaggcggtcggatcacgacattaggggatcgagaccatcctggctaacacggtgaaaccccgtctctactaaaaaaaaaaaaaattagccaggcgtggtggcgggtgcctgtagttccagctactcgggaggctgaggcaggagaatggcttaaacccgggaggcggagcttgcagtgagctcagatcgcgccactgcactccagtctgggcaacagagcgagactccatctcaaaaaaaggaaaaaattgtaaaaaaaaaaaaaaaaaaatttcccccagcagtttttgttttctaaagttatcagtttatatattcaggtcttaagaaaggcaaaagctgtcttcaggtgattggcttgggggcagaacagtacttctgctcggggtttcaccttcctctctactccagtgcagcagagcttgtgatgtgctctcactgaggtgctcagtgcagcaaggaggcctgtggaccctcgagttgagaattggtgtaytagggcattyggtactttctagaagccattaatgctacaggtactcataaagtctactcttctgcagcccatcgtggatggtggcttaatcattgaatttgagttgtttcgagctgcarcgttggatttgcattgttgtaagcacactttcttgctgtgaccactgacaccaaaattagtttgggcccagggagacttcagttaattggttcatttgaggcttagccctggactcatttgtcaccagccaagataacttgccacatggaatacagccagaccaggggtccccgacccccaggcctaggaccggcactaaaccttctgttacgtggcctgttaggaaccgggcatcacagcaggaggtgagcggcgggtgagtgaacattatcacgtgagctccactcggcgttagattctcataggtgcgattgcgcgtgtgagggatctgggttgcatgctccttgtgagaatctagtccctgatgatctgaggtggcagtttcatcccaaaaccattttcctccctctgtccttgggaaaattgtctttatgaaaccggtccctggtgccaaaaagcttggggaccactgagctagactcgacagtattttccaaggaattaaagcctcaaaacttggtttgagatttcagggtaggttgttaaaaatctgtgtgttgaaatctaagatttaattctgccaaagttcacgttaagacagaacaacctgctggaaagagatttggtctgagtggggcctgyggaaatcttctttcctgacttggtcattacctgtgggaccacttcctgagctgtgtggtttgggtgatctcagattttttctatctataaagctatgtgcttttttctactcactgagttgtagaaaggtatycgctctcattccattctgaagctctttgaaagcttgttttccttctaagtatcttctctactaaggttgccagatataataggggatgctgggcatggyggctcacacctgtggtctcagctactcggagggtgttggggctgaggcaggaggatcccttgagctcaagaggttgaggcagaggttgtggtgagccaagatcacgccattgcactccagcctgggcgacagagtgagactctgtctcaaaaaacaaacaaacttgcataactgaaaattcagaagtagttggccatcttgtatttctgtttggtaactctggcaacactaccctctactccccacttctaatataattttatagcatctctggcatacagtctatttggatccgacctaatggtgcaatrttttgttttcctcagaggagcctctgacccatgtgaatctaggaccataaacaattagaatgcttgggagcaagagctttatatctgcatatgggaacttccggatccctgtgggcaagtgcagggagggccccttcttccatctactgagccatttcccaggggctcgggtgtgtataggaggaagagggcgagtcaggcatgttaacaaacattctaggttattcttggcagttttggaaacagttctaaggctgtggttctcagactttatatcagaattgcctgattgctgggaacagagactgatacagtaggtctgatggggtgcccaagaggttgcattcctaaattctcatgcagttttctaatcagggagcagctggaaaggtattgtgagcttgaatgtacctgggaaactacctggggtcttgggagatgcaaatgctggttcagaggtctggccctctgacactctgatgagcatttctaacaggctytcaggtgacggccgtgctcctggtctgtggaycacttcagtatggctgaagcacaataaaagagggcaaattactgctttctttaaaaagagtggcagccgggcacagtggctcacgcctataatcctagcactttgggaggccaaggcaggtggatcacktgaagtcaggagttcmagaccagcctggccaacatggtgaaactctatctctactaaaaatataaacattaggccaggtgtggtggcaggtgcctgtaatcccagctactcgggaggctgaggcaggagaatcccttgaacccaggaggcggaggctgcagtgagccaagatcatgccactgcactccagcctgggtgacagagagagactcccatctcaaaawttttttttttaaatgcagaggttggactgcctacctatactctaatttctattctggagtgattctctggagagkctaggtaaagactgaaaaggcaytgttacgtccacctgtcatctcacttggacaagaatccaggagaaactattgaactgaggtgacaaagttatgatcaatgtggtgatctgaggtgtattaaaacactgagctctttcccagtcacaaacactgcaaggcaggtgtttctaacaaagccttaagctgatgtcgacatgccccacaattccttgtcactcaccagcacatccccgctgsctccatgctagaagcaggcaaggagctgcaggtgcgtataygatggaggtgagggagacagtgcgcatggaatgaatcaactcagtttgggagcagggagaactttattgaggttatgaatatattctacttgaaactggaaggataagtggtyatgaatttgtggcttatggtaacctttgttaagcatctttctttttctttttttttttggtgagacacagattcactcttgtcccccaggctggagtgcaatggcgtgatctcggctcactgcatcctctgcctcccaggttcaagcgattctcgtacctcagcctcccgagtagctgggattacaggcatgtgccagcatgcttggctaattttgtatttttagtagagatggggtttcaccgtgttgccaaggctgatctcaaaactcctgacctcaggtgatctgcccgcctcagcctcccaaagtgctgggattacaggcttgagccactgygcccggccttttttttttttttttttttttaattattgagacggagccttgcgctgtcaccgaggctggagtgcactggcactgtctyggctcactgcaacctccgcctcccgggttcaagcgattctcctgcctcagcctcccaagtagctgggattacaggcatgtgccaccatgcccagctaatttttgtatttttagtagaggtgaggtttcagcatgttggccaggctggtcttgaactcctgaccttgtcatcctcccaccttggcctcccaaagtgctgggmttacaggcgygagccacsacggccggctgttatgctcatcatggcacttaagagatgcttaacaaacctttcctacaatgttcctcagattttcagagcttatttgatctagcatctggttcctaaattctgagtcacatcagaagccaaacttgaatgcttttggaaagagcyagcctcataccacttcagttgggaaggggagtactgaggtgtaccttggcaggacagtggaatgattgctggttcttctagtttgctctataccaagaactgctataacatgtttctaaaccagggctatgcaaagcactagagttcctgaccagcaatgcaaaccagtggcatacaaattcaaaatactgtatmcaggccctgactccagcccaaaccaaggctggagggcatccagggggatgtggttccccacggggtagcatcttggttatgtgagatcaccaagacaccaarcctgttttatgagctgaatcctcagcttgttgctggatttgtggctgataaaaartacaggcagggcccagtggctcacrcctgtaatcccaacactttgggaggctgaggcaggcagaccacctgaggccrggagtttgaaactagcctggccaacatggtgaaatcctgtatgtacttaaaaatacaaaaattacccaggcatattggtgagtgcctgtcatcccagctactcggaaggctgaagcaggagaatcgcttgaatctaggaggctgcaggttgcagtgagctgagaaggcgccactgcactccagccygggagacggaatctcactctgtcagtcacaacaacaacaaaaaaatagagcacagctatgttttgagttcttaagcaagggcaagyttaccaggcacttacagagaaggttgacgaggatgacagggaactaattgggggagggatgccatggttgaaaacatggctggggcagcgaraagttaagatgaagtcccaagagtcgcaagaacatgcagttccaggacrtgattctctgcagggacaaagagagacagcagctacaagtctataggcagtgacaaaggatctgagatcccatcagagtagacttcaagttggagaaamcttttattggcacaggcattccttgttaacttgacagggkgaagctgtaatttttcaaaaacagtaaaagctsgtttctcctaaactattytcctwgtggtagtagagatcagkgggtcagaaacaactcctgaccacttggtttccttttgagccgcgtcatwaggaggcaatctgtaaaactagcacaggtctcccgctgttccactggctcacccacatgattagcagagtgcacgaaaaaataaaacttctattaaagaatcatgctgagcacaasatcagagaggttgtgacattgcaaactcgatagatgcagggggcctgggagactggcrttctccaaagggctcccaacaccrtctctcctctgatttctgtgacaaatgtggaaagctacttgcttggaggtactgggggaactgatgggggaastttyatccygttaggaactccgctttccattcctgsgtctctgtcttgctccctggagatggatggatcacggagggggccacagtcagctggggcarcaggtactccctacggcactagtctacagggggaaggacgctctgtgctggcagcggtggctcacrtggcctgyctgcactgtaaccacaggctgggatgtagccaggacttggtctccttggaagacaggtctgatgtttggccaatccagtccttcagaccctgyctgaaacttgtatcttacgtgaacttaaaraataaaatgcatttctaccccsatctcgcccccaggactggcacgacaggcccacggcagattagatcttttcccagtactgatcggtgcgtggaattccagccaccacttctgattcgattccacagtgatcctgtcctctgagtattttaaagaagcctgggaataaaaagtaaggtgcttttaaagtgtgacaagggtcaaccaatatagtcagactcatccttaaaagaccttaagtcactcatccctggccactcctrctgtkggcccactagcacagtcctcaacaccacaaggcttctrragccgtggggcacacctccacgggcaagccccctgcccggtcacccttcccatcacaggatctggcgcgatgctgtgggaactgttgcaggcgttggctctgaagctgctcagagtctgcccycacagyaaaagggaactcctgactgcctggcacttaggaggagctsacagcctggccgtaggtccagggtttaaggctgtgcggtgggtagaacagagaaagccgagatggccacggggtgtggctcacaattcactgttcttggcaggaagggggcagccactcaccattgtcac

SEQ ID NO: 13403 - DNA, 12968 bp, Homo sapiens
tccatcatatagggctggtgtgtatctaaattcatgcttctatttcactgttactcaaaacagttttatattatgttgaacagtgaaattataatttaatttcatggggacggggcagtgctatagttcctggaaaaattagatttgtattatctttatttcacacctaccaccttagaaaaatcaactagttgtcattgaaaacatttaaaactttgagtcttcaaatacatttgatgttaatgctgtcattacttgcactttgattcactaataacatttctaggtagttaccagttttgtcatttttctggaaaatattttggagttgtaaattgtttctctttttcttctagagttacaaattgaatttttaaatccaagcacctttgttgtggtgtggagagaagtatcacaattttatgtttattttaccttctcaaccttctcttggggtactttgcaaatacctgagtctaaacagaagtaccaaatacatgctctatgaactctatccttagtaaatctattaaacctgaataacttaaaagatcatgtgtgttttgtaatagcaaaatttgattttaattttttatttggaattggtgtatttatcatggggacttccagtttttcttcactttkcaaatggatattggctatagttttatgttttaatgggaatgaatttcaagtcaattaataatcagaaaatttttagttttacttttttcttttacaatatggacttttgttgttatttggatagtagttcaataaatcttaagctcagataattaaacactattttgaatcttaacaagatactgagcatttttttgtatgggatgatatcagcctatgtacaatgaatttaataaacttaagtattatcagatattttgcacattttagatcaataaaatctgaattaactgttcaagatttttttatctgtatttggaaatataattttgtaaaatcaatgtcttacctttttattacaatagatcatgttttgtattcaataaagcaagaagcccttttatctgttgtttttcagggaagggaktaacatttaattctgtttgtttacatttgttttcattgttatccaatgctcattttatgttgctttataagtaagcttaggtataacagaataagtatctgtttatctaatctacatgtgactactttagtctctctcagtcacttaatattatgctgaaatttaccactgtggggatgaatgatcactatccaacaagcgtatttgaacatgtaaatgcttaagaaataagtataatatggatatagtttgggttaatagtattctcatagttttttccctctatgaaacataagtaatgattttagtgtatttcttatggaatacactcatttataaaggactttaagaaattgtggatgtgaataatatctttctctagtaaaaatttaaattgtaaaaaaaaaacccaaaacctttctgatattttcattgtgatttcactgaatctatagatttagttgggaagaactgacatcctgacaatattgagctttttgtcttacaagaaatgytcaagggagtcctgcatctggaagtgaaaagaggatcattaccatcatgacaacatgcaaaagtataaaatccactggcaaagcagatacacataagagaaaagaatcaaaccttattactayagaaaactaccaaaaccacaatcgtaaacaataagagaggaagagaggaataaaagatatacaaaacaactagcaaacaatgaataaaatgacagaagaaggttcttacctataataactttgaatgtaaacagattaaatcccccacttaaaatatatagactrgctgaatggattttttaaatgacccaactatgtgcttcccataagaaactcactttacctatcaaaaaacatatagactgaaagtgaagggatggaaaaagacattctacccaagtgggaaccaaaakcaaataggagtagctatgtttatatcagataaaaataaaacagacaagggataaattcagcaagagcatataacaatagtaaatatatatgcacccaaaactggagcacctagctacagaaaacaattattattagatctaaagggagagatagactcccatacaataatagttgyrgacttcaataacccaatctcaatactggacagatcatctagacaggaagtcaacaaagatacattgtatttaaatttcactttagaccaaatagacttaacagacattgacagaatagttcatgcaacagctgcagaatacacattttttttcattagcacatggaaaaatctcctggagagaccacacattgggctacaaagcaagtctcaacaagtttaaaagtactgaaatcacatcaagtatactttctgayggcaaggaaataaagctagaaatcartaacagaaataactttcaaaactgtacaaatacatcaaaattaacaacatgctcttgaacaaccaatggattaataaaaaattaggaagtacatttaaaatttcttgaatcacatgaaagtataaacacaatgtatcaaaagctatgggatacagcaaaagcagtattaagaaggaattttatagcaataaacacctacatcgaaaaaagtagaaatatttcaaataaacaatctaatgatgcacctcaaggaacaagaaaaacaaaagcaaaccaaactcaaaattagtaggaaaaatgaactaatgaagatcagagcaaaaataaatgaaattgaaagtaaaaataaaatacaaaagatcaataaaacaaagagttttgtttgtaaaaaaataaacaaaattaacaaatgtttagctaaacaaagtaagaaaaaagaaagactcmaataaatgaaatcagamatgaaaaaggagacatgacaattgataccacagaaatacaaagaatcattggagtctattacaatcaaccatgagtcaacaaattggaaagccwagtaaaaatgtataatttctcaggcayatacaacctatcaagattgaaccaaaaagaaatagagagtctaaacagactaattacaagtaatgaaatataaccagtaataaaaactctctcatcaaagaaaagcccaggacctgatggcttcaatgctgaattctaccaaacattaaaaaaaatacttaatacccattcttttcaaactgttccaaaaaatcaaagaaaagagagttcttcttaattcattctatgaaggcagcattacccttataccaaaaccagaatgggacacaagaagaaatgaaaacagcagaccaatatcgctgatgaatagaagtgcaataattctcaatgacatactaggaaatcaaatccaccagcacactacaaagataatttactatgatcaattgagatttatcccagggatgcaaggatgttttgacatattcaaataaaaaaaatgacatcacatcatatttattgaagagcaacagagtgaatagcaaaaaccatataatcatctcaataaatgcaggaaaagcatttgataaaattcaacatttcttcatgataaaaaacactaaacaaagtaggtatagaacaagcatacataacaaaataaatatatagaacaagtatacctaacaaaataaaggataggcatgaaaaatccacagccaccatcatacaaaatggggaaacactgaaagcttttcctctaagaactggaacaaaacaartatgcccaccttcaccacttttattcagcatagtgctggaagtcttggccagagaaatcaggcaagagaaagaaataaagggcaaggatgtcaaattttccctgtttgaagatgacataatatgtgcatagaaaaccctaaaagctccaccaaaactgtcttagaactggtaaacaaattcaataaagcagcaggattcaaaatcagcatacaaaaatcactagtgttcccatacacaaatgatgagctagcagaaaaagaaaaagaaagcaatgccatttacaataggtgcatatataatatttaggaataaatttaaccaagtagttgaaagttctctgcaagaaatgctataaaacactgatgaaagaaatggaaaaggtccctcaaaaatggaacatcttcccatgttcatggattggaagaaataatattgcaaaaatgactctactactaaaagcaatatagagatagaatgcaattcctatgagaataccaatgagattcttcataaaaatacaaaaaaattctaaaattcgtgtggtatcacagaagaccccaaatagccaaagctgtcctgagaaaaaagaacttagatggagatattacactgccaacttcaaattatactacaawgctatagcsaaaaccatatagtactggtataaaaagagatgcatagaccaatggaacagaacagagaacccagaaataaatccatgaatttagagccaactaatttttgacaaaagtgcaaagaccattcagttagaaaaaaacagtctcttcaataaatggtgctgaaaaaactggatcttcatatttagaagaagaaactagacccctctctttcatcctattcaaaaatcaaatcaagatagatgtattagttagggttctctagagggacagaattagtaggatagatgtatgaaycccacttctggtaccaaaatctgtattagtcagggttctctagagggacagaactaataggatagatgtatgaaccccactcctggtgccaaaatctgtattagtcagtggtctttagagcaacagactagtaggatagatgtacatataaaggggggtttattaaggaatattgactcacacaatctcaagktgaggtcccacagtaggctgtctgcaaggtgaggagcaaggaaactagtccaagtctcraagatgaggaatttggagtttgatgttcaagggcagaaagcaaccagcgagggagaaagatgtaggctgggacgataagccagtctagtctcttcacgtttttctgcctgctttttttctggctgcactggcagctgattagattgtgcccacccagattgagggtgggtctgcctttcccagtccactgactcaaatgttaatctcctttgacaacaccctcacagacacacccaggaaaaatactttgcatccttcaatccaatcaagttgacactcaatattaacaatcacaatagattacagacttaaatgcaagacacgacactttgaaccagtagaagaaaacatctgggagacacctcaggacattggtctgggcaaggattttttttttggtaagacctcaaaagcacaggcaacaaaagcaaatagacaaacggggtcatacgaaaccaaaaagcttcygcacagcaaagaaacaaatcaacaaagtgaagagacaacctacagaatgagaaaaaatatttgcaaatyatccatctgacaagggattagtaattagaatacataaggaacttaaacaactgaatagcaaaaaaaaaaaccacctcaaaataatccttttaaaaaataggcaaactatctgaatagacatttctcaaaagaggagatacaaatggcaaacacatacattaaaaaatggtcaacatcactaatcatctrggaaatgcaagtcaaaaccatgataagatgtcatctcacccctgttaacatatgtaattatttttatacattgttggatttgatttgatattttcttgaggattttgcrtctaggtttgtgagcaatattaatctgtatagtttttttgtttctttcttcttttcttctttctcttttcatttcttgtcatgtctgtctgtatttgscattargtataatgctggcctcataaaatgaattargcaatatttcctctgcttctgtctttcaaaagacatggaagaaaattggtataattccttccttaaatgtttagtagatgcaacggcctacagcattatgctgccctgggccgcgacagcgtgggcgccgcctcrgtcaacctggarccctcggatgtgccgcaggacgtgtacagcrgcgtggccgcgcaggtggaggtgttccgtaggcaggacgcccagcggggcatgcgggtggcacaggtgctggaagscttcatcacccgcaaggtggtgaagcagacrgtgatgaccgtggtgtacggggtcaccygctacggtgggcgcctgcagattgagaagcgcctccgggagctgaacgactttccccaggagttcgtgtgggaggcctcccactacctcktacgccaggtcttcaggagtctacaggagatgttctcggggacccgggccatccagcactggctgaycgagagcgcccacctcgtctcccacacgggctctgtggtggagtgggtcacccccctgggcgtccccatcatccagccgtatcgcctggagtccaaggtcaagcaatcaggaggtggaattcagagcatcacttacacccacaacagagacatcagccggaagcccaacacacctaagcagaagaacggcttccggcccaacttcatccactcgctggactcctcacacatgatgctcaccaccctgcactgctacaggaagggcctgaccttcgtctctgtgcacgactgttaccggacccatgcagctgatgtctccrtcatgaaccaggtgtgccgggagcagtttgcttgcacagcgagtccatcctgcaggacctgtccaggttcctggtcaggcggttytgctctgagccccagaagatcttggaggccagccagatgaaggagacactgcaggtggtgcccaagccaggggccttcgacctggagctggtgaagcgttccacctacttcttcagctgacacccggcgggccttgtgccagtgtgtaaataaagctcttttgccaccccctcaaaaaaaaaaaaagtctagtagaattaatcagtgaaccaattggggtcttggctttctgttttggaaggttattaattattgtttcaatcgatttaatagatataggcctattcggattatctattagcacttaccttttattcttttctttccccttctcgtatcttttggatggatggaaggtaaatgatggtatatacatgtgattcaaaattatgtagctggtaaaaattataacattgatagagaaatataggacccatatgcattatttaaatacctatataataatcataaaacatgtttatgccataagtgcaagrattgaaggacaatatgaaaagtgtagttaggtgaatcttacaaattatttaaagagactgtttaaggttagtcaagcagagtgacatacagaaaagaagactactattaaatcattggcaatatccctctgtattaggccactcytgtgttgctataaagaaatacctggctgggtatggtggctcatgcctgtaatcccagcattttaggatgccaaggtgggagaattgcttgaggcttggagtttaagmccaaaaaaaaaaaaaaaaaaaaaaggaaatacctgagactgggtaatttgtaaacaaaagaggtttaactggatcacggttctgcaggctgtacaggaagcatagtggcatctggttctggggaggcctcagggagcttttactcgtgttagaaggcaaagtgggagcgggcacatcacttggcaaaagcaggagcaagagagagagggtcaggtgctacacagttttaaataaccatatcttgcaagaactcactaacacgaagaccacatcaagccatgagggatccgcccccatgatccaaacacctcccaccaggcgccacatccagcattggggattacaattcaacatgagatttgggaagggacacagacagacccaaaccatatcaacccctaatgccagcagaaccactgagtagctttaggatcttcagaaaggattttaaagctcgaatagtcccagcactgtaataattacaagagaaaatgtaactacaatgtagcatctacacaataattgtgattctcttctccgttcttgttcaatccaatgtttaatataaaaattcaagtgaaggtaaataaaagcattggggaatgaccttgccatgtggtattaagaagaagattctcaagcacaactgcctaagttgcaattaccacagctacatctagaaggaagatgtgagagttttcattccacattaactagaaacctagcatgaggcagatggctgsaagcagtcgagggagtgtccaagaccttacacagaaaatcatgttcagagaggaagcttgttgctcattccttttttgtgcccagctgcctgggttcccttctccaccattttatttggtagtaagctatctagagaacttgctccctacgctgagccaataagcgaaatgtgtgagctttgaaggatacagtttcatttcgaggaatggagaatatctgtgcaaagttggggcagttcagagcagagtgagctgcagactgttctgcaggtatggggctggaagtcttcacacgacctcatagtcctggcacccaaacttactcagacaatggtgtgtccggaattggtgggttcttggtctcactgacttcaagaatgaagccgcggaccctcgcggtgagtgttacagctcttaaggtggcgcgtctggagtttgttctttctgatgttcagatgtgttcggagtttcttccttctggtgggttcgtggtctcgctggctcaggagtgaagctgcagactttcgcrgtgagtgttacagctcataaaagcagtgtgaacctaaagagtgagcagcagcaagatttattgcaaagagtgaaagaacaaagcttccacartgtggaagggggcctgagcgggttgccactgctggctcgggcagcctgcttttattctcttatctggcyctacctatgtcctgctgattggtagagccaagtggtctgttttgacagggcgctgattggtgcgttyacaatccttgagctagacacaaaggttctccacgtccccaccagactcagaagcmcagctggcttcacccagtggatcccgcaccggggctgcaggtggagctgcctgccagtcccgcgccgtgcgctcgcactcctcagcccttgggtggtcgatgggactgggcgccctggagcagggggcggcgctcatyggggaggctcgggctgcacaggaacctacggaggccgggggctcaggcatggcgggctgcaggtcctgggccctgccccgcgggaaggcagctaaggcccggcgagaaatcgagcgcagcgccggtgggctggcactgctgggggaccgagtacaccttcccgagcagccgctggcccgggtgctaagcccctcattgcccggggctggcagggccggccggctgctccgagtgcggggcctgccaagcctacgcccacctggaactctagctggcccgcaagtgccgcgcgcagccccggttcgtactcgcgcctctccctccatacctccctgcaagctgagggagccggctctggccttggccagcctagaaaggggctcctacacctataagtgagaatatgcggtgtttggttttttgttcttgcgatagtttactgagaatgatgatttccaatttcatccatgtccctacacaatgagaacatatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacattgtgcgcatgtaccctaaaacttaaagtataataataataataaaaaaatccaaaaaaaaagaaaagaagagaaaagaaaggggctcccacagtgcagcggtgggctgaagggctcctcaagtgccgccaaagtgggagcccaggcagaggaggcgccgagagcgagtgagggctgtgaggactgccagcatgctgtcacctytcagtgggagcaggtgtgacaagagttgggcaaatcagacctttaatccaccctgataggctggagtgtgggcttatggcatttytcctttgacccaattaacctccactcccaatgtatctctgtgcagaaggctcagctaggtgtatcagccattgtaaatcctcaacataaattataatttaacctagaatacagagactaggtagcaggaggagaggaaatgtagagatactaatctcttctcccttatcagaaagaaacctagcataagaaatttcacgcttaatgggccaaagagtaaatcagaaaactccatgggtgatggtatgctcatggtggtggtggtggtgwtggggaattatttgccctcctgtgacctcccttggattaatttctccccaggacaatgggaaaaatcatttaatccttggagtttttttttttttttttttgcttgagagtgactctgatcctgtttctgatggtcatgttcctcagcatcatactgagtaagtcactggccttgtagcatctggagtgattggagtgayccaagatccctagttcccatgtcacaaatgaggatcccacatatctgggacagagatggaacattatttctgggtgtgtctatctaatctattcaycctatctatctaatttctcatctatatatatatttgcctacccatccatccatcaatccatcttagctgtacgtttatccattccatctatttatcctattatctatgtatctatctatcatctattaatagctatctatccatctgtctaatatatmyattatmtatatctactttatctatctacctaatgtatccatcctatctactctatctatctgtgcatctacccatccatctggaccctgagctgattcctctgcacccagctggcctgacgccaggtgttgattggctgcccaggctcmggagacacatccaggctgcagggattggttggcccagcccaacccagccagccctcccacagcctttgctatatcaagggccagggtcaaaggcctcccagcagacagagagaggaggttrtytgggacagactgctcctgacagaaggtgccaggctgggkgtggcaggcctggggggggtcctggcctgggatggagaggggcactgcccaaggcccacgcagctcctgggtgctgscctggaggatgggtggtttccgagtaactgaaaccaagcccctggcaacctcacagtgattcaggctgggcctttctggactttaatcagtctctctctctytttcccattctaagtgcttactagggaactggaggccacttggctgctggwtttggttgggcctttctggactttacctctcagcccctttttacccatccctgagccctccctgctctacctccggcacygcccgtccctgccyctccactgtccctggaggtccctgggccsttctytgggcctcaggatctcaccrtccatcccgyctgccctgcaggatgtcccagctgagcctgtmctggctgggcctckgscsagtggcagcatccccttggctgctcctcctgctggtcggggcctcctggctcctggcccatgtcctggcctggacctacgccttctatgacaactgccgccgccttcggtgtttcccacaacccccragacggaactggttttggggacaccagggcatggtgagtgtggcagcaggatgggtctaggtctcaggatggatggacttcctgaggggtacgaggcttagggagtgggggtgaaggggtgggctgggatctggggtggcagagaagcagaggaggcrtcttactcattcctctgcttattcatttctgtgaggtgcctacgcaagcccttctcacttcctwgtcctcccactccaggcctgcattgaatccttttcctgcctgtcttcccacattaatgcacctctgcggggctcctgggcagagggttggctgcacagagaggcgagtccctggcattcccacattctccrttgctggactcgaggcttcttatgcccactgtccagggtcctctccttgcctggactatttcctgttatgagggtacagctrggccagaggagaggcmtgggccgtctcccacttccacyacacccgaaggcayctttctcttatattcttcttcttatctccctcttatcaatgagacctgttgccaaacccagataaaagttggccactcacttcacctttcagaagctttccttggcckttmtcctccccgtgaccttgccctctgacttagaccgctctcctctttggggaatgtggtcttagtctgctcatttgcaaatggcaggattgatggatgtgtccacagataaagtggaagggtgcacaggacacactagcacagagcctgctgcagaagctgctcccaggtgggagccattgtcctgatggacagttagagtcacctctgctccactagtggctgctgaaaagggaaggtctcccatgtgcagaaccttctccatgggaggaactggagcctctgtggatcagccaggacatgaaggcatgtggggaccagccttagggacatgtcctgaggcgatactgctccccacaaatctcccctgtgaggacctccccatatagctgcctctgggctgaaatgactcccagaaaaagaaaatccttcctctcaagataactgggcctctgtgagtggacagtgcgtcttctccctctgccctgggatgcacccttgggacttggagatggacccaagagagatagagcaggaggaatgtggatagatagatagatagagcaggaggaatgtagatagatagatagatagat

SEQ ID NO: 13404 - DNA, 18475 bp, Homo sapiens
ctcccagacctctggatccccagagcccaggaccctcagtccccaggatccccagaccccaggatcctcaggccccaggactcccaaaccccaagactcccagacctctggatccccataccccagaacccacagacctcagaaccctcacatcctaagacctgcatgaaggggtggcctgcccctccacacctgtgggatatctcatcaggtggaatgagagactgagaaaagaaataagacacagagacagagtatagagaaagaacagtgggcccaggggaccggcgctcagcataccaaggacctgcactggcaccagtctctgagttccctcagtatttattgattactattttcactatctcagcaagaggaatgcatcaagagagcagggtgatagtggggaggaggtcagcaagaaaacatgtgagcaaaggaatccgtgtcacaagttcaagagcaggtactgtgcctggatgtgcacgtaggccagatttatacttctctccacccaaacatctcagccgagtaaagagtaacagagcagcattgctgccaatacgtctcgcctcccgccatagggcggtttttctcctatctcagaattgaacaaatgtacaatcgggttttataccgagacattcagttcccaggggcargcaggagacagaggccttcctcttagctcaactgcaagaggccttcctcttttactaatcctcctcagcacagayccttcacgggtgtcgggctggggggacgatcagatctttcccatcccacgaggccatgtttcagactatcccayggggagaaatcttggacagtacctgactttccagrgcagaggtccctgcggctttctgcagtgcattgtgcccctggttactcgagaatggagaatggcgatgacttttaccaagcacactgcctgcaaacattttattagcaaagcacatcctgcacagccctagatcccttaaaccttgattccatacaacacatatttctgtgarctcraggttggggctaaagttacagattaacagcatctcagggcaaagcaattgttcagggtatgggtcaaaatgaagttttttatgtcttccttttctacatagacacagtaacagtctgatcgctttttcttttccctacatcccagaccccaggactaccaaactccagggcccccagactgcaggacccccagatcccaagactcccagacctctggatccccagacttcagaaccaccagacccctggacccccagaccccaagactctcagacatctggatccccagacccctatacccccccaccaaacccccatatcccaagacccctagatcccaggacccccaaacctccggatcctcagactttaggacccccagacctcaggacccttagattccaggactctcagacccctggatccccagacctcagagtccccaaatctcaggaccccacagacctcagactccaaggcccccrgctcccccagacccacctccaaaactcactatcccagaccccaggcctgcctgtcccccaccacctgcagcctcgggtctggcacttcctcatttctttatttchaagaggcctcagaactgggcgtggaggacgtgcagctgcatgaggctcactgctggctgggctcctccatccctctgctccttataaaagaggccccaagagctcccctgctccctctgctgtctactgaggacacagtgagaagacggtcatctgcaaactaggaagtgaatctgctggtgccttgatcttggacttcccagcttccggaactgttgttcataagctaccccagtttacggyatatttgttatagcagcctgaacaaacatttggagacatctgctctctacccagggctgctcccaccacagggcctttgcacatgctgttcccactcctggatgctgttccccacatcccttcctccttactccctaaggggttccttgatcatcccattgaaaagttgcttctgcggccaggctcagtggctcacgcctgtaatcccaacactctgggaggctgaggagggtggatcacctgaggtcaggaattcgggaccagcctggccaacatggtgaaaccccgtctctactaaaaatacaaaaagttaactgggcatggtcccatgcgcctgtaatcccagctacttgggaggctgaggcaggagaatcgcttgaacccgggaggtggaggttgcagtgagccgagatcgcaycactgcactccagcctgggcaacaagagcaaaactccgtttcaaataaataaataaataaataaataaataaataaataaataaaagtttcccatctcatttcctgcccttatttttctttgcagcattcccaccacctgcacttgatatattttcccgatggattctgcctgttgtctgtttccccaactacagtgagaggtggggggagggggggctgggatttttgtctgttttattcactgctgtgtctgtggttcatagtacctggtatacaacaggaacttcataaaggcttacagaggaaatgaatgagtctttccttataggttcatagagatttataatttcattttcagaactttgtggcatgctaggatggatgaactgaactgttactaatgtaaccaatcctttaagttatttcctttttttttttttccttcttcttgaggcagaggatcactctgcactctgtcaccccaggctggagtgcagtggcacgatttcagctcacttcaacctctgccttccagactcaagcgatcctcctgccttaggttcccgagtagctggaactgtaaggatgtgccaccactcccagctaatttttgtgtgtgtgtatatctatctatatatatatataaaaatttttttttttggtagacatggggtttcaccatattgcccaggctagtcttgaactcctgggctcaagcgatcctcctatcttgacctcccaaagtgctgggattacaggcatgactcactgtgccyggcccattttattttttttcatgtaacaaacaatgctgcaatgaatcactttgagcctggagcatctttttgccttctctctctctctcttttttttttttatatgaagtctcgctctgtcaccaggctggagtgctgtggcgcgatctrggcttrctgcaacctccaactccctggttcaagtgattttcctgcctcagcctcccgagtagctgggattacaggtacatgccaccacgcccagctaattttttgtatttttggtagagacagggtttcacagcgttggccaggattgtctcagtctcctgaccttgtgatccgcccacctcagcctcccaaagtgctgggattacaggtgtgagccaccacgcctgactttgccttctcaaaaaaacaaacctgcaacatacacacaacataaaattgaacattttagccaatttatttatttrttattattattttgagatggagttttgctcttgttgcccaggctggagtgcagtgccgtgatctcggctcaactgcaaactctacctcccaggctcaagtgattctcctgcctcagcctcccaagtagctgggattacaggcatgcgccaccacaccyggctaattttgtgtatttagtagagatggagtttctccacgttggtcaggctagtctcaaactctggacctcaggtgatccgcccacctcagcctcccaaagtgctgggattacaggcatgagccaccgcggccggcccagccatttattttaaattattttttagagatagggtcttgctctgctgcataggctggagtggagtggcacaatcacggctcactgcagtcacaaccttctgggctcaagggatcctcccacctcagcctctgaagtagctgggactacaggctgaagccaccatgcccagctaatttttaaattattattattattattattattattattattgagatggagtctcgctctaacgcccaaactggagtgcagtggcatgatctcagctcactgcaacctctgcctcctgggttcaagcgattctcctgcctcagcctccctagtagctgggattacaggcacgtgccaccatgcccagctaatttttgtatttttagtggagacggggtttcaccatgttggccaggctggtctggtactcctgacctcgtgatccgcccaccttggtcccccaaagtgctgggattacaggcatgagccaccacgtccaggctgagccacatttttttattcgttagtcagttcacactgtaaacatgcaaatattcaggcagggattcccagaagtggacttgctgtgtcagcaggcacatgagtttatcattccggtggcctgtgccagggtgccctccaccagtgctacaccatggacgcaccccacagcctggctggcacagaatgtcattgcattgttggatttttgccaatttgattggtgaagacaaacagtttgtgatttgcagttttcttattaagtgtgaacttttttttktttttgagacaggtctcactctgttgcccaggctggaatgcagtggagtgatcttggctcactgcagcctccacctcctgggttcaaacaattctcctgcctcagcctcctgagtagctgggactacaggcacataccaccacacctggctaatttttgtattttttaaagtagagacggggtttcaccatgatggccaggctggtctcgaactcctgggctcaagcgatctgctcacttcagcctcccaaagtgttgggattacaggtgtaagccactgcacctggcaagaatgagcatctctggacatgttgaaaagcagtttccygctttttcttcaaggtctccgttcaaagcctttgaccatttcttggagtttggcgatgtgaaggacagaggccgaaaagaggggaaaacgtgggggagtggactcccagcctcccagatcccggagaagcctctgtgcatttgacagctgtggacatggtgtcacacgcagttaaggtggcacagtgagtcgggctggcataggttgtacctggtccacctgacaccaggttcaggtgaggccttctcccagcccacccctcctcagtatcatttttgtcactactacccctccagtctgcctcaggcccccatctgcttctgggacctcagcctcctccccaagttgcccaccccagacaccaggctcactccagagggacttcttgagccagtgcccctctgcccacgcacctgccttggctccacatggacctcttcccccaccaccaattccttctatcctctccactcctaaccatgctatcccagccagctacattttcccaagctgctgggagccctcctcactgtcccctccagcatagaggtgccactgtgcaagaactcagtgggagaggcttggaggagcttggagagccaatgataggtttggggaatcttagtgaactcctactyatgcgttgaagccccaactgtaatgcctcctcctccaggaagccttccaggaccctgtctttccctctggaccttccttaactgcatgggactaggagtgtctatgtccagctctgtcctctcttaagatagctccttgaggacctggtcagggctgaggcctcttggggscccagcgtgggtgatgcttgttgaatgaataaatgactgcatgagctgggaaccagccaagctgagatcaagaagcgagttgatgaggtggcagtcggttggggtgctaatagaggacatgaagtcactgggttctagcaagagggaagcgggactctggtccacccctccctcttgccctccatccacctctggtgagaaccttgaggccctgcaagggggcggatctctgtyttcattcttcccctctgcactccacccagacaccagttcctcttccccctgagtcgctgggtgcagagccagaggaacgccagcgaccccagcagcgctgcggacggtgctggccgtggccgctgcggcccccgtgtccaggtgggccaggacgcagcctctgggcgccgtcgcttttccagcatcgcagaggcaaaagcgtggcagtgggacccaaaaggtaggactgaggctctagaacttgcacctgtgcagggactgcaaaccagacctgggaggaccctttcagcagcccccactccaccctatcccaggacttcccagcgacccgccgttctgggagataccgggagcgtgatcagggggcggggccgtttccaaggcaaccgcttatttgcatagggtcccgtcctggccaacgagggcgccccaaatgttcaggacatagaagaaggggttaactggcccggatctcctcctcgccttccaagcccgctaagcactggggttatctacccattccccagaaggggagactgaggcagcccaccagccaaaggaggcgaccagactggggctgcgttttaccatttcagaagcggcttgagctggtctgagctataataataaacactggcggtggaggcgagggcgaccacagggctgaggtcagggctaggattccggtgtctctacgtaggttgcttgaatggggggcaccctggcatggacgctgctgttgccgctgctgctgcgggagtcagacagcctagaaccgtcgtgcaccgtgtcctccgcggatgtggactggaacgcrgagttcagtgccacgtgcctgaatttcagtggcctcagcctgagcctgcctcacaaccagtctctgcgggccagcaacgtgattctccttgacctgtctgggaacggcctgcgagagcttccagtgaccttctttgcccacctgcagaagcttgaggtcctgaacgtgctacgcaaccccttgtctcgtgtggatggggcgctggccgcccgctgtgaccttgacctgcaggccgactgcaactgtgccctggagtcctggcacgacatccgccgagacaactgctctggccagaagcctctgctctgctgggacacaaccagctcccagcacaacctctctgccttcctggaggtcagctgcgcccctggcctggcctctgcaactatcggggcagtggtggtcagcgggtgcctgcttcttggacttgccatcgctggccctgtgctggcctggagactctggcgatgccgagtggccagaagccsggagctgaacaaaccctgggctgctcaggatgggcccaagcccggtttaggcttgcagccacggtacggcagccggagcgcccccaagccccaagtggccgtgmcatcctgcccctccactcccgactatgagaacatgtttgtgggccagccagcagccgagcaccagtgggatgaacaagggtaagtaagccactgagacacctgccaaagtggtgaataataaggctccacacccagatggccgaggttcaaatcccagctctgccgcttgaaggctgtgggatcttaggtgagtagctttacttctctgagcctcagtctcctcacctataaaatggggagaggactggacatggtggctcacacctgtaatcctagcactttgggaggccaaggcaggcggatcacttgaagtcaggagtttgagaccagcctgrccaacayggtgaaacscagtctstactaaaaatacaaaaattagccaggtgtggtggcgggcrcctgtggttccagctactgaggaggctgaggcargagaatckcttgaacctgggagtcagaggttgcagtgagccaagttcatgccattgcactccagcctgggtgacagagtgagactccatctcaaaaataaaatcaataaaataaagtaaaatgagggagaattacagcccccatcatagtgtgttggggtaagaattaagtgagttcccatatatgggacaaacttcccccccttatgacctgtaaacccagtttctggcggccaaggatggggagacaggaggcaactgcttgagcggagttggggctccgcggtggcggtcagcagcataggcccaggtcccatgtgacccaaggctgtctctgaacctccatttctgtctccatagagtggggacagccccccatttccccatgacacacatgagatactaaagaggtgccctacaaagtcccatcaccactagatgatttttttttttttttttttgagatggagtctggccctgtcatccaggctagagtgtagtgacacgatctcggctcactgccagctccgcctcccgggttcatgccattctcctgcctcagcctcccgagtagctgggactacaggcgcccgccaccacgccaggctaattttttgtatttttagtagagacggggtttcaccgtgttagccaggatggtctcgatctcctgacctcgtgatccgcccacctcagcctccttaagtgctgggattacaggtgtgagccaccgcgcccagccgacatttttttttgagacagtgtcattctgtcgccctggctggagtgcagtggcaccatcacagatcactgcagcctcaagctcctggcctcaagtgatcctcctgcctcagtctccagagtagttgggaccacaggcacatgccgccgcacccaactaatttttgtatttttcatagagacgggggtcttgctatatttctcaggctggtctcaaactcttggcctcaagtgatcctcatgtcttagcctcccaaagtgctggcattatgggtgtgagccaccgccaccggcttctggatgattttgctgggcttagacaaatgagttgaacttttctaggttggtgtggggtgcggtggctcatgcctataatcccagcacttttygaggccaaggcgaggtcagatcacctgtggtcaggacctcaagaccagcctgaccaacatggtggaaccctgtttctactaaaaaatacaaaaattaggccgggcacggtggctcatgcctgtaatcccaacactttgggaggccaaggcaggaggatcmcgaggtcaggagttcgagaccagcctggccaatatggtgaaaccctgtctctactaaaaatacaaaaattagccgggcatggtcgtgggtgcctgtaatcccagctacttgggaggctgaggcaagaagaatcacttgaacccaggaggtggaggttgcagtgagcccagatcgcaccactgcaccccagcctgggcgacagagcgagactccgtctcaaaaaaaaaaaaaaagaaagaaagaaagaaaaaaagaaaagaaaagcttttctaggttggaaaagggaatggagggaatttcaaggggtgggaccctcaggggcagagacccagaggtgggaaagaacagagaatttgctgtgaatggtttttgagaagggatgacttgaaagctgaggcctgaggggaacagggagggccaagcaggaaggggccgcggccatggctgtgtttgggcagcagagtccgtgccaggaggtggggaggctatcggaaggctgttggtgagaaaggagaaaatatgcaaagcagatgtcaacatggctcaaaagcagaaatggtctgaggcagggtgttgaagacactggactcgcaaaagcagcttgtgctctgatgttcatcttggcctccctgtccccgaggcttccggatcagcctcctttatgtactggcctccagaaacactgtgtttagaattgactgtgtcatttccaccctgcatcttacagttacagacatggaggctctgggaggcagggaaatgacttgtccaaggtcacatagccagtcaaaaaaggcaggacacaaaccctgcgtcccagacctgttcgtccccctacaaccacttaggggttggtgggcaattcgtactagagtataattgactgatagatgctgttaacacaaagtagcccttttgcctttttttttttcccgctctgtcgcccaggctagagtgcaatggcatgatctcggctcactgcaaccttcacctcccgggttcaagtgattctcctgcctcctgcctcagcctcccgagtagctgggattacaggcgcccaccatcacacccggctaattttagtagagacggggttttgccatgttggccaggctggtcttgaactcctgacctcaggtgatctgcccaccttggcctctcaaagtgctgggattataggcgtgagccaccgcacctggcccagtggccctttttacaagaggagctgggttggaattagaatgttcaggaggcaggaaaattctctggaggtcttgctgaccataacaaatattcctaagtagctacctgctccttgaccaattctatagatgcagaaactgaggctcagagacttgcttttatatatgagggccacaaagtcagttgcttcagtggtgaaaacatttcccatcggaaggagcacagagtgtgggtgcagccacttgtgtgcatgtgactgacgtggccagagcttccgatttttcaagaggaaacaaaaatttagattttaatgtaataatgaacagctacctcaatttctgttttttttgagacggggtctccctctgtcatccaggctgcagtgcagtggtgtgataacggctcactgtaggctcgacctcctgggctcaagcggtcctcccacctcagcctcccgaggagatgggactccaggcacacgtcaccacgcctgaataattttttaattttttgtagagatggggtctcaccctgttgctcaggatggtctcaaactcctggcctcaagcagaccttctgccttggcctcccaaagtgctgggattacaggcatgagtcaccgcgcctggccgctatctcatttttaaggaaggaaaaagggttcagggtcctcagaccgcagcgttacacccacagaaccttccctaaatcactgccctcccgcagcctcctcagagagaggtggggttggctaggagtcagaacgctagcccgtgccagtttccccatatgtaaataytcggggtggactgagccactctgaagctttctttttttttttccttctgagatagagtcttgctctgtctcccaggctgaagtgcaatggcacgatctcggctcactacaacctctacctcctgggttcaagtgattctcctgcctcagactcccgagtagctgggactacaggcctgtgccaccatgcctggataatttttgtatttttagtagagacgaggtttcatcatgttgtccaggctggtcttgaactcmtgatctcaggtgatccacccacctcagcctcccaaagtgctggattacaggcgtgagtcagagcacctggcccrctctggactttctcaaagctcatgtgcctgtcccctgagtcctccccstcccacacttacccctggtctgtctgtccccccagggctcacccttcagaggacaatgacttttacatcaactacaaggacatcgacctggcttcccagcctgtctactrtaacctgcagtcactgggccaggccycaatggatgaagaggagtacgtgatccccgggcactgagcctaagatgtcctaacctccacccagaaccccttcagtccctgctgggtgactcagggcgtcctaackcctccatggcctcagtttccccatctgaagaatgggkacaggaaaggattgtccttgaggccccaggaagctctgccgccccctccctgtccctcatgccgctcctcagctccctcagctcctagagggggaagaggagagacccccaacaaggggacaggasggtcactgtgccaatcctgtcatcaccctcctgtggatgtacaggcagtgctcaataaatgcttcgaggctgatgaggctgctggctcagggtgcgtgggttcctcaaggtggggatttctgagttctaagaccaagtctccatctgagactcccaaattgctccccacctcccatccctgtttttttttgttgttgttgtttgtttgtttgtttttgaaactgagtstcactctgtcacccaggctggagtgcaatgctgcggtctcagctcactgcaacctccgcctcctgggttcaagtgattctcctgcctcagcctcctgagtagctgggattacagcacccgccaccatgccgagctaatttttgtatttataatagagatggggtttcgccatgttggccaggctggtctcgaactcctgacctcaagcgatctgcccrcctcggcctcctgaagtgctgggattacaggcgtggccacygcrcccaggcacattcctcccttctgcccctctcagggccccttcccaggtccctgatctccaggcttggcctccagagcagcccacaccamccccaaaataaaaaaatgtatatattcctttagctctaatattctgagaaaatctttcaagaccctggtgcaatgccacctcctttgagaagctgtccctggtttcttctcaggcagagttaatgactcacagatgtctgtatttcaagagttttktcaggctcatgcctcaactgggtttcctatcagctggtcccagcccaatcctccaacctgggggagatagaactagagacaagtaccctcagtcctgggagatcaagcctgggccaaagggaagaatgggagcacagtccccacatggagacaattgaatgagtttgaataaggctgcatgtaagaggggaatctgcagtgggttttgaaggatgcataggagtttgagaattggagaggaaagggcatgctggctgggtggaccaacttgtgcaagagcctggagaagcacagagaaggcacaggcccagccctataccttgcaaaggcaacagctgttgtttggggaaagactcagtgacaccatctgctgccttttggtattgagtttaattttgaagcctcctaggtgcccattttcaacagctttgctgtgactgaagtgagcctgctcccatmtcagggcctttgcacttgctgtttgcatttacttgcaatgtccaccctcaactaccccctccccgactccttttcttcctccaggtctcagctcaaatgtgacctccctccccagggaggcctccccatccaactatctagatcacctctgcctccgttcactaatgaactgatgggttgaatccccagcacaaatcttactgcaatcaactactttcttaggatttactcatttgtccccttcactcaaccaggctccgcaaagkggggtggtccttgtgtgtctttttacagctgtgtccggggcctggcataaagtgggcactcactgaatayrttaaggggaacctgcagtcattcaggttggcctgtgggtgatggcattcccagcagatacacctcactgctggaagtgggtactctgtccctcaagacacccatcgccattcctctcagagattcaggatgggcaggcagtttggtgtggagagggggctggactcagcacacctcaaaattccaacatcctaaacaggaagtatatataacctgggagatgtggtgtgcatgaaaatattcttcacaacttatttgtttctccctactctttatatgtgaaagaatgaggtgtcactaacatggaagtgccacaaacaggaggggtgatgggactaacccctcaggttggggacagtaccacaaaacaaggcacttggttgcagatagacttggctctgagctgcctgtgtttggaaaggtgactcccaagtggggagagcaacaggatggtgatagagacaaagacagagacagatcctctgcctcagaccccaaagagagaagttttgaggaatgaggaaagatggagggaagctgagacttaaaaaggtatggggtctcagctgtttccaaaacagaaacaccagcctgggcaacatggcgaaactcagcctctacaaaaaatacaaaagttagttgggcatgatggcatgcacttgtagtcccagctactcaggtggctgaggtgggaggatcgattgagcccgggtggttgaggctgcagtgagctgtgattgtgccactgcacttcggcctgggcaacagagtgagaccccgtctaaaaaaaataaaaagaaaaaagaaacagcaataaggagatagagaaatagagacagagagtcagggagtcaggaatggccaaggctgcccttagagcccacaggtgtcgtaagcaccttccaatggcttggcatctccgagaacaccttgccactcattccttgagcctttccacttaccccctcccaggtctcctagagaaactgaggtcagggagaggaggatcttctcaaggtcaccttcccttatcctggacaccacagggaacagttcagacagctttatttttatcaccagagttttaaataaatacacagttccatcagaccagcccccgagtccccaagaaggtcaccccaataaattaataataaataacagacttatataaatrcagctgtttgggcaggaatcgggtgtctcaggaaccttgagcscattccacagggcaggacaactgaggtcgcstccyccgcgcaggtgcacagtggaaggaccaggactgctcatatgcagtggcagtctttggctaacaagtcatcataggtctggagcgacaccccggtgtcggtcttttgaatgagcaccatgggattgtagctggcgggcacgcagcagggcgctggcaccgtgtcgggcttcaggcggtgcaggctcgtcttgatctgcgcgtgcatgtttgccgcccsgaactggctcgggcacgcgccgatgcacatggtcacttgcacctcccgtggcgacagcacccaatcggcccagcccaggtcttccagcgacgcgcggaccgtgtgcagacggcagcaacgcccgggcccgagcggacagtsgtccccgttgcgcgcacgcgctctgcggcgccccctggcggcttgcggccgcaagtgcaactccagctggggccgtgcggacgaagattctgccagcagttggtccgactgcgacggcggcggcgacagtckcaggtgcagcgcgggcgcctggggtcttgcaaggctgagctgacgccgcagmggtcgtgtcacgtcccacgaccttgacgccgtcggggacagccggaacagagcccggtgaaggcgggaggcctcggggagcccctcrggaagggcggcccgagagatacgcaggtgcaggtggccgccggatcccagccgcactgtgggaagacagatagggaagctggtcacccacaggcctaccgttttccaggaacgagggtgcccatttcccctaacacgccaagctggatctcaccacggcggcggcgcctttgcacaagttatttcccctaccaagagcatttctccgtgcgggcgcggtggctcacgcctgtaatcccagcactttgggaggccgatgcaggtggatcacttgaggtcaggagttcaagaccagcctggccgatatgtggccaatatggtgaaacgcccgcttytactaaaamtaccaaaaattagctgggcatggtggctggcgcctgtgatcccagctactcgggaggctgaggcagaagaatggcttgaatcggggcggtggaggttgcagtgagccaagatcgtgccactgcactccagcctgggcaacagaggaagactccctctcaaaaaaaaaaaaaaaaaaaaaaaaargggcatttctccccttgaatctcctgaatctcmgtatggctggctcctcctcttccttccagcctgcctaaaataggaagcaccctattttatttccttgtgtatcattcatattccctacttagaatcttagcttggttgacactgtgcctggcacacaataggtgcttagtaaatacttgaaggaattaatgtatatctgatattcaggcagcctgagattccaaccatggctctgcttttcttctggcagtcaaaaacttacttgcttcacttatttatttatttattatggtcttgctgttacccaggctggagtgcagtggggcactcatggctcagtgcagcctcaatctcctggattcaagtgctcctccygcctcagcctcctgaataactgagactacaggcacacaccatcatgtctggctaattttttttaaacatttttggtagagatggattctcgctatactgcccaggctgcaatgttctggcctaaagcgatgctcccaccttggcctcctaaagtgctgggattacaggtgtaatcccgagaaatgaagagtgccaaacccatcacattccagactactgagcctctaggaatcacagcccctcaggctggtacaagtgttagggagactggggagactggggtttgagggtgccttaacctagttgctaggcttagcaagggtgagaggtttgccggagtcayacggcacagatgggtttagggcgggctaagagtgtgcccctctgcctgccccctcctgggtcccaccacagcccagacctcatccagtgccctgcacccctggagcctccatggagggcacagagatggggaaaatactctcctcctcccctaacaagtcgctcgttgcatgtgactttagcagtgccttgacaagcgatttcatcagattcagaaccagctccagctggctctgcccatcacaaacttctatccatgcaccacacccccattgtttctcttggatcctggccccagcccaggtcagggaccatgcccacaccgcacgcccgaccccgtccccgggtttcccaggtgctgtgcacattcaggagggtccctggcatccctgtacctcagtttccccatttgcaacttggggacaggttataacctcccacgttgtgggtgcaaatcaggcatcggctaccccatcagacccaaggggatccaggatattcctacccagggcacagatggggcaactgaggctcaaaggtaggtctgggcttttcaagatgaggaatccctgattagatatgggggctgcttggggggtgggaggggatctctaagatttcacttaccttctggcgtgagtatccggactgcaggggccgggacgaggtcggtgttcgaatcttcccagctctggttggcccgcagcctggttagcaggtcctcgtagcgtttccgcaactctcggaatctggagtcttcggwgtgyaactctgagggtcccgggaaacttgcgcggctcgcctcggccagagacagggcgcccccatgcggcagccacgagagcaccagcaacaccaggagcatctgagagccattcascgtcctgagttcttgcccgggcatggctgtgcaggttgcggctctgagctgggactgaccagatgctgccggaccggcctttatagtccccggactttgtccgtctccgcctgctcagtcccgccctcctccccctgcctgcagagtaaacactccaatgaccacagctgggcggggtctgggggtgtatttagggggaggatctttaggtgggggcgctcctagtaaagctagggcacatttctgrgcctcagtatcctcttcctcgatatgaggacaccattccagcctgggagtctttttggaggaaaaaaagacattgttactatgtgaaaaattccagacaagagtttaagaggtggctgtctatgcccatgggatttcctctcttctctttttggttggggtcaaaggctaaagatggtgaaaaacaaaggaagcagaggagaacrggctagatggagccaggaagggcaaccttgatgtgtcatgcctctctgccatgcctgtttcctcaccaggaaaaaarggactgagactctcactggagaggtggtcaaatgaggggtaaagcacagggccagacacataggaggcacttgataaactgggtgttattgcagttactcatcctcctctggagaactcctactcattcttcaaaactctacgcaaaaagcccctcttccaggaagtcttctccaacattatctttccagtctaagcagggtgctcccaaaccccatccttttgtctggctcagcgctcaccttgaagccatcctcacaggattcataattctgggggccaggcatggtggcttatgtcagtaatctcagcactttgggaggccgaggtgggtggattgtttgagcccaggagttcgagacaagtctgggcaagatggcaatacctcrtctctaaaaaaaagaattctgcgccgggcacggtggctctcgcctgtaatcccagcactttgggaggccgaggcacgtggatcatctgacgtcaagagttctagactagcctgaccaacatggagaaaccctgtctctactaaatatacaa

SEQ ID NO: 13405 - DNA, 14113 bp, Homo sapiens
ccaaatggcagatgaaatacccatttacccaggaccctcgggaggaacccattttgcatcagagaattctccagtattcagtgaaacttttttttttttgagtcagagtctccctctgtcgcccaggctggagtgcagtggtgagatctcggctcactgccacctccgcctcctgggttcaagcaattctcctgcctcagcctccctagtagctgggattacaggtatgcgctaccatgcccggctaatttttgtattttttgtagagacaacctccacctcccaggttcaagtgattctcctgcctcagcctaccaagtagctgggattacaggcacgcaccaccgtgcctgactaatttttgtatttttagtagagacggggtttcgccatgttggccaggctggtctcgaacccctgacctaggtgatctgcccgcctcggcctcccaaagtgcaaggattacaggcatgagccaatgcgcccagccttcagtggaactttaaatgcctgaagtttttttgtatcrtctytttaaaaaattaaccgtccgtctcagtctcaggtaggttccctgccctcctccatccaaccgtgtcatggtgacgaggggtcgctgaccagcagctcaccagagctgggacacacggccctcatgccctgcgctggtggccgagggtgctacactttttcaggactctccttgttcagtgtttctggcccctccttccagtgtcacattgctgcttatggtgcctggtgcctgtcccgtgcccctcctgttttgctgctgcttatctgctgttcggggcatcctgtgacaggccagttggaatcctacrtagagtgaaagcatctcagccccagacaggcccgaccactcccacgccagcttgtcttctcatcagggactgggctgggctgctgtggaggcctgcaagcccgcgccagcttctccaccctgctgggcctcagaggcgcctgtcagctccagctcaccaccrtgtgtggccctctgccccttgcctctgggacaggtttagtctgcagttattatgttcaaaattttaaaattttaagcagttaacactgatgcrtgatgaaaattccaacagcacaaaaaggcagatagtgacaatgtgccccttgaatccctttcccctgaacccctttccggtgtcttgggtcccttcctgagatgttctctgcagccttctgcatggcgttcaacatcatttccttcatcaacagtcgaggattacggtcccataataacaacagtaattaacgtttattagcatttcccaggtgctgacctttgcacccgttctcccactgatggtcatttggtttatttccaacttttcctactatgcacagtgctaaattaaaccacctgataccaccaatctgcacacgtgggcaggtacatgcaagatctgcagcagggtctggaataacgtcctttagttacaacgttgatgataaaaagttgattcccttctgcacccactgcctgtgtggagtttgtgtgctctcacgactccgtgggctttctctgtactctgctttctttcacatctccgagatgtgcacattcagtgaactgsacatctaagtggtcccagtctgaccaggtgtgggtgcgagtgtgtcctgtgatggaacggcgtcctgtccaggctttgtgccctgggagaggctctagccacctgcgaccttgaactagaataagcgggctggaaaatgaatgaatacaagtaattgtcaactaaaaactgttgaagtctacaacaatcacacaaatgcatgacaataaatgatgggatccgaatgcagcctgagcccgacacttctgttcttgtttggttttgaactgtgtggtggtaggaggtgctgtggcataccctcgatagctgcggggagtggggggaaggggggtcctgaagcagaccgttcaggtgtggcttgtgcacacaccccttgacacccaagtgccacaggggaccccaaattccgtcccagctgtgcatctgcaaagctcaaatggactcttgtttcaaattcgacctaatcggtggcacagaaaagctgtgaagatcgtccccagagaaaccgagcggcagcaggccctggaacaggcagagattgtgctgttctgtcctgtccctccctttgggtgacagagaaccacgaacgtctgtgtcctcagagggtcacgggacacrttccagaggkgggtggtggggagcacagtgagcacagaacatggtattttcaatccaggctgtactggcgaggagagagagtctctgtgcccagccctgctgatcccccccgctatcagggaggaactgttttcagggacagtctcaccaccctgtgaagaaggatccatttccgtcagcaccctgcctttcatgctcctccctgctgttgagcagcgtgtgctccctccctgcgcccacgctgcccaccccctgttggcatggcctctggaagctgcggacttgcagggactgaatgtgtgtgcaggtacagagtggcccagacgaggacgtgcctcccgtctgctgggctgaaaagctgtggcagccccagacccgcctgaaaagcactgcttttgcccaagaggatggacagattgtcacagctatrgttatcataagtggcctgtggctttgtgaggtattagcctcagggagctgagtggagacacacaggcctgccctgtgctgtttttgcaactttcctgaaaatctaaaagtgttctaaaataaaaggtaaaaaatgccacggttggctgggcacagtggcccatgactgtaatcccagcattttgtgaggttgagtgaggcaggtggattgcttgggcacaggagtttggaagcagcctgggcaacatagcaagaccccatctctacaaaaaaatataaaagtcacacctgtgatcccagcactttgggaggctgaggcgggtggatcacgaggtcaggagtttgagaccagtctggccaatatggtgaaaccccatctctactaaaaatacaaaaattagccaggtgtggtggcatgtgcctgtagtcccagctactcaggaggctgaggcagaagaatcacgtgaacccgggaggcggaggttgcagtgagccaagattgtgccactgcactccagcctgggcgacagagtgagactccgtctcaaaaataaayaaataaataaataaaaattttgttaaaaagggcatggtggcacatgcctgtagtcccagctatttgggagtctgaggtgggaggatcatctgagcccagggaggtcaaggctgcagtgagctgtgattgtgccactgtactccaatctgggttaccttgtctcaaaaaaaaaaagaattccatggctgcttgtcactgcagagggttggtctcacagcctggtcagggtcctgctgaggagatgtggcctggtcactgtgccttctggacacacaccacctagtgtggacacttgccaccctccacacactgcccagacaggctctacctcctgtccttcaagacctgtactcggccggactcggcggctcacgcctgtaatcccagcactttgggaggccgaggcgggcggatcacctgaggtcaggagttcaagaccagcctcaacatggagaaaccccatctctactaaaaatgcaaacttagccaggcgtggtggtgcatgcctgtaatcccagctactcaggaggctgaggcaggagaattgcttgaacctgggaggcagaggttgcggtgagccgagatcgtgccattgcactccagcctgggcaacaagagcgaaactgcgtctcaaaaaaaaaagacctgtgctcaccgtgaagccgtcacagactctggtatgaatttagccacagacttgatgttctgatgcctcgaggagcttctgggtccctcaagggcccaggtgacatgatctccagtgcagcctagagctttggaatccctcttcctcccccagacccctggtctccagaagacccctaggagcccagggaccattctagaatggcatgttgtatacacgctgtccctccccactggatggtcagccctcaggggcagcacggcttggcccagcctacccagcccagggcattcaagctttggcctcacctagagccaggctggacgccagcagggctgtgtgcagcttggccagctttggagctcccatctgtggactgccgccatgacaatagctacctcaaagtgttcttgaggaccaaaggaagtcattccttcccctcgagggaggctggaacctaatgggtatcccgggaggtggggggaggttcggatagaacatcccgctgctgtgcgtgcagcagagtggctgccatcagatttctttggggtggcctgcgcactggctctgatttgatgacgttctctgtgttttccaattttcttcttgctctttagctccttccttctggcttctccatcttcacatttcccacagaattcagttgtgatttagattttccatgcccctcactagcgtgttctggctcctgtcatgcagacaccttacacttaaataccaagtccgagataaacctgctttcagttcacgggcgcttggaggtcctgggagttctgtccttgagcatgaggaaggagatgcacagggtagggccctgtggctgtgccccagacaggaggaggaggacgaggaggatgaggaggaggaggaggaggaagaggagggaggctttccagacacacaggcagggctgggggagccatgcaggagataagccaggctgaacttgggacttttgcacacaatgcttctctgcctggaaggcccttctttctgtgttctgtgtggtgtctgcttttcatcctgcacgccacagtgtgaaggtcacctccctgactgccctcgctccaggttattctttctcccagcaccctgttctttggcgagcgcatctctggcatcatcacacagagtccatgcggcacagacaggaggcccccttgggcagaggccctgaacgcctcgcctgcttgccctagtgccccagggcctggcacttggcagccctccatagctacctgaagaacagatctgtgtgtggagaggggtcgggagctctgcactttgggaggactatggctggcatttgcttgcagttggggctggtttgcaaatatttctctctgcctcagcaggtgagaaatagcacctcggagctccttgcctgttcaattatttcygattgaattaattatcctgcagtaacagcggagctgctaatagggaacattgggtgccccccaggcggagcatgtgsctcgagagcacgcctggagctggagaccagtgggcagcccagctcttcgggggcgcaggccccctggagctcttctgacgatgggcagcttcatcctgcagtcaccagtgcatgcagaggtccagccacggccacctctttcttttctgtcctttaaatggagagggtcagcacgtagcaaatgaaccaactttgctttgactgcagctgtgaagataatgaggcagccttggttgtcatctaaactcagcaatggtcgagagctatttgggatttcctggcctgcttccaaattgcaagccctgttgggctactaatgccccaccttgtcccagcctctctttggccataggctaggccagccccagggtggacagggaggctccccagggtcggacgaaggcaggcgcctgtgagcagaggcctgggggctggatgggtggcaggtggmcaggccactcttcctagcccagctgatgccatcccgttatcttgtaattttcttcccggggccttatcagccttattagcaaatgtcagaaacaatgagagtcacttaaacctgatcatgcccactgcaccccccaccagcctggcaccagtttgaaccaagcctgcttctgaaaatgtggtggagaaagccctgctgctcctgggaggggctcaggccatttgattctgcctggtgggttcagggctgcctggctagccaccaagacacgggagagcaaagcccggccaaacccaggggcagtggtgtccagcaggcatcaggacatgccgtggcccacacatgcccttctccacaggtgccatcatctcctttcttctcctgttagtgatggcttcattggcctcaggtgacaccgccttctagcccaggccactggatccagccagagcgtctgtgcatcgccccagggaggtgtggggaggctcggccccacctggcaagtttataggctgcttgaggacataagatgggtacagaagaggcttcagggctcagcagatgctgtgctgggagtgagcccaggcaaggtggcccagggacagaagatggaaggtcagtcgtggcctccttccagaaggaaagagattttagcaggaagagacaggcaaggaaaggaattggtttttcaggcagagcggtacttttttaaattgacaaattttaagcatacagaaaagtagagaggacgaacctccaaacatcagcccttagattccagtmcatcctgccttggtagctgacgtcacgaacgctgtgacctgtccctctgcactccatcatagcatctctaaaacggaggacatttcctacctcagcacaacttcattatcacaaaagagaacattttgagcaaaagtttggaagcaggcaaaagtagggtttgttctggaatggcatgaatgaatgagtcatgggctggacccggccccgcagaaagagcagaggaggccgtctctggtgtaggagttgaagccaagactcagcatgcaggacaaggagcccagcctggtggcatgggctgtggcttctccagtgggcccataggaatggccctggggctgggacttgtggggacggcggccacaagaggaggatcttcagcatggcctgamagcacctgtaatgtaggcaggcaatgggctcctccaggtggcaggaacacygtgaggagcatgcaacgtgctggagaccatggggcatgtgacctccgggcacaccctggacagacctgggtgagaggtggkctgggacgccaggacrgtgargggcttcaaggtgtgtttgtcctttgtccttatacaggtgacctgcatgggcgggtgaggtccatcagaatgctctagaacaggacaactgaggtcccggctgccccgctcaacacrccatgattcctagactgccctgagaggtcaggttttaaatagggtgtggcccggcaaggaccctgagggatgtgaggccagacagctccttggtggccgcctgcacgggaagctgagtggccctttggaacaggaagtgccttgtccaagttaacccgggcccgggcccaccttggactccctctggagagaacggctggcctgttcgcctcctttctccttccttccaaaataacatgtccaggtcccttggtaagaatgctgcagctggggtcagtctccaaactggagtttggtggctaaaatgcccgcctttctgcccccaatttcacacatggatgatggtcctggttcagcagggaagattctcttggacccgtgtctgctggttgggaagtggagaaagccgccctgttctgcctccattttgaaacgtcttttctgttcggaggactaaaggaagccagagctggttcagatgttcatgagcacctgtgccagcccctgcccgtcacacttgaggacaccaaggctgtggtctgtgcagtgaatcggggcagtggggggacttcatggttagaaacacaagctggaggccggatgcggtggctcmtgcctgtaatccctgcactttgggatgcctgaggtcaggagttcaagaccagcctggccaacatggtgaaaccctgtctctactacaaatacgaaaattagctgggcgtggtggtgggcacctgtaatcccagctactcgggaggctgaggcaggagaatcgcttgaacccgggaggtggaggttgcagtgagccgagatcacaccattgcactccagcctgggcgacaagagcaaaactccgtctaaaaaaaaaaaaaagaaaagaaaaagaaacacaagctgggcttcctgcttcccagctgtgtggctttgggccagttactcactgtctgggtgcctccatgttcttgtttccttatataaaataaagttctttcctcgtggattgtcaggaggattctgtaataatccacaggatgtgttctgcatgcactaggtgctcaactttcctgacccccgtccagtgcccccctcaccgrccacgtctgccctctaagctgccagtcctataggaggcattaagacgtctagcaaggctgtgttctcagatgcctcgaaatgggacctcagccttggagttctctcctcccacatggaggcaagtcactgacagtcatctagcaaattgtatgcatggtcaagctcagaggttctattttgggtcaaaaaaggcatgagctggctgggcgccgtggctcacgcccgtaatcccaacactytgggaggctgaggcaagcaggtcacctgaggtcagcagttcaagaccagcctggccaacatggtgaaaccctgtccctgctgaaaatacaaaaattagctggatgtggtggtgcatgcctataatcccagctactcaggaggctgaggcaggagaatcacttgaacctgggaggcgaagtttgcagtgagccgagatcgtgcccctgccctccacctggggtaacaagagcaaaactccatcttaaaaaaaaaaagcacaagctggattttgccctttgtcgtgagagcatttcatgccttcatgaaagtcactgcagctgtgcttcaggcagagggcccgggatccaggtggcgtgcgctgccttccgtggccccttcaaagggcagccaccttcccagtgccgcaggagctcctggtctggggccacatgcttggaagggccactgaatgtggtgaagggctgggtcctggtactgagcctgttgagacttctgcaggattcactgccgtatgcctgaggaaggcagacgaaggaaaggacagtgtggagtgctcagcagagtccccatggtcgcacttgggaagaacgccctggcagtggacggtcagtggtcacatgcacatgcgaggccctcaggactctgtaggacacgacgtggcttctccacagtcctggggatcggaagcagatgcagaatgtggccgagtggcccgggccagggcctgagagtctgcattctgacatgcttccccggtggtgctgctggtctgggaaccacactgggtttaagtaactgatttaagtaactgatgcgaggaggccatgctctgggggaaggcagctggagaggagaagaatgatgtccccatgccccttccagcctcagagtcctctagacccggcagtgtgcaggaacggcagcttcactgcccatcccctggggtactccctgcagccttgggccctgctcctgcaacggtggccgaacggtgcaaaggaggggrcggcccagtccctgcaggctgccctcarcctgggtttgctcatctgtgagatgggatcacatgtataatcctggctacttcacagagcccaggcgaggatctcatggacttgtgcatgtggaaaagccctgaaactgaaagattctagaaacaccaggattgtggtcactgtcattactggagggcataacccattcccctgtttttcctccatgaaagacaatcccaccaaaacacgaaggccctgccctcaatctgtttgtgtccttggcatggttcagcctgctctccccatggcctgagaggaaagcgttagccaggagggtagttggaggtggcgggaggtaatcccaggagcccgtggtgagctgaggatatggagaaggctcatctggggtgacctgagcaagcaccctctatcccaagccagtccccagaggccacgtaggcmcctgtttctggattaactgagcgggagctcaatcaggcaaaccaggttgcttggcacggtgtttgccttaaagaagaacaaggtgggccaggcgtagtggctcacgcctgtaatcccagcactttggaggcyaaggcaggcggatcacctgaggtcaggagtttgagaccagcctggccaacatggtgaaatcccgtctctactaaaaatacaaaaattagctgggtgtggtggtgagcacctgtaatcccagctacttgggaggctgaggcaggagaattgcttgaacctggtaggtggaggtttcagtgagcagagatcatgctgctgcactccagcctgagcaacagagcaagactgcatctcaaaaaaagaaaaagaaaaaagaaaaaagaggaaggtgggctgtgcccttctggctcaggcactgatattcaggggccagtaccaggcagatgagccctgggtgttgggctcacatgtctgtggcctgtcgttttagccttggggccaggggtagcagccgtttctctctgggcaaggggctcatgaggaaacgtttctgccttggcagcccaggccacagctgtgctggctgcagacaccctgggcaggccccggtcgctgaggagccttcttgggcaggttgcttcatctctgaagctcagaatcctttcctggagcacagatatcaaaatatttatccccagaagcctcaacaaacctgtgctcaccgctgctttaggccctgcagcagtcccaggtctgggcagatgtttcaagttcagtgtgtgggctctggctygctggagctgggcccagggaactggcgccttgggatgaggcccgccatgtccgagcctgcccatgccccgctgctgctgcggccggtggtcttggggctgcctgccagccttctctcctgggagctaagtggggacaggtgctgcgggccacggtccacgatgctccctgcttcctgtttggtgggcagcctgggttttaggaatgtgtagagctggaggagctgaaagagctggrgctcgggatcaggtggttcagctgactcgggaaactttgaggcaccaccgcacmtgtccgtgygtgagggagacatcttccttgcagggctctgggaggatggggtgcttctgtaatgcccagtcttgggcctggcgcctacctcatatgggtgctctatatagcagcaggcggagcacaattctgctaacgtcagcaacaatcctgtctgttggaataaacatgcagatgcatctgtgaccccagaatcccagtggtggctctgtccycgyctcagccgagcactcakcggccagggtggctggactcagcacggggctggcactgaaactggcagtcactgctgtcagtgcccacagamagcaagaagagaatagacaaataccaggcagtggagacactccctgcccactgcagatttataatcagcgaacatttactgagtacctgttgtatgccttgaggtgctcacaggggagcactcgggagcccattcactcgccagtgatgagtgggcactgtgccaggtgctgtccaaggtgggggagcgagggggtcactgcaggagagggtgagaaggaggctgcatgctgcacgaccctctgaaccctgagcctgcctggagaagtgggctgtgctgcggggaccctgttggagaggggcagcatggggaggggcggagcctgcctggggcctctcatcctgcagctgcctggaagttgggctccttctgacagtgtcctcaagtagacgcgggttctgggggtctggctggtggaggccagctggtgctcctgactcactggctcctctccttgcacagtggctgctgccacctgcctagggagtcttcctggggctcagttcccctgaccccctgggacataatgccagaactcatgctggctggccaccctccctcacgtgtgctgtgctcagcccgaagttggtgctttcacctgtgtgctctgggcaaagcaggcgcagaggaggcactgggatagagcgcagagtccacctggggcagccccctcctcgtcccggccattgccccatgttgggggtcttctgtcgggggagggagggttggagctgggattggaaggcccctctgaggctcttcttccttcctccatgagccctccaggccccaccctccatcctgcgcccctgccccatccccacccacggccagggctggctgctgcccattttggccccttcccttggggcgttgcttccaggttcaactcagattctgtcttttccagaagatgtctctgtccttccatgcccccagcctttgttccttgtcctcccctgtccctgcactcctggggtgggccctcctgctcccgagcctcctgcgtggaggctgtgagctccctgccacctgcgtggtcagtctttcctgcaccagcctcccaggacccctcctgcccacgctcctgagagattcaggcgccagtgcatgggtggggcacaggggctgcggcagacagagggtggtgatacaggggtggagtcccacaggccggatgccttgayacttctcagctgcagggctgtgcccggggctctgtgcccctgaatgagggcaatggttcccctgcacagtgaccttgtgagctgattcaggccccatgatcgtgattagctgacagcacattggccctcagagaaatgaaaatacacagttacacagtagcaaaatcccacgagcagtccctcagctggggcagggacacacggactgtggcacgtccacaccaaagaatcctgcgtagccacaaaaaggaacaagctggggatacatgtgacaccctgggcgcatcgcagaggcatcataccaagtgcaggatgccacagcctgcgcgattccatttctgtgacacttgaggagggaaacgggatggaacacaggacaggagtgtctggggtgggacagggaagggcccagctctgggttggagcctggagctggctggaagtgctgtgtcctgatgtggtggtggtatgcatttgtcaagactcatagacctggttggggcacagtggcttacagctgtaaccccagcattttgggaggccaaggcaggaggattgcttaagaccaacagttggagaccagcctgggcaacatagcgagaccccatctttactaaaatcaaacaacaacaacaaaactcacagacctgtgcattaaaaagggtacattttactttatgtgttaccttcataaatctgacctaaaaatgatttttaaagtccccccttctaaaatatactaatctttaagaaacaaaaacaaaacaaaaagctggctgacagtgggtcctactactagcacatgggcgttgatgatggtgataatgtctctcgcccataaaaggccagcttggaaacctgagccccagctgcttatcggcctgtgtagccagacaaccattctgccactcgccaaatattttcaaatttcctttccgaggcaggctgaagtccaggtaaatattgacccaagaaggcggatcacgctttgtgctatatttggttaatagttggagtcactcctaagctactttttcagttgctttgtacaggtgggtttgttttatgtaaaaagaaaagacactttaaaaagctgcgcataaatcagacatcataaatgcagtagaaagcctccctatttaaatgactcagcgaatcttctgatgaaacaactgcctcttcccctttaatgtatttattaatttttttttctttttttggagacagagtcttgttctgccacccaggctggaatgcaatggtgtaatccaagctcactgcagcctcaaattcctgggctcaagtgatcctcctgcctcagcctctcaagtagctgggactacaggcatgtgccaccatgcccagagaatttttcaattgtttgtagagatagggtctcaatttgttgcccagcctgaggcaaatttttagatatatattttatttaagtgagagctgtgacagcaatggcacaatact

SEQ ID NO: 13406 - DNA, 23803 bp, Homo sapiens
tctgcccaaagggcccctaaagaagtttgccctgaggtcctccccatgcctatttctctaagtctacttcaagagtttggaagcaggccgggcgcggtggctyacgcctgtaatcccagcactttgggaggccgaggcggacagattacaaggtcaggagatcgagactatcctggcyaacctggtgaaaccccgtctctactaaaaatacaaaaaattagccaggcgtggtggcgggtgcctgtagtcccagctactcgggaggctgaggcaggagaatcttttgcacccgggaggcggaggttgcagtgagccaagatcgtgccactgcactccagcctgggtgaccgagcgagactctgtctcaaaaaaaaaaaaaagtgtggaagcaaaggcccattcatactgaacagcactggggtagggggattctttacttttttccaaagcagtaagaattctacccaataccccagtcctatagtaactcctctgacttgtaattcctcctcctgataccagagacctctgtttcctggagaccaagaactgcccaaatggctgtggaccaaagtgacagcaaagcacttgagataagaggctgcagaaataacttgctcactgaagcagttagggggagcgagtgttctctagagaggaaactatataaacatgaggcatatggccctgactggaggaaaaacataagagcagtggagaaaaggcagagcaagcaggagagacctactgcagggtccaaagagatgctggagaacctttccacgcttatttacatcagtgttgcttcactgcaagcagcagctgaatcaggttcagttagatccttaccatgaagagaatgctaagcagaaaagcacaaagtagggaccaaatacagtggtatggttctgaagtcaggagaaaccatctacagaggaaggtgaacaatgaaccccttgcgctcagccaaacctagacagtaaccaaaaggaatgaatacaaaaggaatactttgggacttgtagcaaatcttggaactggagtgaccaagggaggcagcagcattcctctcccctgtcaacacccactgtcaccccggcctgactggactattcaccacccgcaaaccatgatgtgcacattcccagctctgccctttgcactatttgttctctgtttgaatgcagaactactatttgaaaagatcacagactttggggttgaattccagctctgcttcttacttgttgcaggactttggaccctctaagcctcattttcctcatataaaaatgagaataggccgagcgcggtggctcacacctatgatcccagcactttgggaggccaaggtgggcgaatcacctcaggtcaggggttcgagaccagcctggcaagcatggtgaaactaaaaagcacaaaaattagccgggtgtggtggcaggtgcctgtaatctcagctactccagaggctgaggcagggagaattgcttgaacccgggaggcggaggttgcagtgagccgagatcccaccattgcactccagcctgggtgacagtgtgagactccatctcaaaaaaacaaacaaaaaaaatgagaataatatcgtaaccaatttcatgatgttgttaggaggattaaatgagatagtaccataagtgcctacgctgtaaatagtaaagatgtgatctcccatcttctttctttacttctccccgttgttcaagtctacctaatgtctttctctgtgaagccttcctgaacacccagcccagagaaatcctcttcctctaaacctccagcttctagcacttgtggctctgagacagaccttaacttctatcttaaggagctccctgtcttttcatggtcatgtatccctgatccttaacatggcttatgtggtgggtgactatatatttgattgttcaaactgggacgcttatgagaatgaaaaggrgtgctattaatgattacacaggggaaaaccaagactgccctgggcaaaccgtgkgtggggctgcccaacttataagacatcattctcttytttatttaagaaaaacatgtgtaacccctaattccaagcccatcctccaccagctgaaagcacaagccaaacagcctcagttttctgaccatcagagaaagagttcagggaaaatacagctatacttagcagcatgaggaaatctaagctgccaatggaaaaaatacaatctgagggccacaagtaaataaatacaaactttttttyttttttcttttttttaaagacccactagttggccaggcacggtggctcacgcctgtaatcccagcactttgggaggccgaggtgggccgaccacgaggtcaagagattgagaccatcctggccaacatggtgaaaccccgtttctactaaaaatacaaaaattagctgggcatggtggcacatgcctgtagtcccagctactcgggaggctgaggcaggaaaatcacttgaacctggcaggcggaggttgcagtgagccgagatcatgcaactgtactccagcctggtgacagagcgagactttgtctcaaaaaaaaaaaaaattaattaattaaaataaataaatgaataaacacccactagttgaaatgactctcttatcctgatatgttctttgtggcctcaagaggagggggcagggaggggattctaggcctggcaaagtaaaccacttcccttctaaagctgaatatggtatgataactactcttcagaatagttaatgggggagaaaaataaacgagacagaaagccagagagagacaaaccctctcagcagagaaaacaggaacaatactgatgccaggactgcaaatttctaaggagagccagctcctgattcctgcctcatgcctgagaactgcacacactacattatccaaggggtcctggatgaacacctaaactgcaatgcagccccaccctgaagcaaagatttctcccctcagaagtgaaagatgagtcaccataaataggacatttggttaaatsatttttttttaatggaacatcctattgtctctgtggcagaggctatagaaaatttctgtggtatcaaatactaaaaatatggtagcaacgggagacttggctggattaccagctgtctttatcctgcacaaagaggagcattcatgattttctgaaagttataattaaactgtagtttaacagaaacattcaaacttaagagtgtatctgtctaaatcacctctctctctttacacaagaaacttaacggtstcctctggagaactggatggagaggagaaaagaaaaatgatctttatctttttcatttcatatccctttggtatttaaatttgttcatgaaatacacatttactacttctataatttaaagcaatctaggctgggtgtggtggctcatgcctataatcccagcactttgggagaccaaggcaggcatatcacttgaggtcaggagttcaagaccagcctgtccaacatggtgacaccctgtctctactaaaaatacaaaacttagccaggcatagtggcgyacacttgtaatcccagctactcaggaggctgaggcagaagaatcgcttgaattcgggaagtggaggttgcagtgagcctactccagcctgggcgacagagtgagtctatctcaaaaaaaaaaaaaaaaaaaattaaagcaatttaaattgttggcatctaccagtatgtcttgccatcagttcccctgttaaccttcctagagtctaattttctcatttctccaggccctggagaggctatgtgatgatgcaagctctaagacacaatctcacctttcacaagttcacaagtttgaaaggaagatctagatcttgctccttgggggatgaatgcagggagagaaaggtcgagatgccagcagtattggaaaaatcaagtatttttccagcttcatattgctgtagagaatatactattcgggctgggtacagtggctaacacctgtaattccaacaccttgggaagccaagccagggggattgtttgagtccaggagtttgaaaccagattgggcagcatggcgagaccctgtctctataaaaatacaaaaaattagccctgcgtggtggcactgcctatagtcgcagctttttcgggaggctgaggtgggaggatcacttgagccggggaggtgatcacaccattgcactccagccagggcaacagagtgagaccctggctgaaaataaataaacaaatacaaaataaaaatagagaatatactactaacctgggggtcgggggaggctctggaggatatatgctggagagtagatgcatgcaaagaaatactatttggtgaggtttcaggtccaagggcactttaccaaatggtggaagagaccagtcatttgggttactggggggtaaaatccaactgtttagcacttagaacggtgccccaaaaactctacattagtcctccaataagcgccctgtggtggactcagaggtaacaaaaagggattggttccaaatggccttatgcattgaaataactccccaaatttgtttttcacaaggaaaatgtctatgtaattggtgttaaaatggaccttctccccaattcaatatgaagacaattcatttattccagcagctgagtctgcagcaggaattagtgactttcaggatttgttaaagaccagaatctgtccctcaggggaatttgtagagtttaagatatctaaaaaggaaagctcagcaagccatctatctaggtttcttcagggcagtataactcaaagtagaggggccgggtgacctcctggagcctgtctctggttagctttttgctgctaactggggataacagcctaatgcctcatgacggctcagcatggctgggtgagtccaactgagtcagagagcaccaaaaataagccacaaagcattgagtagtcatatttatggttttgattccaaacacactttgtgcttatcccttccaagtggagaatttttatgtcatttgtgtgcgttaaggccaaaggagaaacctggaggcaaaggaatgctggttgtgggtcaacaaatatgcctgatggattttgtatgtttggcttaaaaacactgacttaaagtaaaatactgtgactacttctaacctagaaatgagttcagcccgccagacagaaactgccattcggaggaaataargccgtgagcaccggttccctccacacccccgaggttcacctggaggccagtgggccaagcgaagccttgggagcggagaactcaaagaggggcggggagaaaagaataaacacacctcgcggggctaggctggcggcggcacagtcctggtttttttgatggaactgaccaagatgacagcaagcagaggctcaaatgcaggattcagacccaagacttctccccgctctcaggcggaccccaaaggcggggagccaaaaaccgggagactgaacaagcagcattctcacgctcctaaactggcttctcgctcctcgctcctcatgccccaaaactgatcaggccccaacccssctccccacaactcagtgttccctccacayggaccgtcgagkctcccccagatcccacgtcttcgwccttcctggaccccgtgctccattccttacagtcacagacagggattcgttacctgcagarcagctcgacaaccctgcaggtagtcctccatgatgaagcccaaagtacgccgtcgcccctggtcgagtagaggtgcccctggtcgaggagaggtttccccgacgaatgcagcccgcccgggactcagggactagaggccagagtcaggaggcgggactcgaacccgccacacggcgaatcggccwccgaccccgggaggaactgcgtaagcgggcgctccggagtccggcgtcgccccgcccccagcggcggaggcggggctctacgcccagaggctcctgggacgtctttccggcgaggccaagggggcgtggcgtggggcgacgtgggaaacgtagtcccgcaactccgcaatgtccctagcaaccgagggaaggattgttttctgagggatcagtcgttcggtaaacaaatgtgtatgtgtcacagtaacccattattgtggcatctgaactttccctctcagatcaggccaagtataacatctttacatatatcacaccgagcatctggtgacattttaaatgacacttggcaaaacagatcatcttctttctacaaattctgccctttaccaaactgactcartcgccaccaattttgtggttgttcatgttaggagaacattagaataatctttgacccctcttgttaacacctacagtctcctgccaactcctgctgcttctccctttgcaactctgtagcctgtttttttctacagcctcggcaaatatcttcttcctttcttggacggttgtaaccttggctttttgctctcygccaccctaattgttccaattgctctttcagcctttagagttgcttgaaatttcatcctgtggcggccctrtacatrgagtttagggaacccttcagaatgtggagttaggttccaacctcccttaactgccactttccagccgcagagtagtgcaggtactgcaaataaatggacactcatcatcaaaaattccctcatttatttatctatccctttatttcctaccgtcagcctcacaccagcttttcctgcttccccagctgtaaatcgagaggaggtgaytgatgagaggcctgcagtggaaccaagatccagagcacaggcgtgttggatctcctgcctgctctgccagttcttttcttcttcttcttctttttgagacggagtcttgctccgtcttcaggctggagtgcagtggcaggatcttggctcactgcaacctccacctcccgggttcaagcgattctcctgcctcagcctcccgagtagctgggactacaggcatgtgccaccatgccctgctaatttttgtatttttagtagagatggggtttcactatgttggccaggttggtcttgatctcttgaccttgtgatccgcccgccttggcttcccaaagtgctgggattacaggcgtcagccatcgcgcccaragcctggggcttctaccacaccctytgcactctaccaggtgcacaacccaaccagtttcatttctagacttaaaaatgatacagcaaggacttggaaaggagctctctggagggctccagagggaaaagagctgggtttgtttgtttgtttttaacattaattgagtaatacatgcaaatatcgtgctctttgctcctgcttctgtggatccagagcaaaggactgccatacccagagagagagcccagatccaacaagctgcttctgtccagcccttctcctccctacttagcaagggcacttgctcttcccyattctcaccagagaggcacaagcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtaaaaactttattttaatcatcttcttcacctcttctcccacccttctctatttcctctccagctttggggagctgacacctgctgtccttccacctttggtctgcaagtctggattgcttagaggagctaagtcaggagagacatgtaaaggggatgctgcttggtcctcctccttttaatgaaagcacgaaaccttccccctctccttgtgagcaagtatacagggcactgtggccatggttgacatattctgagatgaaaatctaaactattgattgcacaaagacataggtcagactaagaaggagattggtgtgagacagtaagggaactgttcctacagagaaggagtgtcttcttgaagctacatacctgttttacgtgcttcttccaactttcggctctctactgccattgattagggaggagccaggattattttaactccctcactcaccaccataattccagctggagagaaagtgtaggatttgacgagctaagaaagaggaggaaaagaatgaaactttgatttatctgactatcctctccctcattctttcctactctgaaatactccatgccctccccagcaggattggacgttgtagagtagaaagcctccattacatttcctgcccctgcctcttaagacttagcccatttagctctgcccagttcctctgagaccccactccctcaggtgtccactcctgggttcctttggctcacctctccagccagctagctgcccaacccccacttcatcattgatcatttctggcactggagagaaaatataaaaaataaggcctgcttttcttttttttttttctttttttytttttttttttggaggcaagagtctcactcttgtcacccaggctggagtgcagaggcacaatcttggcttactgcaacctccacctccggggttcaagcaattctcctgcctcagcctcctgagtagctgggattacaggtgcccgccaccgtgccyggctaatttttgtatttttagtagagatggggtttcgccatgttagccaggccgatcttgagctcctgacctcaggtgatccgcccgcctcggcctctcaaagtgctgggatacaggtgtgaggcactgtgcccggccaaggcctgcttttcttcaagctttttcacttttccaggctctggcatctgctttgaggttcaccctaagtgtcatttaaggggagaaggaaaggagagagagaaagagagagaaaaaaaagcataaggcctgcaggcaatttttgctactctgattctaaattaacaacacgtaaatgatatgcagctagcataaacatatgtgaatcaagaggataatcaatttgagtgactaggcttattttgtttcagtaactttaatgttcctcaacctcatctcccaggccttcccctagccccaaattcctgtaggtttacaagaaggaagcagtctcaggctgggaggagggtggagaaaaracaagatttctaactagtttaatttattttattttattttattttattttattttattttattttattttattttatttttgagatggagtttcgctctgtcacccaggctgtagtgcagtgtcaccatctcagctcactgcaaccccctgcctcccaggttcaagcaattctcccacctcagcctcccgagcagctgtgactacaggcacgtgccaacacacctggctaatttttgtactttcaatacagacagcgttttgccatgttagccaggatggtctcgatctcctgacctcaagtaatctgcccgcctcagcctctcaaagtgctgggattacaggcgtgagccaccgcgcctggcccctaactagtttaatttctccctgtttctctccctgataaagagtgggaggggagcaaggagattgaagggagatgttttccaaagggcaggatttgtggttttttattatttatacccacagtattagttaaatgtctatctgtgcttgcctcaatgtgcctccagtgctgatagagaacaggttammcaggtccggtgttcacatctaaaatgacctggagaggactgggcacggtggctcatgcctgtaatcccagcactttgggaggccaaggtgggaggatcacctgaggtcggaagttcaagaccagcctgaccaacatggagaaactccatctctactaaaaaatacaaaattagctgggcatggtgttgcatgcctgtaatcccagctactcgggaggctgaggcaggagaatcacttgaacccaggaggcagaggttgcagtgagccgaggtcgcaccattgcactccaacctaggcaacaagagcaaaactctgtctcaaaaaaataaaaataaataaataaaaccacttggatgggaatagacataaaactttaggtaggtgaatgtacaggaagtattgttatgtaaattaataatcagcattttcatatttcatagaaatagcaggcaagagagtacctctgggtttaggtagtttctggggaaaaaaaatgaactgaggaaaagttgctgtctcaaygctagctgtcaagagatgcttactgggtccaggcaccgtggctcatgcctgtaatcccagtcctttggcaggctgaggagggcggattgcttgggcccccaggagttragaccagcctaggcaacaaagcaagaccctgtctcagtttaattaaaagaaatttgatatctttattaattttttttaaagagaagcttactggaagaacttgtggggagtgctttttgtgcccctaatctgaagttatttatcaaaaccagtctctgattccagcccccaccacctacatttcccctcccagcttacaggaaacccctcccaaggcctttatactgtggtttgggattgtgtaaggttcagtagagccctttgaggtggaagacttccccttcctcaccagcatttcacctttaggggcatgaaactgactctctgtgcctcctccattcttcaccccaagtactatgtgacttaatctttttatccttgggtgaggcagagagaaggtatccctaaacatacaagcactgtgtattcttagtatgttgtgtgaaggggcagggtgtggggtagggcagaggaattatctctgtcatggctatgagggggttactgatgtgatgcctattagagtaagctaaagatcatcatattaataaccattagcgtagatttaacatttctttctccacctcttatccttctttctcctttgtgctctccctttctctctgtctttcctcccttccctgtcatgatctgtttcagggaagctgactccacccatgtgttcaatcccaccagtcttccctcccaagtctggaagccccacgacctcttggtctcatctggtcacagcaagttagaggtggaaagagctcagcacggggcccttctgtttacacatatactgcccatagccaggagttactgcacaaacactagccagccttctacactacattccttttccaagacttttctgggttagtttgctttccagcccactgatttccttcttattggacaggtcactcttttgcatcccaagcctggcttaggcaagtccctgaggttagtaaacaccttcagtgcccctcagccragtcccttttgaccatggaataccatcagcctgaggatccagcccctggtaaggccgggactgcagaagcagtcatccctgaaaaccatgaggttctggcaggcccagatgagcaccctcaggacacagatgcaagwgatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtaagagaacatgcagttaggggtgcaaaaaatatcagggagtactcttccctgacttacttccttgatcatcctgatgtcctcaaactagtcaaaacttttcagattgttctccctatttctccagcttgagcaaatgagataagatgttcctaaaaacaaagaaaaaaaaaaaagaggaagatctgtcctacccctgtatctcctactccctagcaaatgcacatgccttgcaagatttcacattcattcccttgtgccagttgcaagccttttttcctaccccaccctactactggagctcccccttgcctttccatgggttcttcyttcagtgctctttggaggaaagcacacacgtgatcaccccttctgcctccaggtgaagctccccccgcagaaggaagtgatcacatcggatgagctcatggcccatcttggtgagtgactgggcgttgaagaggaattacccaaggggytccagagctatccactcagccagaaatccagactattcagggatctccatttgggggttctgatacagcagggagggtaarggtctatggggcttctctgcaaggctggagaatgaaaagcaaaggcgtcgggagtcctgggttgtaacaccaattctgcccttagcttttgtatctgaccctgggtgggccgttcacctttatgaggctgycgcctcctctgagaaatgaagagtctggattagactctaagtattttccagctctgaaaatctgtgttctgtgacattacccgcattctccaggagaagaggaaacttagcttttgggatgattggtggggtaagctgataaggggccctgtcttgtaggaaactgcctcctgtccatcaagccccaggagaagtcagagggacttcagcttaattttcagcaggtgaggcaaaaggtctgcaggcataggggtttgcaggtttgtaaggggacatcttgtaatactaagataagcttttgttgcttcttcagaggtttccttgaaccatgatttcattctgcaggagtcagaggagagtttatctttgtcctagaaaatatgttcattggccgggtgctcacacctgtaatcccagcactttgagatgccaaagygggaggatcacttgaggccaggagttcgaggccagcctgggcaacataataatacccctgtctctaaaaaaaaccattttttttttcaagaattagccaggtatggcggtgcgtgcctgtagtcccagctactcaggaggctgaggtgggagggtcacttgaaaccaagagtttgaggctgcagtgagctaggatcacaccactgcactccagcctggatgaaagaattagacttagactctcaaagaaaaacaatgttcatttatataagatagagaagggttgaggcaagggagaaatggagtggcttgtaagagaatcagggaagaagagcagcaaggttaatttttaatttctgcaggtgggagtggagtggtgggagagaaggctagaatctccatcatttttttttctacccccagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacaggtgagggtgggagggcccactgggaccttatccagctcaagctgacatgagagaggcaaatttttgtcgggtagaggttagggagttaggggttagattggcttgggagggaaatagtgtttagagactggacccagtacagaattccttgaattttaatctattttgggggtaacatgcaaatacaagcaaactacatgcaaataggtcagttctttagacatcaaaaattcaggaagcagatgggtttggtggcacatgcctgtattcccagctacttgggaggagttcgaggccagtctgggcaacatagcaaccctatgatgaatggttcctgaaatttttttcttttttgagagaccaaaaaaaaaaagtgtttaggaaccattcatcmyagggttgtagtccttgtgagctttgttcatttccttccttaaaaaagaaaaaaaaatcccaatttttttggtatcccacatcccactacccaagcagagtcctgaggctgtgcgtgcagttgggaaactgagttacaaccagctggtggagaggaycatcacctgcaaacactccagtgacaccaacctcgtgacagaaggtgacattcctccccttctcatggatagtatgtggagggaatgacagctacttaggcttattttttattgggtgtcatctcctaccacatcccactagatataagcttcacaagaaggagcttggggaatttctgtttagttcattgaggtatccccagtgcctggcacaaggtagctgctctattataagtatttgttaagtgaatgaatacagccaggtttcaagaaagggacgtcagaaggtgggactgaccccccggggcttttgacaggggctctctggatggtccttcctgttgtggaccttgaatttaagccaagtttcccccgactcgtccctttctggcaggcctgattgcagagcagttcctggagwccaccgcggcccagctgacctaccacggactgtgtgagctgacagcagctgctaaggagggtgaacttagcgtctttttccgaaacaaccactttagcaccatgactaagcataaggtaatgcgagtttgggggtggcgtgctgcggtgctgtcatttcctggtgcctttttctcgtgggtccagctgggatcagctagattaagccgtggtagcaagtgacccctcaaatccctgtggtttaccacaacaaaggttcatttcccgctcctggtgcgtgtccactgtggactggctacggttctgtcccacaccatcttcactctgggacccagctgacaaaagatcctttatctggaatatatgtgggaacagagagagagaggggcactgtgcactcatgcttagagcttctgtttggaaatgacacatgtcatttctgctcacatcttctggccagagcaagccataagggataagcctgccgtcgatgggacaggaaagtatgatcctcccctaggagggggcagtggaatttttaaacaatgctggtcttcaaaagttagaaactgccaaagctctctaggatttgagcagcagagggaggggtctctggttctcaaaggatttatcctaagagccatcaggcaagcccagagaacaatgggaaatggggggagcagggtcttatgtggcatctcagccccaacgactccatgccacgcttagccagaatgaccaccgtgctcacacccaactggacatacactcagacatccctttcttccccccaaggccacacatatttgtaaaaggtccgcatgctcagggtccgggtgcggtggctcatgcctgtaatcccagcactttgggaggccgaggcgggcagatcatgaggtcaggagatcgaggccatcctggctaacacggtgaaaccccgtctctactaaaaaaataccaaacattakccaggcatggtggcgggtgcctgtagtcccagctacttgggaggctgaggcaggagaatggtgtgaacctgggaggcrgagcttgcggtgagcagagattgtgccactgcactccagcctggatgacagagcgagactccatctccaagaaaaaaaawgtccacatgctcataccgagatttctggcagtgaactgcctccgtatcaactgtccccccaatgagctctgttcttttctttgtagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaamgcagctgcaggtagaccaggtgtgtagggcacttaggaaaagtgcagagagcacatgtgcctcagagagctttttactgcatacattttaactgctagaggccatgtgaacccatgcctctctctctgggttacctcagaccgtctcctcacttggtgtgtattctctggcaccacagataatgcatttggctgtgtgtgctgctctgtggggagaaagagctagagaatttgagggatgtgggaaaactgatttggaaaccttgcctgaatagccacggctctgggcctcagcccactgcacaactcttgttctccccaggactacctgattgctctgtccctgcagcagcaacagccacgaggcccgctggggcttacygacttggagctggcccagcagcttcagcaagaggagtatcaacagcagcaggcagcgcagccagtgcggatgcggacgcgggtcctgtcactgcaggtgggctgctgcctgggcgcccacactcccggtttccacctcatgctttgccgggtccagaacacctgttattcctgcactggtctcttcaaggtttcttctctcagrgtccttcccctgcctgtccctctcccctggagccccttcctgtcttcctctccctactctctgtcccaatcctgacaccccttcttctagaatctcttcttgtgctcttccaaggaagttcagtgaccaattgttaaatccgatacaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacrtgctgctgccttctctgcctcccayccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattagctgggcgtcatggtgggcgcctgtaatcccagctactcgggaggctgaggcaggagaatcacttgaacctgggaggtgaaagttgcagtgagccgagatcgcaccattgcactccagcctgggcgacaagagcaaaactgtctaaaaaaaaaaaaaaccttctttcctgagatctgttgtttgccttaccctgaagcaatagggttaagtatttgacccaattgaagaatgcaaaaagcrggaggtgggtcagaggcaggaaggtggttacctgtcatttctttttttcttttttttttttttttgagatggagcctcgctgtrttgcccaggctggagtgcagkggkgcaatctgagctcactgcaacctccgcctcccggattcaagcgattctcctacctcagcctcctgagtagctgggactacaggcatgcgccactgcgcccagctaatttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacytccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagcctcctgagtagctgggattacaggtgcacgccaccatgcctggctaatttttgtatttttagtagagacggggtttcaccatgttggtcagggtggtcttgaactcctgacctcrtgatccgcccacctcagcctctcaaagtgctgggattacaggcgtgagccactgtgcctggctaactactgggttttctatggggcaagaatatgctcagctgtgtgcagggagtgagggtggaggtgaggagtgaaggcctgaggctccaggctaagaagtagccaagtttcacctggagagaagagtagagggacttcccaaatttcttcctgaactcagctctgatactcagaaggtcagtctcacatcgagagataaggatgcgaatcaggacttggtaattgggctcagtttcctagtaggggaagaaagagatggggggtagttagtgagagtctcactgagagtaggggttgaatggcttggagggttattgtaggaaggggaggcaaggtgggagtcaagggataagagtgtacattatacattatctcgggacaaaagttatgtttgtccatcctcaaggaagatgacacagcaggaaagatcagtctctgtgggggcagcttgagtatttatttctttccacatgtctttcctgcccctaccattagcttagagctgtgtacctccagaatttggtggtgagcagctccaaagataggtacaccaggaaggctagaaaagatttggtgcatataaagactgccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaataacaggccaggcacagtggytcatgcctgtaatcccagcactttgggaggatgaggcrcgtggatcatctgaggtaggagttcgagaccagcctgaccaaaatggtgaaacccygtctctactaaaaatacaaaaataagccaggcatggtggtgggtgcctgcaatcccagctacttggaaggctgaggcaggagaattgcttgaacccaggaggyggaggttgcagtgagctgagatcgcgccactgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaractacaaaaattasccaggtgtggtggtaggcgcctataatcccagctactgaggagggtgaggtaggagaattgcttgaacctgggaggcggacgttgcagtragctgagatcacaccactgcactccagcctgggacagagcaagactccgtctcaaaaaaaaagaaargaaaagaaataacacaggtacaagtcatcaaaatcctgaattataattgattatactaagtaatgtgttgttatgagagatttttaaataaaaacttttaattgtaaaattcctgtgtttttttttttctgtgcaccagtgttgtcatcaattcctaatatcctcattttcagagtttcctgagtcactttactcacaagactcttcccagaactgcctacaacacatacttagggcatcccaatagatcataaactcctttgacaaaacaaaagaaaatgaagtaaaacaggatgctccaattcatttagactcattacctaattgtcagtggacctaatgtctacttcattttaacttttatgcatcattagttttgtattgtcataaagattgccaattgctccccagtatccattcttctcttcttccaacgcttgttactctaaagttacagaattgggcaagagtcactcattaactgaatactctcattgttgtacaagtattcttttttcttgctctgtcacccagagtggaatgcagtggcrtgaattcagctcactgcaacctccgcctcccaggttcaagcaagtctcctgcctcagcctcccaagcagctgggactatagcatgtgccaaacgcccagctaatttttttatttttagtacaggtggggttttaccatgttggccaggctggtctcaaactcctgacctcaagtgatctgctcgcttcagcatatatatatatggtttgtttgtttagatggagtctcactctgttacccaggctggggtgcagtggtgcgatctcaggtcactgtaacctctgcctcccaggttcaagcaattctcctatctcagcctcccaagtagctggaaatacaggtgcacaccaccacacctagctaattttgtatatttagtagagacggggtttcaccatgttggtcagtctggtctcgaactcctgacctcgggtgattcacctgccttggcctcccaaagtgctgggattacaggcatgagccaccatgcctggcctaattataatacttaatcgtatacctggcattgcatatggccctaggatcttcaccaggaacattaatttttactacagattggtggaaatttgtcctgaatcagccattgctgattttctgaaggttgtttttctgaataaatattcttcacaatttatgttttcatatatctacatatctctcataaaagaataatacaggctggacacggtggctcacgcctgtaatcccagcactttggaagactgaggctggtggatcacctgaggccaggagtttgagaccagcctggtcaacatggtgaaaccctgtctctactaaaaatacaaaaattagccgggcgtggtggcgggcgcctgtaatctcagctactcaggaggctgaggcaggagaattgctggaacccaggaggcagaggttgcagtgagccaagatcgcgccattgcactccagcctgggtgacagagcaagcctccatcttaaaaaagaaaaaaaaaaaagtttgccaccagcgtggccaacgtggtgaaaccctgtttctactaaaaacaaaaaaattagccggatgtggtggcgggcaactatagttccagctacttgggagggtgaggcaggagaattgcttgaacccaggaggtggaggttgcagtgagccaagatcgtgccactgcactccagcctagcgacagagtgagactccatctcaaaggaaaaaaaaagaagaagaagaaggccgggcaccttggctcaggcctgtaatcccagcactttgggaggctgaggcgtgtggatcacgagatcaggagttaaggaccagcctgaccaacatggtgaaactccgtctctactaaaaacacaaaaattagccaggcatggtggtgagcgcctgtaatcccagctactcgggaggctgaggcagaagaatcgcttgaactcgggaggcggaggttgcaatgagccgagatcgcgccactgcactccagcctggtcgacagagtgagactcgatctaaaaaaataaaaataaaaataaataaaaagaataatacagatgtatcatgattttttccttatttatttattttatatttgtttatttatttattattattattttttttttagagatggagcatcactctgttgcccaggctggagtgcagtggcgcgatctcggctcactgcaagctccgcctcctgggttcaagccattctcctgccttagcctccagagtagctgggactacaggcgcccgctaccacgcctggctaatttctgtattttcagtagagacagggataataccttgttagccaggatggtctcgatctcctgacctcgtgatccgcccgccttggcctcccaaagtgctgagattacaggcatgagccaccgcgcctggcctgtttatttattttttttgaggcaggtctcactttgtcacccagactggagcrcagtggcrtcacctcggctgaccgcaacctctgcttcccaggctcgagattctcctgcttcagcctcccaagtagctgagattacaggcgctcaccactaccccctggctaatttttgtatttttagtagagatggggtttcaccatgttggccaggctggtcttgaactcctggcctcaaataatccacccgcctcagcctaccaaagtcctgggattacaggcatgcgccacagcgcccagcccg

SEQ ID NO: 13407 - DNA, 25209 bp, Homo sapiens
ggataaaagaacccaagtatgagtttgcagcacaatgggaaaggaaagccttggagacaaagagagagggggcgacatagtgttgatgaagaggagcagccattgtaggttgtaggtcggggtcagaggaagcgtgaggtggttgttgaggagaattggcaagttcttgggatttccaggctttatgagtatttccagtgagtctgcacaggtggatgtatgattctagagggccacctttatgagactattctgtgcagattctttgttgggctgcccagctgtttgttggcctagcgcagcccaacgcaacccagccatagtctctgctttggccaatggcctggttgctgggagaaggatgggggaggcccagatgatttgtacagggcccctagatgacccactgcacctgtccccactcgcccccaggtacttgatatttcctaatcctgtctgccttgagcctggtatctcctacaagctgcatctgaagctggtacggacagggggaagtgcccagcctgagactccctactctggacctggcctgctcattgactcggtgaataatctcctcttgcccacaccaaccaagatggcagggcccgtggtgtgggacttgagggatagcaggggtctgtggcagaagaggcaggcccatggtggtgccagggtgggcaggcttgtggcagtgctaaggcaagtgctctggcaatgcctacgtggtcccaggtctgaactgcgatcttccttgctcactccttcagctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgcgtgagtgtctgtgatgtgggttgatggggcagaggtggggacccagcctgacttggcccaaccctcctccccacagcatgtcagtgcaaccctcaaggttcactgagttctgagtgcaaccctcatggtggtcagtgcctgtgcaagcctggagtggttgggcgccgctgtgacckctgtgcccctggctactatggctttggccccacaggctgtcaaggtactcttctgccccttgttccctcctatgcttctctctccttcccattactgttctctctcctccttctggacctgctgctggtttcctcaaactaagtcttggaccctctactctcaacctgggtcagttgtagttctcttccatttcctgaccttcccacctagactcccactactcacactcccctgagaccctcccccacccacactcccctcagaccccctcccctggctctggctcagctctgccttgctcctagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcwcacagggggtgagcactgtgaaaggtgagactggagcagctatgagtgggttggttggtgggcaggcttcccagggatgacacatttcttcttcctcctccctgcaggtgcattgctggtttccacrgggacccacggctgccatatgggggccagtgccggccctgtccctgtcctgaaggccctgggagccaacggcactttgctacttcttgccaccaggatgaatattcccagcagattgtgtgccactgccgggcaggctatacgggtgagtggatgggggcaggcrtgggatcagggtgagttggctgggctgagcactcacagcttcctcttaaccgtgggcagggctgcgatgtgaagcttgtgcccctgggcastttggggacccatcaaggccaggtggccggtgccaactgtgtragtgcagtgggaacattgacccaatggatcctgatgcctgtgacccmcacacggggcaatgcctgcgctgtttacaccacacagagggtccacactgtgcccactgcaagcctggcttccatgggcaggctgcccgacagagctgtcaccgtgagtatgagtgtgggagggcatggctgaattggggttctgcttcttggcctcctcttgactactgtgctcatcttggttggcacaggctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccwcccaagccgggccagaggccccacctgcaacgaggtatgggaccctcctgcagatccctggttagatggggccaggtgtctgtcttatctccagggcttagcctctkatagaggctctgaccctgccttgttcccaccccagttcacagggcagtgccactgccgtgccggctttggagggcggacttgttctgagtgccargagctccactggggagaccctgggttgcagtgccatggtgagggagccagcggggccagggtagatggaggacttcccagaatgccccacagtgaccctaactctgtgctctgctctttcttgcagcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcrcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggtgcggaagggcctaagaatacatggtgggatggggcagaggcccagtggaccagggctgaagcctctctaaacacccccctctccatcattgcaggcgtgaaattggggaggccactgagcacctgactcagctcgaggcagacctgacagatgtkcaagatgagaacttcaatgccaaccatgcactaagtggtctggagcgagataggcttgcacttaatctcacactgcggcagctcgaccagcatcttgacttgctcaaacattcaaacttcctgggtgagttgttagccaactaggcaggtggaccagggtcagtcttcagctgactgtctgcctctgcccaatttaggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgaggttgaagtgttgggtggggcaggtgggtgtagatgttcctctcacagggccctgacttgttctgtgcctggcaggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcawctcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggygcgattgcagagcgagtccggagcctggcagatgtggatgcgatcctggcacgtactgtaggagatgtgcgtcgtgccgagcagctactgcaggatgcacggygggcaaggtctgaccccatccctggcccctatccctgacacctggttttgatacctccaggttctgattcccccttctccccaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtgaggtcttcctaggacatcagtgggacaaggttatgggcatgaaccgtagatctgtgtaacctttggctcacccatggcaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcaggtgggttgaggcagagccagctggagaaggtaggggtggaagatgggcctccactgagctaccacgctaacctaaccctctacatctgcagctgctacgcggtcctctgggtgatcagtaccagacggtgaaggccctagctgagcgcaaggcccaaggtgtgctggctgcacaggcaagggcagaacaactgcgggatgaggctcggracctgttgcaagccgctcaggacaagctgcagcggctacagggtaagaaatggggcaccagagacacaagactgcgggaaaccccccctaaactgacacctgcccttcctagaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccactgtgttgtctggactctgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggtgagtggagcaggctgcaactcgctggcttggccgcagcggggaggccgcaacgcgcggccgcggcggcctgttcaaggtcacgggccgtgccagtccctacccctagtgccccgcagcgtgccagcccactgatgccggcagggccgttacgctatgcctgtggccagcctcccacctgggagaggactggcggccagcgagggcaacttcgtgggagaggtggtggcgggctcggggttcagaggctgaagctgggtcgcagctcgaccggggcgctgatctgtggtcagtaaccccgcgctgccatttcaggccggctcgggtctctaaacagccccttacccgcctcgacgtccctggggcatgggggagggacgcgaccttcggctggggcctgggtgcaagaaggaggcgycggtggcaggtgtcattaaagatccagcccaccagtaccacatctgacctgtagaagggtatcctgccatccctccttcctcctttacacacttaggggaacacagactagtcattatctgtcctgctactggttcaggccaggcttgaggctgccaggagtcctggatctgtggtcctccccagcctcatctcagtatctagtttcaagaccttcattttggaggaggaaacagtccagaatccactggtgggtctgtgggaaactgtagtggtccttgtggctcagagctcatgagtgaaggcatctgggaaggaaggtgataatttctgttccagtctcaaactggatgcccatcctgccttagtactggagcagggttgctgctgaagaggtagcgtgacatctagatacacttttcagtccctttctgcttgggacagcagctggggaraggactttctcttgaaatgaagaaggaccaagcagtacataggagcaggttcttgccaagggtgggagctggcaggaggcaggtggagtgccttagccccaggactttttctgggcaatggtagaacctgggttgagcctgtttacagccacagagcctggttctcctgcggcttgtctcctgtcctgccttcctcctccaccttctatttctccagtggtgactaagcagccagtgagagtgaaggaaaagtgagcaccctgctcggagtgccagccctgtgggctggagccgtggctcctctccagattggtggagtagcctggtcccaggccatgacttccttgacctggtgccccctcagtgaggctttcacctgtgtgggactgttatkgtgggtatctatgaggcttggccagaagtggttgctgctacttgcattatttattacctcttcagaatatcctgagagtgtccaggggtacttaagagatgagaagatacagctctgtagcattagtgtcctgtgttgctgagccctgggtgtagctaaagagcaagttgttgggtcttggcagtgatcactggcttctttccattaggctgtccgttccttgctggagaatttggccacaaagagytgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaagsatggagatcctaggaaaggtgggagtggcattcccagagtaattgtggccttctctgcctcccatcttattggtatacagattggggtttgggagatgactttcttgttcttctctctgtcctggtttgatgatgagagaagaaggacccatgataacctcagtagagcctcagctttgaagcctgagtacttggctaagatccagaagatggtgctgttggggggcttgccttctttcctttttaaacttttttcttttttttgaacctgttctttttttccttttttttttgagatggagtctcattctgtagcccaggctggagtgcagtggtgcaatattggctcactgcaacgtccacctcctggttcaggtgattgtcctgcctcagcctcccaagtagctgggattacaggtgcatgccaccacgcaaggctaattttttttttttttttgagacaatgtctcactctgtcatccaggctagagtgtagtggcrtcttggctcactgcgggctctgcctcccgggttcaagtgattctgctgcctcagcctcccaagtagcctcagcctcccaagtagctgggattacaggtatgcaccaccacactcagctaatttttgtatttttagtagagacggggtttcaccatgttggccagactggtcacaaactcctgacctcaggtgatccacccacctcggcctctcaaagtgctgggattgcaggcgtgaaccaccgtgcctgtcccttttttttttttttttttaaaggcagggtctcactcttgcacagattggagtgcagtgcaggtgtgatcgtagcttactgcatcctcaaagtcctgggctcaagcagtcctcctacctcagcctcctcaccatgcttgactaatttttcttattttttttttagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggtcagtaacgaatgggctttttgttgctagggaaggggagggggcacttgcaatttggctcccatctgaagcagtttcattaggctgggtctctgttacctgcttatcaccatcaggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtgtgtccatctgccctgagcacagtagtatgtttgaatcttctgatatctcctatcctacctcatggaccctgctctgtccccaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggtgagttctagtagtacagggttgggtagggataccagtgtagtcgacagggcctgactgctgtatctttggcagaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggtgagagctgggcacctgtttgggtgttaggagatggggggaaagggtgtgcactggagtgggagccacctggcagacccagggctgattctttccacaatcttgccattaataggttgaggctgatgaacagctttgcataccaccgctgaactcccaaacctgyctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatggtaaaggtgggggtgggcaggcagagccctaggttgggttgcaaagtttgtaggtggatagagagtagcaataggctggaacctgtcctggttggggctgagccatggtctcaatatagagcccgagtcgatggtgaacctggcgtttgtcaagaatgactcgtatgagaagggcccggattcmgtggtggtgcacgtgtacgtgaaggagatctgcagggacacctcaagagtacttttccgtgagcaggacttcacgctcatcttccagaccaggtgggtgggtagatgatggggcaaacaatgcctcaggtgggacagtatgtctcatgctcttcctcttgtccttcctcctatcctgctgtgcctctgcagggatggaaacttcctgaggctgcacccgggctgtgggccccacaccaccttccgttggcaggtgaagctcaggtgggtggtgcccggccccaccactgtgcctgtcctaccccgtgggctccatctccctggctcatctatcctgatgctcattcctcctaagtccctgagttcagccttttcccacaggaatctgattgagccagagcagtgcaccttctgtttcacggcttctcgcatcgacatctgccttcgtaagaggcagagtcagcgctgggggggcctggaggccccggctgcacgaggtctgcacacgagctcccttcattgcccagttccacgtgaccaggacccaaacccctgtcacatgctgctaaccaccagccctctcattccccctttttaaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcggtgagaattctggggtgggaaggacgaagaatggaggctggagagtcttggggctgttctctcatgtcgtctttgctcctgcagcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatggtgagggcagggcctggagcctgggttatgggcagagagagtgcctttgttcctcacacctttgctcggctactattcctagaccgctcctttgaggctgagatcaactacaacaacccactagggactggtgggcgtctggccattggctttgccgtgctgcttcgggcgctgtggaagggcacccaccatgccttccagccttccaagttgaaggtgatctgtgaccactgtcacccttggctggagggggcggggagggccagccagctgggtgtgcagtgggtgctagggcttcatgttcacaccttggctcctgtatccaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtcagggttagggacagagggtgggcatgtctcatgagcatcccagccccyggtactctttggttctcaccactctgcctctcaggtggtagctgaggaagcatggcagcggcacaagatgaggaatgactctttcatcgtggacctatttcaggggcagtacaagtcgaagctggtgtgccctgtgtgtgccaaggtgtgatgggctcccctggaaagagaccccctagttcagctcagctattctggtcacattaggttcagaggcatgtgcatcttaaggtgctacagggcaaggtttgggcaaagaagctggcagggaggccttaggattctatttgggctgaagagcccactcagggtaggcttcctgactgagggaaaagtgatgttagagctcaaaggtgttgtagcagggttgtgggcacatggggtgcaagtgtgaggccaattcgtaaagtggctaagctgagtagggctttgagtgccagaaagaaggattgttatttcctggtggtcctcctgccctgtctagtgtcctgaagcctgagagtttgctggttggctgtgggggccctgagagccatcagaagccccggaatgggctctctgagcatgagcatcttatctcccactctgtgtgcagctacccagtgccacctctacatccacaggtctccatcacttttgacccgtttctttatctgccggtgcccttgccacaaaagcaaaaggttctccctgtcttttattttgcccgagagccccacagcaagcccatcaaggtgaggagtaagcccctaccctctgggctgttctagagaacgtggcccacctccctcactgactgccctttttgccacagttcctggtgagcgtcagcaaggagaactccactgcgagcgaagtattggactccctctctcagagtgttcatgtgaagcctgagaacctgcgtttggcrgaggtatctttgtccttccttgggctatcacatgtgtggatgtgtgtgtgtactcaccacagacgtgtgtacagtcattggcatctacagacatacacatgggctgggcacagtggctcatgcctgtagtcccagcactttgtgaggccgaggtgggcagatcacttgagcccaggagtttgggaccagcctgggcaacttggtgaaacactgtctctacaagaaataaaattagctgggcatggtggtacgtgttatagtcccagctacttgggaggctgaggcaagaggctcacttgagcccgggatgtggaggttgcagtgagcagagattgcaccacagcactccagcctgggtgacagagtgagactctgtctcaaaaataaataaataaatagataaaaaaataaaaatagggccaggcgyggtggctcatgcctgtaatcccagctctttgggaggccaaggctgatggatcacaaggtcaggagatccagaccaccctggcttacatggtgaaaccccacctctactaaaaatacaggaaaagttagccgggcgtggtggcacatgtctgtagtcccagctgctcaggaggctgaggcaggagaatcgcttgaacctgggaggcagaggttgcagtgagccgagatcgcgccactgcactccagcctgggtgacagagtgagactctgtctcaaaaataaaataaaataaaataaaaatagacatacacatgagtatgcctgtgactgtacaaaaacaggcgatgtgctgttattttttctgtgcaacagaagtgccctcagttcctagccattatcagggtttattcccctttgtggtggtggatcccaactgcatttccctttttagacaaggagcttgagctgcaggactatccctatgttcgctctgcctctccctctatcctgctgctctctccttttatcccagttgtgtgtgctagctctccccaggggttcctagcctttagcctgacagtgttggttttcttaggggtaagagtggggaggaggctctttgaatgtggaccctccatgataatatgttacagtcttataaggctatgctagttatagcagggcagagtccctcagtgtggagagctggtgtggttgatatctgcctcacacctggtctttcaggccctctgatgcaccaggctccttatggcattgggcactgaracaggtgccagcagaggcataagcctatttggrcctacagacctcaccactgcccacataracccaaggcagggccaagccttcttaaactctggggcagggctagggaaagggcttatcctcacgtgggatctgtgtgttctctgtccccaggtaattaagaatcgttttcatcgtgtgttcctaccctcccactcactggacactgtgtccccatctgatacgctcctctgctttgagctgctatcctcaragttggctaaggagcgggtagtggtgctagaggtgcaacaggtgagtgggggccaacctgatggcacagcgccctggtgggtggggcacttcttcctggtcttgctgagccagacgacccacccwagcgcccccaggtgcccagcgtccccatctccaagtgtgcagcctgccagcggaagcaacagtcggaggatgaaaagctgaagcgctgtacccggtgctaccgtgtgggctactgcaaccagtgaggacccccatggtctcccctaccctttctttccaccttccatgtgccaccctgctccttcccttcacaccaaggcacatatgcttaagctttctacttgccaccctactttaccaggctctgggggaggcagggctggcgtacccagttcccagggactatgactagcccccagtatggagtcataggagatggggctaagggcctatccttgtcttcctcttcccgtcaggctctgccagaaaacccactggcctgaccacaagggcctctgccgacctgagaacatyggctaccccttcctggtcagtgtacctgcctcacgcctcacttatgcccgcctcgctcagttgctagagggctatgcccggtaagtgcccagtggttggactagagtggtgtaggtgggggcagaggtgctagatgggctggtcaggagtcttacttgcgttgttctctgttgccaggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcrccagtggaatttcttctgagatgctggccagtgggcccattgaggttggctccttgccagctggcgagagggtgtcccgacccgaaggtaagatccagtgaaaggctctrgaagctggggaggaggatargggaggatggagggggctgttgtttagggcctggtgggcctggtgaggccctgatgggcagggaagctttgattatcatgttctcacacagctgctgtgcctgggtaccagcatccaagtgaagctwtgaatgcccacacaccccagttcttcatctataaaattgattcatccaaccgagagcagcggctagaggacaaaggtgtctgaggctgtgggtgggagccatggggtgggttgagctggctgttctccacagctgcatgacctctytccctgcgaatctccaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtgagaacagagcagcaagtagataagggggcaggatggagaagagagagacttgctggtcctgacccaatctctgtccccaccaggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggtaagcagtggaccttggtaactgtgggtggggtgtgaggaccaggatgggcatcctgagcgcctgttgcctgtctcacccctccctgactggacctgacctgcaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggtgagggcacacacagccagcaggataggtggtaggggtggtggtgcagactttgttcacactcttcccaccctgctgtaggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggtgaggcatgtgggaggctttacagaatactgggggacagttcacagactggggccgggttgggggatatagcttcctctcctccagccacaggcccattgagccttgggattcatgagaattgcagagttctcttaacatcaragctttagccagaggcatccccatgccttggggacactaacaaacatacaagtacactaacatgctgccactggcaagcacattggcacctacttggcacaggtcaggcaactgctctgaacctcactgggcactatgctgtgaatgaactatacctgacactctcctagatttcctctgcacattccccacatgctggcccacacaccctcacttgtgatgtccctgagttctagtgtgcactcaagacaaggcctatttgggctggccatggcctctggtggctgttatactctttgaggtaagcatctgtctttgctgagccttcaggatcttctctttagtgacatggtgtgccataggcccagttagtgggcgtaggcacatctcttttctggactggccgtctcctttctggctccatcctctcttgagccttctctgtcaagcttagagaaatccttgcagaagactggtcaggatctgggtatgggtgggaaggagcaaggagattgctctgggattggcagtcctgttctctatgaatcggtgtcctttggggaggcctggactgaaatactaaccagataactcccctcccacctccatgcggagctgcatgtggattgagagctgtttagggtaggccaaaatgctgtcaagattctcttacccttgtgctcttactctggacagccctgaggttggctgcctgccttcctccttgctgtttgatctagaatgcagggtgttagccccagtcaccccaggtgggactgtcatggctaagggtctcagggacactgggtcctccccacccccggggtgctgatggccgtttccacataccctaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggcccaatctcgtctctctgtctcaacgccgctgctgtctgcgcctgccttgggaccctcccttgggtgccagggctccaagccagcacccccgggatgccaggcggcatgctgggcagcccccaacccctgtcctcgtattctgttgcagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcartgggaagctgaggggtatgatttgggtgtggagacctctcaggttgggacttcttgtcagcttggacccctgaccagtgggctttggcttctccagccgcctccagtgctgcgtgatttgattctgwtgtaccttcaattcttctgacccgcattataaacattataattttattctaaaaattgtaattttttttgcattttggaagtgactgctgctgtttaaatatattttaaaaataaataataagtaagtagacttagtgactgtgatccaccacatgctggggccacctcccctccccatcatttgcggtgtgtatgtgtgtgtatgtgtgtttatatatgagagaccctgaaagtgccctagtctgaagggagatgatggggtcccagctcatgtcctatgggtcatgaagcccccagtgctatcagctytttggagcctacctgctgctctttcatcccactggttctggatcctacataagaggcagcttggtaggcatcgtcaggatctcaatatagccaagggacagaggagtatatgaagcactggagctgacagcgtggagtaaaaggtgcattcaccagagcagcctggggctgacaagtcagggaggacttgggggacagaagtactgggagatcttcctcctcctctcctgtcctcagctttttctttgctgtaacttgaacactaactgcatccctgcaggtaacagagcaggaggaaaactgctgtggggcagatcttgctgccctgaaaagaggacaagcagagaggaccagagtgaatcttgtctgacttctattggagggagggtgctggggcctgccagcctgaagagtcttcccttaagagttcctgaagccttccttctttggccaggcatggggggctcacacttgtaatccccgcactttgagaggccgaggcgagtgggtcatgaggtcaggagttcgagaccagcctggccaagatggtgaaaccccgtctctactaaaaatacaaaaattaggtgcagtggcgggcacctgtaatcccagctacttgggaggctgaggcaggagaatcgcttgaacctgggaggcggaggttgcagggagccgagatcgcgccactgcactctagcctgggcgacagagcaagactccgtctcaaaaaaaaaaaaaaaaaaaaagttgctgaaactggccaagtgtggtggcttatgcctgtaatcccagcactttggggcgaggtgggaggatagcttgagcctaggagttcaggaccagcctgggcaacatagtgagaccctgtctttaccaaaaatataaaaattagctggctcttatggtatgcacttgtagtcccaaatatttcagaggctgagatgggaggatcgtttgagcccaggaggttgctggaccctacctctgtccattccacgactgggccttgctggctgctgcctggtttttccacttggtcatctttgtcttgacttttcctggaagcagtgccaggggcttatgcaggcaagctaacctccagactgggcccatacaatttaacatttctgctttgtgcaagtcgtagacatctagggcactagctggatatcgactggtatgctaccacttgtggcattcttggtgacactggtggggctactgcctcattctatgacttgtagccatggcgtccacagtgtaccatgaagtaaccagggaagggagtgcagatcttgatctcattgagggagccatcactagacctgtaggacttggtgatggtgctacagtgaatctattggcagcatcaggtactgaggaaatagtggcagtggcaggcactctgcatggctttgctcaccatgggcacctttatggtgggctgggtacttgcagcttcaaatttggtgcacggctggtgtggctatggctctgcttcttggtacctgtccttagcaccactggtctgcatcccctgcttaattcctgcacctggcctttctcatgcagtacactgcagggctaggcatctggctggggccacggggccatggagatgtgggaagccccaggacagcattggacctggatagcgatacagcatgtggccctggtctgcacctggcatgtgatcattaggtggtatccagatgtaggcccagacttggaggttggtcattaataatgggatgtgggcacaaaagacacagaatatagataaagactagtcaggatcctgcctattccttgaaggtccagaagtatgagcatcaccaattcctgcaagagctccaatctcaaatktggggatttccaccatcccaccaccagctgctcattctctgcaaccccctacctcagtcccttactaccttagtcccttttctcacacacacacaaagtctctgttctgtttcagccagcaggtcctggaagtccagtgagactgtggaaagatccccaagcacaacagctataatcatgaagctataaccatctcatttgtcccaccctctcacaagctcaataaaatatcctctcaaaggcctgcagagggatttcaaggtctaatttgcttgtggttttcctgataatgctttggcaagagggtaagtgtgggatgagatttttttttcttttctttttttttttttgagacagtcttactctgttgaccaggctggagtgcagtggcacaatctcggctcactgcaacttccgcctcccaggttcaagcgattctccagcctcagcctcctgagtagctgggattacaggcgtgcgccatcacgcccggctaatttttgtatttttagtagagacagggtttcaccatgttggcgaggctgatctcgaactcctggcctcaagtgatccgcccgcctcggcctcccaaagtgctgggattaaaggcctgagccactgcgcccggccaagattttaaaccaaatcatcatagaacttatgtgaggtccctcctggcccagacccgtcccttccctttcctggccagctgtgtccaagtgggcacctgaaaaccggcggacttatggggcccctggatcggtcattccacacattctctacgatggagtctggatgagggatttcctgggcttcatttgttcaactgtttccatgacaactccaaagctgtggcgtcaaaagcgtgacagggactcgcatttgcccccgaggacaattactatattgagatggagttaccagggctgaagtagaaaagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgmtcttcactagcytcggcctgagcgagcagaaggcccgcgagacgctcaagaactcggctctgagcgcgcagctgcgcgaggccgctactcaggtgcgagcccctctgcccccggcctggtttgcagaccatgctgcaacgcagcgcggggcggggtccagatcccgacctgccccrtttgtyccgccctttcctctcactgagcgcggggcttctctcttgacccctctgacctcaggctcagcagaccctgggttccaccattgacaaagctaccgggatcctgttatatggcttggcctcccgactcagggatacccggcgtctctccttccttgtaagctacatagccagtaagaagatccacactgagccccagctaagcggtgagacccctacctgtcctgccagttcgcaccaatgcctcccttcagccaagacccctgtcttccctttttgccaagtcctccagtttctttctagacacctagttctgcacaggcactgaggcatggaaggggtggcctatggtgagactgacacgggaactgtcagggtctgaggggggatccactctcgacacgtgcttctttcttccctgtgttctctagggtggtggtgccagggcttaacttttcaggaggccagactatccttggagtttcatgagattaggaccctgtctgtccacttcttggagcagagatgccacaaactcacgggctctttcttctcagctgcccttgagtatgtgcggagtcaccccttggaccccatcgacactgtggacttcgagcgggaatgtggcgtgggtgtcattgtgaccccagagcagattgaggaggctgtgagtctttccccaggcatcgtctgcctccccagtcctggccatggaaaggagtggctcagtttccctcctcaggaagacccagagtgagggtgtgggttcccagaatatctctaaaggtggctttcctgaaccacatggtttggctttctgcaggtggaggctgctattaacaggcaycggccccagctcctggtggaacgttaccatttcaacatggggctgctgatgggtgagcagggcctggaacggggctatattgttctctctggtcatgccttttcttctgggcacgagtgagaaggaggtgggggaaggaacaggagtgacttaaagtggtctggctgggctcaggctctggttctggtggtcagccaggacctttccttgggaaagaggtggggggagtactcttttttgcctttctgcagctccttgtgcctatgcttctaggagaggctcgggctgtgctgaagtgggcagatggcaaaatgatcaagaatgaagtggacatgcaggtgagcgtgcttcactaagctgaagctggcaaagactctggcatgaacagagcctggaatccactaagggataaaaggcaggaagagggctgggcatggtggctcacgcttctgatcccagcactttgggaggctgaggcaggaggattacttgagcccaggagttcaagaccagcctgagcaacatattgagaactcctctctacagaaaatttaaaaattagccagacatggtggtgtatacctgtagtcccagcaatttgtggggctgtggtgggaagattgcttgaatctaagagatcaaggctgcagtaagctctgattgcaccactgcactccatcctggagtacagaatgagaccctgtctcaaaatcaacaacaataaaaaaaggtgggagggggctgggcatggtggctcacacctgtaatcccaacactattgggaggctgaggtgggcagatcacctgaggtcaggagtttgagaacagcctggccaacatggtgaaaccccatctctacaaaaagtacaaaaattagctgggtgtggtggcgggcacatgcagtcccaggtactcagaagggctgaggtaggaaaatcgcttgaatccaggaggcggaggttgcagtgagcggagactgtgccattgcattccagcctgggcaacatgagcaagactccagtctgggcaacaagagcaagagcattttaagctagcagacccacatgagaagagatgggatgggctaggtaggttttttcagtcagtgctggtagataggccaggaagccttgggttggtgggtaggatyagtcaggggctccttgaaagaggatactcctgcctctgcctgattctggtctctgctcaggtcctccaccttctgggccccaagttggaggctgatctggagaagaagttcaaggtagggatgggcatggccctgagtccctgagggtgaggtgaggtatggtgagacttcaggctggggaaggaagtgtctgaccacagggatcccaagaccctatccaagagaaaatttgatgccattttctgaagcacctggggcttctttcaggtggcaaaagctcggctagaagaaacagaccggaggacggcaaaggatgtggtggagaatggtgagaagcttgagactcctgtcacagcattcagctccctgacttctgaacctcctcagaagagtccttacaggctcctcaggcccttggcttactcagtaccctgacttctgtctcaagactgggattcctggtgtttcttttgttccctttgcccagagactggcatgagaggcctcagatgtctggctctagatatcttgtctctggaattgagggaataggggtctaytcagttctgttctggctgtaggatatggtaaatgtatctagaggacaagttttccttgttttgttccccacaggcgagactgctgaccagaccctgtctctgatggagcagctccggggggaggcccttaagttccacaagcctggttagtgggcatgtcaaaaccctggggagggctggatcttggcagcagctcctatagtcaggcccctggggtcagaggctttggctgcagcctggtccttaggctta

SEQ ID NO: 13408 - DNA, 12854 bp, Homo sapiens
ccataatttctttgaacattccatatacctttatgtgcatatattctcatccgcccctagtccctccagaatgctgtatggtaacaagcagcatggctcctgggattaaaatctcagctggaagttgctgggccagagattatcaccagatgtgtctccagtcctggctcacaggaggaccactttctgattagctccacaggcagtgctggctttgcttgtttctgttaactccctctgcagagccagaggtggcttttcctgatgtctrtaatggtctggaatgggcagggaaccatcccatcggccacactgtctgtctgggtcaagtccacggtcattcagtgccgctggcattgttggaaagcaggaccctgggctgcagtctgtggagacctgaaacaacctgtgtcagttttcaaccaaagccccagcttggaaaaatgagaactccatttctttccagcttcagaaaacagagtgcatacctctttgatagtggaaaaaagatttacacaattagtttagatcaggtgaggacccactgaacccttgacccaaatgcaagctgaactttctggaggttcacagtttctaatttttcggttttcaagtgcttctgggtctcagccttgattagcagtagaaatgttgatcccttgcagggagagccatccctgcactagcccgcactgctgggagccagtggaatgagtctccaagcattcctgctcctgagcttttggcatttttggtcatgttttttaaacatgaggtactgatggaatatatttgcaaattagcatatttttgcctctgttcacagctctatttttaactgtatcatttatttacttgtctcatcaaaggcacagcaagaatatacccagaaccaagccctatccttggggacaaagagaaaacattctccccaccacccccagacacttgatcatgtaatcaktccttagaggaccttgttgggaggtgttaacagcccctgatgaagccatcagttaaacaaatgagtcaacctctgatctctccaggaacctaaaacagctcttgccatttggtaatgctgggaactcactaccttactaaaataatgcactaaacattgaaaatggatgagttgttgtctattcggacttagtctcaaaaatctkccattgttgtgtttaggtgagtgagtggcctccagcatctagaagtcgatatttgtctgggagtgtcagtcagagctttgtttcttctcaggaatgtgttcatataagcaacattgaaagcattgctgcaaactgagcttgaattcttctcacctcttatgtagcctccgaaatccaagggaaaatgctatcaatgaacggattcagctttcaaatgcctaacttctagtcatcttggcagtctgayaaatttaagttttttaagtgaatttgtcatagagtggggtttaggatgccaaatacataactcatttatatttattttttaaaagcttatgatcatcttcttcaacccataaaacatttttcgaatgacaaaacagaaaatgtatacttttataatccagtttttaaaaagtcaaagctatgataatcttgtcatttcagaaaggtaatcccagtgcatatttctccatgcagcttattgacgtaacctaagatgagaagacactactattcatgcctggtcagaaagcacagactggctatgtaacagccccagcaggraagcactgggtgcaagacactggattaaaytgagacaaatgtttgcttctcagaatggcagtgaccatgggtgcttgactgtgggtggggatgacagatttcatgctttcctctttcagaatcatgtctccaacctcctttgtatatggcgagtccgtggacgcagccaacttcattcagctggatgacctggagtgtcactttcagcccatcaatatcacccttcaggtacccactcctggagacctcctctgtccgtgggggctaacggaagggcacatgggatgtctctcctacagagggctaagctcttgtcaggagaaacccttctgtggttggctggtgtggtgtgtgtgtgagatctgtaaccacacacagaatgaatccttttcgatgcctggtactctgctgtgcaggcccctctgctttttcaggatttggaaggacaggtccacgtcatgaatgccagttttccccaagaagccctctgygtggtggaggcctcagccaatgtcccagcccagatgaccccatgaggacccctttctgttctccatcattccccaccttctgggcagggctgcctcagaggatttgctgtgtcccttcctcctgagattttcttgccagctcatccaggagcccactcctcctgcaggggaacagcctttcggaagggcagttttataagaacagaggagtgtgagyccctgtgagcccccacgggaggcacgctgctccctcactgagccatggctggcttgcccaggcacacaggcatcatttccagcaagtccacttggtgtagactgtggacctcatgaaggacactgtttcttctcttagttgggggtsagcaaactttttctgaaaagagccatggggtaatttaggctttgtgggccatttggcctctgcagcatctattcaaccatacttctgtagttcaaaggcagccatagataacacagaaacaaaattttagttccttatagacaatgaaatttgaatttcgtataattttcacatcatgaaatgtaggcccaagcgagaaaggatatcctgaaggtcccagagctgggagaagccgggctggggccaagacctggcggcactggccggaccctgtgtggatgaagtgaaggagatgggcccaactcacccataggacacaacagtccatatctcctcactctctggttctacctcccagaactcttctctgcctcttgcgtccttccccatggagagatggtttcccactctggcattcactgctgtggctaaataataattattttctttccttgtggcctctcctaggtggacttaggggatgacaaataatgacagggtgagggtctagagaatgtggcagtaaaacatttgtgggctctgacaaacaatggtcttcctctccccagagtattctcccagcaacagactgcgaaaccatgatacataacacatgtccccagctcacagaggatgtgccttctgaccaactaagcccctgctgtcacaccctgctcttgatttacaggggagaaagggaaggatggggttagagcttgtttttgagacagtagagtgattgctgtgaacagcacctctgcatttctgaattgcttctcagagttattttmtttttctcctttgcttttcgtaattgggtaggamatagataaagacctgatgggtttatttcatcttagttgtttctactctttcctactcttatagttttgggggtgtcttgcaattaaagatgtagttcagaaaattatttagaagggttcaagtaacacagaccatgtaatgaagagggtatgagtgttgaaagaaggaaaagaagaacaggggttgcacagaakataccaaatgttcttatcaccctctggggaacaaaagaaagaaatctgagggtatgcagcttatccttccagttgtttctctgaaggtaatttttacagtgagtttaaagtttggtattcaggcaaatagttttcttcacatctgacctgaaataggactcaggctagagaatccagccctggggaatgagtgattggcatgtcccttagataaactcctccgtgatccattgcctcaggaagtgcacagcattcaatccagggttgagagagttgggtctgaaagattgatagtgtgtgccattgattagaaggagatccttctgtgctagcaaagcccactttttccttgagaattgtctgactacttatttattggtataatggttgttattgtggttgtcctgcaggaaggtcactaaccagcttggcagtgataatgaccagaaggtgaaaatactgtggaaggaggccaggaatacggagaaaatgtttctatatttccttattccagtaatattgttcctgaaggagaacataagactttccatatgaacagatttttctatgcttttaaaaatcggttattcaacaagctacataattgtttaaaggctccactgccattgtacacaggagaaaggcagaaatactagycttgggcctgctttttacatttcatcatagtttttaaacagacacattaatttctcgacaataagaggcttttttggcatcaaaatttaaagcatttccccacctgaaaaacaatggccaaaaataatgcagatattacacatgaacatttgcagagaatccagtataaagacatttgtkaaaaataaagatggtaatacaagctcwcctgtcctcctggctctgatgagtgaaatagtgcaaatcagcatccttttcttcattgcttaccccattcatgcttgaaatgggatttcccagacatgccaggatgtttctttttaattctgtgcactcatgtttcactkcaaattagttatttcagctatggtcagatattccttccttttctatgtcttcaggttgtttggtgaatattgttcttttttgaatcaggagttggcaacccactcatctgctctrtcagttkttatctatttattctttgaagtggaaccaactattgcagaaaaccaaagacacagttttctagggaagagctagctggagctagatcttcatacatcctgtcatgtgtgaagacctggtaagatttctggctttttgttggctctgcccttctgacctcaacttcagagttgcagattccctggattctctctctagtgcccaggccaccaagcagcatgtcattccttcctctctcctacttatcctttttaaacatttagttttaaattgacaaaacttatatattttatattttactcatctttttaaaaataacacctttattgagatatgattacataccttaaagttcacccatttaaagcatacaattcaattattttaatatgtttacacaattgtgaacctgtcatcatcatctagttgtagaatatttttaaatttttttcattttaatttttgtgagtacatggtaggtgtatatatttataggatacatgagatgttttgatacaggcatgcagtgcataataatcatgtaaaatgggggtatccatcccctcaagaaatcccttgtgtttcagacaatccaattatactcttttagttactttaaaatgtactattaaattattattgactatagtcaccctattgtgctatcaattgctaggtcttattctttcaatttttttaatccattaaccatccccaccaccccccgccacagccatccccccattatccttcccagcctctggttagcatccctctactctctgtctgcatgagttcaattgttttggttttgagttcaattgttttggttcaattttgtttgattttcacaaataagaacatgtgatgtttgtctttctatatctggcttatttctttccttttttttcttttttttttttgttttgttttgttttttgaggcagtgtctcactgtcactcaggctgctggagtgcagtggtgcagtctcagctcattgcagcctcaacctcctgggctcaagcaatcctcccacctcagcctcctgagtagctgggactagagttacacaccaccacgcctasctaattttttttgtggagagggggtcgggttttagatacggggtttcaccacgttgcccagctggtctcaaacatgcctgcctcccaaggcttattttacttagcataatgacctccagttccgtccttgytgttgcaaaattttggaacatttcaatcacccccaaaagaaatttcggccttttggccagaaccaccatcttccagtaattcgccaaaatgtcgaacacaaagggaaagaggaaaggcacctgatatatgttctctaggctttttagaaaacatggagttgtttttttggccacgtgtatgcaaatctataagaaaggtgacattatagacatcaagggaatgggtactgttcaaaaaggaaggccccgcaagtattaccatggctaaactgaaagagtctacggtgttacccagcatgctgttggcattgttataaacacacaagttaagggcaagattcttgccaagaaaattaatgtacgtattgagcacattaagcactctaagagccaagatagcttcctgaaacacgtgaaggaaaatgatcagaaaaagaaggaagctggcggcacagtagctcacgcctgtaatcctaacactttgggaggccgaggcaggcggatcacctgaggtcaggagtttgagaccaacctggccaacatggtgaaatcccgtctctactaaaatacaaaaattagccggggatggtggcagccayctgtaatcccagctactcaggaggctgaggcagggagaattgttcgaatccaggaggtggaagttgcagtgagccgaggttggcccactgcactccagcctgggcgacagagcaagactctgtcttaaaaaaaaaaaaaaaaaaaagaaggaagccaaacagaaagatacctgggtccaactgaagcaccagcctgcaccacccagagaagcacactttgtgagaaccaatgggaaggagcctgagctgctggaacctgttccctatgaattcatggcataataggtgtctaaaaaatgaaagacctctggactgtttaaaaaaaaaaaraaaaaagaaaaatccttaacccattgacatagcttcttgtattaatttcttattgctgctgtaacaaattactacaacatttgtggcttaaaacaacacaaatttgttatcttacagttctgaagaacagaagtccaaaatgggccycgctgggctaaaaccaaagtatcagggcctgtgttcttgccagaggcaccaggggaaaatccacttcttgcctttgccagcctctaagggctgcctgcattctttggctcatggcccccttccatcttcaaagccagcaatggctggtcaagtcttaggatgttctctttctgatctgacttctgcctcttccctatataaggactcttgtgagtacaatgtgctcacctggataattcaagataccctctttattttgaggtcgcttgattagcaaccttaattccccctggccacataacattcacaggttccacagatgaggacatggacatctttggggggcctgtcatgctgcctgtcctactccctattcttcctgctccccagccctaggsaaccgctaatctactttctgtctctagagatctactcactttttttattcctctgcatattctgtttcttcctcgagtttcatgttcagctttttcctctccctccttgctcttactggtctctgygacctccatctttttcctcatttctcaggaaatgrttgacttctgaagacagaaaatggagaaatgctagggaaaacaagagaggcaaagttttatagaaccaaatgctgagacagaagaggggtacagttgtgcaagtgatgagctgcagattgcctggaaaccaaatcagctggctcatgtagtaaaaacagccctttctgtatattcgatcgcttggttttgggatgacccacttggtccttgagggcctcagttacctcaaactggcaaaggaaagaggttggaccagatctgtgggtctcaagtggtggttcctggaccagcagcagcagcatctcctgggaccatgttataaatatgaatctgccagccccaccctagacctactgagtcagaaactcggcatgacccccactccatacccccccaccaaaatgtgttttaacaagcccctcagatggttctgatgttttgctgaaatttgagaaccactggactagattatgatgtctgagttctcaccaagtgtaatagtctatgagtaaattcctatrcatgtaaaaagaaaagttttagcaggaagaagacaaaatgctgaaagagaatatggtartttcaaagtttgagatttttagatgcatgttagaagtgtttctattttgttgaaatttcccgtcattcagtagttcactttacttcaagttgtgaccttccagatccgaaccttagagtttctgtatgtgatttcaaagaatcttagaatatatattgcatgacaggaaatggaggtctgctattttccactgagacttgctgtgtgtgttccacacccacaggtctacaacactggcccaagcacccttccagggtcatctgtcagcatctctttccctaatcgactctcatctggtggtgcagagatgtttcatgtccaggaaatggtggtgagttctccatttgttttcactattgctttcagctttgagccagcccattcaaattttgtattccaccctaccctgacatccaccttgagggtttggaaaattcaactcattctaccctttggagacatatctggagaggccaggggacctgtgatacctgaatttctacattgagaccatttggttaatgctgtaagaagacctctttggagatggggaagagttaattacgaaccagctcctgggatggacttcgctggctctgggaacccccagcagcatctgcagttgcatgcgtctgaatgcattttgctgagtgcattttgcacagggaaagtgcctgcagtccatgttgagaggattgtgaaagcattgctctctataggggcacgtgaaggacattcagccaaagggacagtttttccatagatagcttgaaaatcagggcagcaaggccmhtatggagcaggtgaatatctgagccgagagttgaagaggacacagcccacagggtggaggttcagaaaacattgtgtgatggtgacagtaatttctggcattgctgccctctgggtcatgtggactgaaaaccagacgcatgtgaatgttgaatgtagaacaggtcactcctcccgagatgccagctcagatgttaacatccctcatgatgttccattccagttccatggcatccccttgtctttgggctctgctgacccagcagaagaaagccgccagtgttccgcacctatgatgtactatggttggaacttagcatgaggtgaacaaaccacacaggcttctggctaccctcttaaatattattaaccatgctgaccatgccacatttccccagcatctaggagtgttctcttcctagagcatgctttctgagttgttcacrtgaacatctacartgttgcaggagcctttttttttcctatgggcaaaatcatctattgaccaaaacaagacatttaagtcactcagattctgaaggtaccccaaaaccagggataccccttttcctctttactgatcatcgagccaaggaaaagccactggaagggacttgggctcacacttacaaatagctggcttgcatggaaggcattagaagtggtttcctgaagacctggacaactgcctggctatcgttctggctgagtggaccctcagatacccaagtggtgtgagctggctgcactctgttctttgggctctgagaaacaaatcctttggattttcaaaactatatttagaattttcataaagtctgtaacagacttggccctaggatggccaagtctccatctggatagcccagcctgtgatcaaaggctgtgggcatcttcatcgtatggaaaagtaaattcactggcacatctcactaagcaagtaggaaagctctctgtgttcttataaacgatcaccactgagcccagaatgacaacaagagtagaagcataaaagcgagtgcatgaggtgctgtagtgaagaggcgagagtccccagatacttgtttcagaggcccacagctggcacaccctctgccttaaagccctcggcaagggcctcctgtggctccgcccctcccttgctcagyagggcctgagaatgctcactgggtcaggtgtgattcagagctcatgacggtttccactttggccttatgggactttgaatggagcagggctttcattctggggatttgggtggcttggtgcaagtgaaattcagtcctattaggagaaaccagcactcattctctgtactgcactaggaggtgaccctttggcctggtggcattccctccccacccccactctcagccaccaccattccccaacctccaaaggctactgaacagctgggcaccagctggacatgttaagccaactgaagcagaaacagattataggcatggagggaaggctcatctgtcattcctctccacacccttgggaccctcaaattgtttctccctctctaacagtgcccttggtgtctgtattgcctgtgatcatcatccatagagcataatgaggawkggcttactcgccctatgggccctgggctgtcaccctacctacggacccacgtgtggcacagttttctgacttggttcagaattcatttagaagtctctggggctgcttctggggtccctgggcaggaccaacctgcctctagctttcaccaaagagtcttttgtgtttgcccaaagcatttcttgaggtccagctgtctgtaagtggagagtgtctggcttatatatgggaggtttttacggggagcctaatgaagtgtaaccactccaaactcccagccttggctcgtgatcttctttccttgtagctaatgtctctgagcccctctgctgtgcttgtatttaccttaaaaacagagccacggtggtsgcytgaggaaagactatcaattttcactgcttcccacccacgggggttgtgtggaccctactctgacttcccacagcacagaaaaaaaaggaaacaggtcactgtggacctagtgtctgtccatcaggaagccaggttgtaatgatcatgaaaataatagaggggaagaatgacagacctttctagtctatctgaaatagcaaaattacyagtaacaaatcattcttgatttgttcacaaacactggctcagcaagtacctattacgtgccaggctccaaggagaggaataagtcccacatctgccccagaactcactgtcttgcaggaaacagatacataaaatgccattgtaataccgtataacaaatgcaataatggaggcatgcccagaccccaggatgctacaaaggttcagtgcttcacaaaggaacctcttcaagtcagggcttagaggatgtctagttcaccaagagaacaggtgaagaagagaacattccagatagaggaacagtcaccacttgtgagtgtatgatgagtatctgctgtgctgggagctacacccggttctccattctgttwgcctagctcttatacaaataggcaagagtaagtgttccgtatgccttctgcagatgtacagcagatagatattttggcagaatgacagagagtactgaaccacagtcatttcctctgtcagtttgtaaattaatcactcttcttgggtacatcgtgtgtgtgctgtagacctgaaccttcctacctgctgacttaggcatggagaaggccaagctccctgtttgatactagagtctaactacatgtcatggacattgtcagcaaaccacccttggcctgctgcaatgagcagtagctactgacctccctagcttacttttttccttctattggacagtcattctaaaaaactcacctgatttccaggaataaaatgagtgagccagacagcttatgggaggcaggctgtgtccacttgctccttagagatttctttttgaagtgaagatagatcatcttctcaatttttcagaacagacctgaaaaattgaaccacttcactttattgccattcttctgcagaggcgagccgtgtagcatagcccctgagcacaggtctaagattgcaccaagataacacatctgtcacaagcttcatggcttatgaagggragagggtagtggtctttccaaagttaagttttactcacaatttctgaaggttcaatggaagagatgggagctttatctcagactgcaagcttcacttgatggagttaaaaacctgtatctgtgagcagctttctcacactggaggagaaggctttgggatttggctcttgttaatatgcaagaaggggaaaagtcagaaatgatagctaacagggagtgaagggctagaacttttattccaggtgaaagtactggatttttgaaagaactctagtgttagtccagaagagatataaaataaatatcrtaccattcattcctcctcctgcaaaaccaattgaaaatattggcctctctggcttgttgttttcttgctatggggcagtgattctaaagaactgacctgatttccaggaggtaaaattgtagggatgaatgataattttctaaggagatayatcaatgtctttgccatagggtaccattaggacattgacttcaatatggcatgaataccaacatctgttagaatattccaagttggtgccaggactcatattttagtaaactrtaaaatcttccctccccatgcttgtacagtagacargsctacccatgatgtacgatgggtatcccacaatgagtcagttgatgtgggaacttcaattaatttatagtgggactgctcacatccctatgaagaaaatatgcacctgatacatcactgaccataacagga

SEQ ID NO: 13409 - DNA, 13816 bp, Homo sapiens
gcatgtactcacttttctctcagaccctgcgggttcgagggctcaggtttttcttttaatgggtcacttttaaaagcagacagtgctcgactgaaagctagaagaccctagaaaaccacagttggtttctgtttctggcttttcactttttccattctgtgctctgttattactgggaggctcacatgagggtacctgtcaggaaagcacctaatatgatagagagagtttrcacaattggagcgataatgaaggctgccattacccggggtcccactgttcacatgagtttgttgggcactttctatacatgcccgaaacctgcccactttggacagtgccctgttctgcaggtaaggccctcaaggctcagaagctcagcaacccagggccacaaagtacgggagtaggagggtttgggtttgaccccaggtcttaggctgtgacaattgtgcagtgggccaggtgaccacccctgagtgtgggaatgcaagaacaggtcgataaayctttaggragcccaaaatttattttcttctggcctttaaaccagatttttactcctaacattgaagctttgtttgtttgttttttgtttttgtttttgagatggagttttgctcttgttgcccaggctggagtgcaatggcgccatctcgatcttggctcactgcaacttctgcctcycgggttcaagcaattctcctgcctcagcctcctgagtagctgggattacaggcacctgccaccgtgcccgaataatttttgtatttttagtagagacggggtttcaccatgttggtcaggctggtctctaactcctgacctcaagtgatctgccctctttggtttcccaaagtgttggaattgacaggtgtgagccactgcgcctgcctgaggctttttataatgcactagaaataatgtcagttcaatcatttgtgtgtttcaggtgacaaagttgttgtcacgtactccaaaggttatccgtgtggtggaaataagaccgcatcctccgtgatagaattgacctgtacaaagacggtgggcagacctgcattcaagaggtcaggagactgggggctcagagcgggactgtgcagtgagcatactggagggaattcctccttggggttttcatgggcaggttttggctgagtcttaggagctcagggccagagccgctgattgtgctgtattgggcggggctgctccaggcagggaagacctccagatacagtgctgagacactgttacaagaccagtgcaacttctctgggctagcttgtctcttgaactaggtttagcactggctgagcagtacttaactgacctctacctttgaatgtcatagtagaaacaaaggggcgtggatttgtcccacccgaggtgttcaagcagcctggctgggaccctcgagcagctgggacctgcatctggacctgggatgtgcttggattatattcaagttttcccggccacattgcatctggtgccagggagagcttggccaacagagggtgcatgtgagctgctgtttgtgaacagaactgattccttccagacgctgagtttggaaaaggggtgactcagaaattgccaaaggatttatgaatgtatgagtctgagaagcttaaacaaaaatctaaaaatctaggagcaaattttccaggttttgaaygttgcacggtttacaaattttaaaaaatttatattgaatgcttgcctgctttgtcacattactgatgtgtgcaccacagtcatcttccctgtccattgtggtgatgaaaagaagygagtaaaataaccaccctcgctccgagctgccgtcagtgttgagtcgggaaattctgcctaggcctgcgcagcccggggagtgggggcctcgggacccaactgaagtctcgcagcaccttgactgaaagccagtgagctgcttcaagggctccgcagtgttcattgttttgcagtcttcccttatgtctggctggggaagtgactgtagcctgtgcttccctcctcctaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagtaagtaaaaygttttccttctgagctgtgaaatgtgttcaaaattaaaccagcaatgccgctctttccctatyggggagcactgcaggataaataggtctgtgttttagttactgttgctggagtcatcgtcatcttttgcttaaactgaggaaaagcgttactcaatcattaagttttaacaccaaagatggtgaattctcatgagtgtaaaaataaatcccccgtccttctccctctcttcatgataatctcaggggttgaagccgaagccttctgacatgtttgagcaggaatcttctgggcttaccagtgtttagaaaataagtttctcagcagtgttactggggctgctcttgggggtggtggccgaggtgcacagacagggcgagggccgtgtggtgctggatacggcacctgaggaaggtggattagcactcagaggccagaactggttggggagaaagcctcttgagagggaaactggtgtcctcagaattgctgtggggtcacagacgtgctgcyctagcgtgtccgtscttcctttccctaggaaaggaagcatcctggggccctgcagtgattctgaggactgagggtttatgtcatgaatgccttcttgaaggacttccatgtcactgtgatcttttctgtctcttcaggctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaaggtaatccgtggcttcccacaaagttccacatttaacttcctccaaggaaggggattaaaattttcaactaactcccttcagttgaaatctcggaccacttttaaaacaaaaacywtggtctaattcttkactttgttatgaatttcttgacagtggattgagcgatacgtgtcagaactaagcatttcactgtaggcaaattgtgtcttagttatcaartaaatgtacaaaaaaactaaaacctggtctgatccagtggttctgaggttgggtggaggctgagctgtgcacagtcagaattgcctttgatttggttttaaccatgacacttccttattttggaatgccaaataatattagagaagggtaagagattttatatttgtaagaaggatgaaaggaaactggcctaaatgttaggatgtaggttaaaatcaaccaggacgcacatagggcagagtccagggtgtgaaggaaggttttaaactggcactaataagggtgttgccctttgttccctcacataatcgtgaaaggctgcttttgttttgaacagctagtcttaactatatacctttcataatttgatttttgaaccgtgtgtggatgtaataactctttaaaaaaaaatgaagtgtgtttaaagaaaaccccagcctgctctgatgtcaaagagctgccgatcatgtcctctgggaggggagagtagtgatagctgagaaggagcaggtgctctgtgccctggtgctgagcacattgccgagaaggagcaggtgctccgtgccctggtgctgagctcatcgccgagaaggagcaggtgctccgtgccctggtgctgagcgcatcgccgagaaggagcgggtgctctgtgccctggtgctgagcgcatcgctgagaaggagcgggtgctctgtgccctggtgctgagcgcatcgctgagaaggagcgggtgctctgtgccctggtgcggctgagaaggagcgggtgctccgtgccctggtgctgagcacatcgccgagaaggagcaggtgctccgtgccctggtgctgagcacatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctcygtgccctggtgctgagcgcatcgccgagaaggagcaggtgctccgtgccctggtgctgagtgcatctccacgacggcagcacctgatggagggaagctgggtcagcatcgctgctcctggtcacagattgtagacagcgccctggtgcatctgctcatagcacctgtggcccctgaatagaactgggaaagtgaatgttctgctttctgggtgagttgatgatgggaaagttgatcagcctcattcacttgcataactccacagcacggagctagcactctgtgtttctctgttctctgccttcctcacacttcggtgaatccttcagtcattcagaatcagatgttgcatgtcacargttgtgccttctcttgctgtcctctttcccagtgctcggtaaatcttgattaaaggaaggaaggaaggattgtttcagaagccttcagggrccctatcatgcagagaaggaaagtctaggctctctctgacacagcttgaagatgtctgagaggctcccatgtaccagggtagccttgcaagctgctgctcctacacatgcctcagccatcaggttattcactagttcccaaagtcaccctgtaacctrgtgggtttacatatgctgctcttggtgctggaatgccttggcccaccttcctcatccttccaaacctacttctagtgcccctcctgggaaggcccaccttctcatagcagggtgacaccgctggtgtgtctgcaggattccaaacctacctccagtgcccctcctgggaaggcccaccttctcatagcagggtgacaccgctggtgtgtctgcaggattccaaacctacctccagtgcccctcctgggaaggcccaccttctcatagcagggtgacaccgctggtstgtctgcaggattccaaacctacctccagtgcccctcctgggaaggcccaccttctcatagcaggtgatactgctggtgtgtctgcaggagtcttcacgctccatcgcgcagcactggccacttgtctsgttacacataagacctccacgttcacaagtggtatgtctagcagacctttgaggatccccagctttcagagtgcttgtgcatgcgcatttagtcattcttggtaaataaaatccctttcagaccttttcactttcttcattcaccagccccaggaagtagctttagttttaagacatcttttcatctttcatgaagaaatgaagtttctatctcttcctgaggcttgccawtccttcgggagggcagagctgtctctcatcaggacgtggagctgctgggcggtttgcttccccacatcagccctgtggaacagtccattcagcagcccctgcttcagctactcccaagcgagaatgtggggccctcccggagcggagccrcaccgcctgtctctgggccccatctgtgtgtggacatgtccgtctcctaccctgcactctcgcctctgcattcctggcacccagcagcaccagccacaaagattttcagccagtgacaaaggttgggagcagcagagttcatgcaaggagtccacacaagggttcctcacttctgacagcaacagcacactgaaggggttcccaagccaacttcagatttaccctttcaccataactcacagagctccctggaagcagttacacttatagttatgatttactgcagcaaaaagatacaggttaaaatcaaccaagatgcacacagggcagagtccaggagggaattgaatgcagagttcccaccagctctcccgtggaatcagatgtgttgtgttcccagcacccacgtgtggcagtgcacatggagtatcatcagccggaggtgcttccccragccttggtgtccagagtttttcccggggctctgacatgggcaggattggtccattgatcactcaggtactgcatggccagcccctgctccgtatcctgtcattagccaaggagcaaggccagccctctttttgggcaaggttaaattcttgccttccctcttgttgccgttgcttctgttcctggaggagctcctggcacagtgatggggtctcaggcctccaccttactgcacgatgaagagtttgaggagatcaagaaggagactggcttttcccacagtcaaatcacacgyctgtacagccggttcagcarcctggacaaaggagagaacaggacgatttccaggggattccagaacttgccatcaacccagtgggggactggatcatcaatgccttccttccagagggagaggaccaggtaaacttccgtggattcctgcaaactctggctcatttccaaaccattgaggataatgaaaagagcaaagttgtgaatggacctgaaccactcaacagccgaagcaacaaactgcagtttgcttttcgactatatgatttggataaagataacaagatctctcgtgatgagctgttaagggtgctgtgcatgatggtccaaataaatatctcagataagcagctgggcagtatcgcagacaggaccattcaggaggctgatcagcatggggacagtgccatatctttatcacagactttgctaaggttttggagaaggtggatgtagaacagaaaatgagcatctgatttcttcactaaaggacagacagcaaactattccttgcagtctagtatttaagtactggaacttgacagtcctcctgtccaccagccctacctccaccccatcattccccttctcccaaagtactactgctgttgcataacaaccccaaatatgttctgtcaacacaaacctgcttttggtctataaacagggcgttacagaatggtacacccagtctatttcttctcagtatccattcgccagttcttcatttataaatatcgtcttcctctgttctgctgctgaatgccacacatccatccagtctgagaaagtaagatagggaatcctgccgaggaacaagccagcaaagctctttcactggatgtagactgcacctgctgccttccctctggcgagtctgccagcatgcttctccatcctttttatatgtcctttgcttcccacttctgtgtacattcaacatactgttcacgtagtcatgcagtctttctgctttttgtgaagcctcagaatctcctctgttctacttggcaccccaagctatgcctggtattgtatttctgacttggctcgatagttcggtggtctggcagtttttatctaccttcattattaaaaggccctctggagctgggcgtggtggctcacgcctgtaatcccagcactgtgggaggctgaggtgggcagatcacgaggtcaggagatcgagaccatcctggctaacacggtgaaaccccgtctttactaaaaatacaaaaaattagccgggcgtggtggcgggtgcctgtagtcccagctactcgggaggctgaggcaggagaatggcgtgaacctgggaggcagagcttgcagtgagccaagatcgtgccactacactccagcctgggcgacagagcgagactccatctcaaaaaaaaaaaaaaaaaaaggccctctgggatgttgcctctccaggagctttttggtaaccaacacttctctcgggagtatgagatcatcctctgcactcttctctgtcatcaaagggctgctgggtggagatattcttgaaaggtggccttggtgagaggtgtggagtcaagtcttttaggttgcttgcccacgtcactctacctctggcctctgattctcaactttgtacctatggggcgtctcttgttagtgcagtgttgactattcaaaaagtagcaatatgcctgcagatttgcttagtcttgggacacggttaccaccagaacggctgctcagacaatatgcttggggactttctcatggctttttgaacaaggaggctgcgcaccctgtgaagcctcctgcattcacacctctgctgcatggtttatgcctcagtgttatgtgcactggaatgcttttcactatacgtttccaagttagaaagattagtgttatggaagtgcctaatgtatcctagtccaaaatatttaaagattgttctctgtgtcttgaagttttgcacaaaattctttatgaattttacacttggcaaatgttaatgctagaagccatagtccgcttcttatacaagtccaaagcgttgactgttgtatcattagctccctggttacactggtttcccagctccttgtgtagaccactgctaatcccttagaaacaagaggtctggcactagtagcacaacctaaggtggcattccaagtctttaagcaagtcacagcaacttttctgccaaagtcagcttagtttagacttcagtgaatcaggctgttgccatcctaatgtatgtctctgtgagtctgttcattcacatatctgccgttggctgactttcttgactcgctgcttgcttgcttgtttccttgctttggaaagctattgaagatgtgtacataattctttaggaaggggattgctaaaaaatacactgcaaagcgatggaaaacagtggagaacaggggagtagccaggctggatggctcaaatataaatgaatgaggaattctttatgaagtgtcagttggactttgtgattgagtgatgtaatacaggaattatatagaaagggaagaatatctgatactgatctgttagatacttcagaggctccttgatttgcatatttaaagttcctaaaattgtagcttttcccttcttttggctgtacagcagactgttttaatccacggttgtgccttattgttccattaaaattgtgtcttcagtccatcaataaatactcgtggttaaaacaaaacaaaaattctttactgcatgctgactaagggcagggctctatccatgtgcatcgagtggcctcgtaagctgtgaacagagtgcctgtgggaygtgggatgaagtctcttctgcctgattttaagtctttgcaaactttttagaccgtaaggagctaagctcagtctgctcgtgaaaaatgatggtgacatgccatgtgtgcccttcccgtttgacagayggcgatctygatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctggggtgagtatgacatccggaagcttagcacttgtaccccacatcttcccttaagaataagtgtatgtgtgttttttccccaatgttttcttgtgaaatattcagaacatgcaccaaaaaatagagaaaatgatagaagcggaccccacatagtcagtgccccgctccgttgcttgtcagcatcctgccrctgatttttggtccatggctgcgtcacctcccaccacccccagyagcagtgccattgtttcctttgtgtgtaccatgccccgaatagggtccagtcagggcaccccagctctgtccctctacccygttcccattkctgcctccctctccttagctcctgggaggcaagtactggtggtgcctcctctgtgtaatcctggaacatcttttgtgtcgtaatacaaatgattgtttggtaaagtttcactttgatttgagtgcagtatttttactttgatttgagtgcagtatttttacgtttgtttgaatgaatgaaaagcttactctccagattttgagaatcagcatgagaacagagggagcagtttctgctctgaaggaaggtggcacctccattggttgtcttgtgtcccacagccgttttatactttgccacgaataacatgttgtcagttgctttcctcttggatttattttcttcttaygttacccccacccatcattgkatttatatttatttttaytttttatttttttgggatggactcttgctctgtcactcaggctggagtgcagtggtgcggtcttggctcgttgcaacctctgcctcctggttcagacgattctcctgcctcagcctcccaagtagctgggattgcaggcatgtgtcattatgccctgcyaatttttgtatttttggtagagatggggtttcaccatgttgaccaggctggtcttgaactcctcacctcagataatctgcctgccttggcctcccaaagtgctggcattacaagcgtgagctgccatgcccggcctggcccaccattttacataagcttttcattctctgtcctgagactttaagattgggggaacatgaattcttgccatgtaattgtttccttcatgtcctgaaaaagggaccgtagagtcagcagacgacagtggtgggggtcatgggggaatgaagatcacacattttacatcttaaatcagcactccccctgcccacccttaacagtggacatgagctcagcaaaaaccagctttgtcctgtgctgttcaggcctgtgtacttagggatcctcagctgcacagtcagggaaagaggcttttggttgaaatttcacttgtggtattttcagcttttgaatgtttatggtgttccggtgacgtcattacaaaatgaaaggattgaaactggaagttcttcctgaaagaagcaaaatgtgaatttttataaaagataaaacccagaagtgaactttccctgcattctctgtcatggagaggctacagctgccatgagatgaatcctgcctcctgacatggcagctggtcttctgtgtgggtttgagggaccaggccaggctaggatcccgtccatgttgaatgtttagagttcgacttctgtgagtaggaaaagcacygtttatagggctttggtgtttgactctaaaaccagagaggaagattctccaggaaacctcggtttcatgatgttcagaacatcaggattgggagctgtttaaatcccttaacacactgacaaggtaataaggactttaaaaaaaagaaacagaagttgaaaccaagagcaaaaactcagatggtggattttgagggatgcagktaccacccgggggtgacgtggaatagtgcctgagatttttttttccccaaatgttatcagtgttgtacattgtagaatcatgtaaatatggccagacgcggtggctcacgcttgtaatcccaacattttgggaggctaaggtgggcggatcacttgaggtcaggagttctagaccagcctgggcaacatggtgaaaccccgtctctactaaaaatacaaaaattagccaggtgtggtggtgcacacctgtaatcgcagctactcagaaggctgaggcaggagaattgcttgaacctggaaggtggaggttgcagtgagccgagatggcgtcactgtactgcagcctgggtgacagagcgagactagatctcaggaaaaaaaatcatgtaactataacaaacaggtagcaatgttcgccctaatagattaccatttttagttcttttagctatttcttctggaatttacctcagtattttaaattaacatcctatatctcatctgttgacttcctgcaatagtagatgaagatagagctgtcttacaccttcctcctactttacaaaaatggttctttcacaatatttgattaaagtcaaaaaatttacacaaagctaaaagacaggcatctacagatggaaggggcaggctatgtgcccagcacagttattgatgacaagacccacccacttatgaaataccaggagagcagatacaaagaaaagactgtaaaagctttaggggaggctaatttgttgtattagaaaataattcaagaaaggttaaaatactttaaatcctcactttatatcatcgataggttcttggaaactgcaactttatgtgaaatgatgtataatgaaaccagttttttttcctcagctttatgttatgttatgttatgttatgttatgttatgttatgttatgttadttttttgagacagagtctcgctctcgcccaggctggagtgcagtggcgcgatctcggctcactgcaagctctgcctcccaggttcacgccattctcctgcctcagcctcccaagtaactgggactacaggggcccgctaccatgcccggctaatttttttgtatttttagtagagacggggtttcaccgtgttagccaggttgatctcgatctcctgatcttgtgatccgcctgcctcagcctcccaaagtgctgggattacaggcgtgagccaccgtgcccggcctcatcaactttataatgagacagttttgaaggaaatgatgtcattcraggacctcccatagtcgcttcayggaaggttgcagtttgaaggaaactgtcagcgaccctatgaggacacactgtactggacaacagtggtgtctaagctgagaggggtggcagagttcccagcttttaaaatttcttacagtgatagcatcatatgaaagtaaaaccattttcttgaaagaaatgaaggaaggaagaaaaggtagagttcctaattgtttggaagacatactgttagacttcctgtcttagtatgcatgccagtattttaagaataaccactaaaataatataaatatagtatgtaacttccaaaacagcggagaagaaaaggagaagtaaaaatacttaaatccccaaagaagacaagcaaggagaaaaataaaacaaaaatcagataagtagaaatttcagcccagtatggtagaaataaatctaaatatatctataatcataagtatagcttgactaaacttgtcagctaaaaaacaagttgtcaaactggatttcaaaaacaactctgtttacagggaacatgcctaaaacaaggatacagaaaagaccaaagtcaaaggagaagaaaagatataccagaaaataatctgaaagaaagctgcagtagttatgttaatataagataaaataggatattaaagaaaaatattagggataaagaataaagagggtcattataattttaaaagggctaatttcctaggaagatacaagaatcctaaacttccatctacctaataaaaaagccttgatatgtaaagcagaaattgacaaaaccacacacaagaaacaagcctagtgattgctgggttgagtagacaaagagtaaagctttttttggaagattgagacagcacagtgaaaagcaagatttaatagacatgcgcagaacactgttccctgcgttgggagaacactgtttgcccaagcttacatcaaacacttagaaaactttagcaaaaattaaccacaaagcaggcaagtcagcaatttccyttttttttttttttttttttttttttttggagacagagacttgctcttttgcccaggctggagtrcagtggtgcgatcttggctcactgcaacctctgcttcccagattcaagtgattctcatgcctcagcctcctgagtagctgggattatgggcgtgtgccactacctcc

SEQ ID NO: 13410 - DNA, 46752 bp, Homo sapiens
cgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaartgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatrcattccgcaaatcaaaatatcttgatggataaattatagagcttaatagatcttgttttatttcatccttgttaatyttgtttaatatggctgggcatggtggctcacgcccataatcccagcactatgggaggccaaggcaggaggatcacttgagttcaggagttggagaccagcctgggaaacatagtaagaccttgtatctactaaaactaaagaaacmattaggcatggtggcacatgcctatagccgcaactactagggaacttaaggtgggaggatcacttgagcctgggaagtcaaggctacagtgagccacgattgcaccactgcaccccagcctgggtgacacagcgagaccctgtctcaaaaaaaaagacaagmtattaacatgaacatgtaggatatctgtcctacttacatgattaaacaaatagtattatgtaaaaagatactagaaatcatggagatcctgggttctcagaatgggaccagtttgtcacactatgtcacagtatgctgaaatttctggttaaatggtagaatttcagaggtggaagcaaaatcggtcatcatatctagctcctttgttttacagatggagaaactgggatgggaaagtacaagagaaagtgatttccctgagctcacaaaatgaataaatgacagaagtgaaccttgaatccagtcctcgactccctgttcaagtctggcacttctatttcctccagcctctagtcagttggctttataatagagcagccaaatgttaacttagtaataagaagaaaagggctagaggcttcggaggtaaaggggctaagactcatgccacctgtgttcttggtcattaggccgcattccttaggacataggcatttggtgagatcgatgcatgtttgccaaagctgttaaggccaaatacccagattaaaaggaatttggagcctaatggattctgaaggaagtgcttactctgttctccatggaactggggaacttcaggctgccaggactttgtataggatagtgttttcaccctaatttgcttccccttctaggcctcttggcagcagaagcatgtgagaccagcttgacctccatcttcccagattgtgggttatggtccagaatcttaccaagtaattaaggttttctggggttttgtggcaaagttcagctggcagcggcaccaacgaaaagtgcatttctttttttttctttttttttttttcttttttttttttttttttgagatagggactcattctgttgcccactggagtgcagtggcgcaatmtgggctgaccgcaacctccgcctcccaagctcaaactattctcctgcctcagcctcctgagtagctggagttacaggcacatgctaccatgcctggctaaaaaaaagtgcatttccattcaacaaatgcctgtacacaagaccatgtaggaaataacaagatgctaggaaaagggttaaagtataatcacagtcctgggccgggtgtggtggcttattcctgtaatcccagcactttgggaggctgaggcgggtggatcacctgaggtcaggagttcaagaccagcttggtcaatgtggtgaaaccccgtctctactaaaaatacaaaaattagccaggtgtggtggtgggcacctgtaatcccagctactcgggaggctgaggcaggagaattgcttaaacctgggagacggaggttgcagtgagccaagattgcgccattgaactccagcctgcaagaaaagagaaactccatctcaaaaaataaataataagtaaataaatatatatatatataatcacagtcctgtgatagaaatgctaaatgaggaaggraaatttggtgtctgctggggccttgaatgatgcaataactagctcatatttattgactgcttactgtaagccagtgattgtgctaagtgctctatatacattctcactgaatacscttaacagttctatgatcattagcccccttttcttgataagacactgagcctgagagaggttaagatcacagagttgccaggtggctagggaaaacccttgttttgacactactttctccaagaaacctaccccacctcagttcccttccagtcctaatgttctggattccactcacatgtggtctgctcccacttccccgctcctctgcycttmcagccactttgctggctcctctgggagcacagctttcattttgctttgggaaattgccgtgttcaccagctgtcacccctgttgctgtgggggctgctcaggggcagggggcttgtctgctccatctctggttcagggcacagcacagagcagctcacggtggttgttgctgaactgaagcgtgggcagaggcccttggaatggctaaaatctgctgtttaggtttatgggaatgtgaagcccgttgtttakaaaacacagctctatctccacatcctaaattgagaaatgatttctgttataagaatcagcccagcactgggcagcttgcagtctagctgggagcccagaattgcacaaaacaaacctgagaattgtacaggctggatctagggcctcaagtgatgtgcagtggattcaaaaggggcgtgcasagaggacagtgaagggggtgtgggcaggagattccgagactctgaccaagatgacatggggacaaagccctgtggattcagcctcctaaacagctttctcctctgcccctccaccccatcaccattagagactcatggtcattgtacccacccccacatctgattgctgtacctgcctccaactgcagggccctgactcctgtctccctctgatccatattccgctctgcttccaagctctggtcttgggtactttcaacggttattctgcattatccttagctcagtatccttatgggacagtcccagtccgcrgggtagccccggcttctaggcggtggcatccacatstgctctgcccggagctgatgcaggtgcctcatggggggcgctctggggaccgcgcagaaaatttacgagcagtgtggaaatatacctgttgggtaaaagacaaactaggcgtgtgtttaaggcaccagcaaatgactatttagattaagaatttgttgtagaaaattttattgaagtgatgacttcmaaatgtgattttgrgggcattatacacttgcttcgaggtttaatcttcaatccacatggcggggcaccataatctctggtgcccagggccctcgtctagcccctgtgaggccctttgcggtgcctcccttgccagcccctccagcctccgccrtttgccccctgggctctccagtttccactgcccccctgcccgagcscagctccactgctgtgtgacctggcgtaagtcccttaaccgccgtgtgcctcagtttcctcatttattaaaagaggaggttccagtggtatgtaccccctaacgatgtgcgagcatcacagaaatgacacgagacacacactcakaacatgccttggcgtggcaagtgctgactgttgccattattaggctccccagccggggtctcagggccttggcacaagctattccctctgcctggagcactttcctccactgacctttcctggcgctccaggtcaactccaggagccttcccagtgcagtctaggtgccttctccttccgcagcgcctgaaccacacaggaataagtaaggcgagagcgcgcccagggaagagcaggtgtgcagaaagggactgagtcagtcgagacgtttccgcggggatccttctcttggcaggcctgcaccggggccgtggggactgagaagatgtgcacaggtggctcccgagtgctcgggaagggccccagagcttctggcccagctggaggcaggaggcggagcctcctccgcaaagctggatcagtaccggggacgcagggcgcacagctagggctggcgggggcggcccgactggggcgctgcctgggctcacgcgggagccaggtgggggacgcagggagaagcagccgagcaggtgccgagaaggaggcgcccgcagaagcgcatgcaggggccacggggaaggcgccaggaggcggtgaggggccgcggtggccggaacccgggccggctgctgcgggcagaggaacaggccccacccgcggggcttggctggcaccgcccggctctccagacggggctacggccgcgtgtcgggcccggtggcgaccacggcacaccacggcgaggcagccgggtggcaccactggcgggaccgggacggcgccgcggccttaggatctctgcgccgaggcccgcggcgggagccacgacggccctgaccacgctgacgcccaggctgcgggctcctcgcccggaccaaccgccagccacgccgaggtcgcacctcggggtcgccccaccygcaacacctgccgccgcccggggctcctagcgggcgcggcctccgcgcccaggccccgcccccgcgcccccattggtcagtcccgggggtgggcgggcrgcacagacggctgagccggggcaaggactcgcrggaatcgcgccgcccgggtcgctgccggagctcgccggtcgcccctgcgctgcgcggaccgcagccacagccggactggtgggaacggcggcgacagacggattggctgacagtcccagccctcagaacagccccggcctcgaagcgttggcgtctgcgtccgcgtcagcgtccgcttgtcccggagccggggcaggtgcgcgcggggggcgctccagggaccgcgctgaggccgcagacgccgcccgccgagccccgccccctgctcgccgaactcagctccccgttcgccgtcggggcgtccccgggcccaggggcggcggcggagctgatgtgcgcccgmtgagcgcccccggcccgccatggccgcgcgccccggmccgctctggctyctgggcctgacgttgtgcgcgctgggcgggggcggccccggcctgcgacccccgcccggctgtccccagcgacgtctgggcgcgcgcgagcgccgggacgtgcagcgcgagatcctggcggtgctcgggctrcccgggcggccccggccccgcgcgccacccgccgcctcccggctgcccgcgtccgcgccgctcttcatgctggacctgtaccacgccatggctggcgacgacgacgaggacggcgcgcccgcggagcagcgcctgggccgcgccgacctggtcatgagcttcgtcaacatgggtgagtgcggccgcccgcgcggggaccctcggagtaarctggctgcaggggaggkgcgcgcatccgcgggcggtgccgggccstggccgaacggggartcacagacggtggacgcgaaccacagkggagtgggacygccgtggttagggaaggtctaagggtcatgggggccccctgggctgcggrgtggtcaggagcagagtgtgggggactgtggactcccaggcgctgccttcaccctgccccaracacacccaggagtaagaatyagrtgatgtctttgcccacctgggctgccccgggaagacagcctggtcctggggagacaggtgagtaaacagaggccgggatgctgtcactgtgataaggrcagtactgaggagagggacaaagttcagcgtggaaacctgtggtcacatcatcggagtgaccagagctgagtcgcgtgccctgagtccacagcaggctcttcyctgtgcggagcctgggtggggtgcggctgtcaggggrgcggctggggaaggagcagactcagctcgctggggcagggactgtkgccttgtcaccctgggccctgcacttagcatgtggcctggtatagggtgagtgtccggtcctgtggaatggcccagtgggcagctggacccactgtgttctcccaggcaaagccgggcttttcctgtctgcaaayatcttgtatcaaaccctggagctatttattccttaagatctcagatttttcttttccagtactaaactctttggtctatgctcgtgtagttactgttggtcaggtcmcccgtctgctttgcctcctgtctgtggctagtgacaggccggggtctgggagccaaggaccacagctcagcccgaagtgggggagctgtggggctgagagcagggagtgggtacctgccccagccaycagcctccctccacagacagcatcattaattcttcatcctcccgacaaccctgataacagccacggtcttcatccccatctcccagatgaggacagtgaggttcagagaggcagcgccatgcctaggacagcgcagcctctatgttgctgagccaggacaggyccaggaagcctgactgtccatccagggctcaawgagatgacatttctgttgtcaggtcaggctttcagggtgcagagagctttctgaggagwytgggctgaggaamacagggtactgagctgcagcaggtcttgtggggccatcagccatttgcttcctacactagarcagaagagggcatggccaagcctctgcttcccgcaacccagagctggtggtggaggcgagcagcagaaggcagccattcaccatcgctgarcgcccagtgccagggacaggactctagccggtgggatctgtatgctgcctttgtagttagaggacagggtggggatgtgggacagaggagaccatctgtgaakctggggctggggctctgtcatcaggacaggctgacactgggctyaggaccaagaagagttgtggatggagtcgtccaagaatgtccccagggagccgcccatcagaatgcgtcaccacccagcccacatccgacctcccctggcatcccctgggtcaaggcatgcayagcctggtggggctgttgctgtgaattgggcagggcccacccctctgtgtgaccttagggaagttcctcaccytctcagccttsgttgctccttrtaaaakraggtgcctggtgatctgtcctcagggttgttgtgtgattggtagaggggcaggagtagaaagcctgtgctgctcccctcagagggtgaacctggacctgggcactgttggcctcccagctgtggcccagccttagtgtggaggtgacaggaacatctccacatgtcttgtacacgtgaaacccagaaatgaactctaaaagccaatcaaaggtgtttgtacttatttttaaaatgaaaagtagcatgtgaactttttcttttcttttcttttcctttctttccttctttctttcttttttcttttttcttttttttttttttaagaggcagggtttcactgcattccccaggctggagtgtagtggtgcgattatagctcactgcaacctctaattcccgggctccagcaatcttcctccctcagcctccccagtagctagggctacagtcgcacaccaccacacccagataatttttaaatayttcttgtagagacggggagtctcactgtattgcccagactggtcttgaactcctgaactcaagcaatcctcccacctcagcctcccaaagtgctgggattacaggcgtgaaccaccatgcctggccacgtgtgaactttcacagccttacaattcctcatttaattcatgtgagactgttttgccagccccatttcatgcgctcagagagattaaatggccagcccagggccacacagcacatccaaggtgacatccatggctgtggattccaaatcccagcttcttcccacaccagctctgagcacttcatgaagactcggggcctccagygccrtgggattarcaagcagatcgttgttagtggaagcccaggctgtgggtgggcgcagccagctgtcagaaaggccttctttattctgctgtgctaactgcactagtagaactgtctcagagtagctttaactggtaattactgaggctgggtggggcggggtgggtggggggtggatagacacgtmccaggatgctctcagtgtttggaggcccctgaaggttggtggccccagagccaccatgggatctaatagcagggtcgctgtggtgtcactgcccacacccaggctctcacacctgcttctgccagctccacctctcctatcagcctcatctgastcctgaawagccaggyctggtgcccstagggcccaactcttgatggcagcctgtgggacccagagggcggggctctcgctggcttcccacccatgggttcaggyctccgtgcagagcaggtgctttaggaagccaagcctgcgtcctgatgttcagagcctgcactgggaggccagggctggggtcagagccggggccctgcctggcctgtcatccatatcagcctgtagacctgggctctcttgggcaggacagtgatggagcggttggattctgtccctggtctctctgtgctcagggaggggagagccctgagctgggaggcaggacccaggttcttgtgctgcctgggcccaccattaactcctgcatgtsctgagccacggcccttcccttccctgggcctctgctttctcgtccattctacggtgatggcatcagaaaagcaaggtgcctcccagccctgaccctgtggctctgtggcagaggcgccttctcacaacaccgccatgccttggccccagtgcctcagggcagcccggcccctcctgagggaggaaggatggcaggaaggaccacctctgcacactccttctgaatccttctccacccatctcagcagagaggcaggtgcccatgttccagattgagaaactgaggcataagcaggmctagcaggcagaagtccagccaggatcagaatgcaggcarcttcatttttgtcctgatcccttyctgaaccagacagatttgctcctgtggtctcyggtggccatggacaggggtgttgatgaacagagccgtctggatttgggagaagcaggactgagtgggaattcgggacctggcccgggtcctgctctgcccttgccagccgtgtgacctrgaasggtggcaccatctccgtgggccccagggccacttcctttggttctttaccagggacctctttcattttcccattcattcattcagcaaatagttctgtagcacctaccacggaccaggcagagttctagttgctggggatataacaatgagagaagtaaagtccctgccctcagggagatgactttctagtctagagacacataatacatacatgagccctaaaggtaattgtcrggtgtgctagacagcaacgccccatcgggaaacaggaggggctgaacaatggcaggacagacagggctagattgggggtttctgacctgagacccacacacaaggaatttgcatcctgacgccaacacctgatctcagtgtgatctgggctttccagtcaacctccccaagcctcagtttcctcctctgtaaaatggagatactcatcttatgggrctgttstgggcttgtgtgagatgatacccagcgatgcccacgtgcccagaacctctgcatctcttccttcattggtatctcacaattgccgtcacatctgtgtttgaaagagaggagagagaggctcagagcagttaggtggttttcccaaggccacacagcaggttgtccccctgcctccatgtgaaacacagcagctgcctccaccccaggccaggtccccgcctatcattagatgcagtaagtgctgtcgaattgaactgaatgtgaatgtgtattgtaagctgagaagcctgttgttaaagwatttttattttgggggaatttatagaaataatgcatgctcattctacaaaattcagattctgcagaagcatgtaacttgggtgcccctagggagccccattcctaccagacaatccttccggcaactactttctgattttcattgccatggcctgttctttgaacttcacataaatggaatcttacagtgcatactcttgagtctagtctttgactcagcatgyttctttttccattttcctccatgttgttgtatctgtagttctttttttcataactgagttgtattccattgcatgaatatacataccacagtccatccattgttatggacattcgggttgttctgaacacttttatccacatccctctgtggatatattaaagcagggattttaatcttgcgtgtgccatttgggagctgtgcgatgttgagcagcttgtttaaagtccctgaaactcagtttccacacctttgaggcaaggtaagtgagccagcctcccggggttgcatgcagtgtggccagctggargccgacacacagtaggaacttcacaaatgggggctgatcgattgtgccccacttctgcaccattgctcgttgggtagctccttcatagaatacacttacctccatttttgcttgtgaaaactccacccacttttcaatgaaggtgggtcagggtttccataaatctctctgcccctaccccacaatcccacagggacaggctctttccaggcagaagccccacctgcattgcatgcacttttcttaggattccagtcgctttctgcctgtgtgacccaggggctcacctagcccctctttctcctactccccagcaacccctgaacaacctgagaacaggaccaattctgactcttccctgcccctgccccccaccccgtggcaggaagttgagggaaagaggaacccagcaggaggcagggagagccaggaggaacctgggcctggtcaggtgggacagagtggggccggccctccctgtctgtgtgggggccaacaatgggtgccatagctccctgggccctcccctgggaccccaggtccccacagggccctgcctggaggaaggtggcttcacgggcattctcgggtgtctgttgataggagggccttgttgacgggtgacccccatcccaatatgtcccattgaactccagggccactcatttcacactggccccaagtgtgaacatccacatcagaggtctctattctgacacaggcctgtaatctaaccctggaaaccctctgcccctccttggcctcagtttccccatctctgcaggacctgaagtcctttccagctctgaccaaagaatrtgcccaccccctgcctgctgatgggggctcctccggkctgaggcacagggtggggaggtgcacccagcccccctcctcctggaacctctttcccacaggcaagagaggatgtgtcaccatgaccacttctttctggaaaattcccacagttcattctttcccgggatttcactggaggaattgtgtctttcttgctaacatctcctgggatctattcttggccttggcgggcttgatgtggaggcatgtgtgggtgttctcttttaatttggggtccagaactgtctgaggcctggaccggtaattatgagagcagcaccatttatggaaacagcccttgaagcaagccagtgatgagacccagctggaaatacctcagcatggagccctgggcccgcctcgaggcggtgctgagatttctgggtgggagaagccccttcaggacgcagaaccaacaggtcatgagtcccgccctcccttggcctgcagaggctgtggggcccaagccttcttttgggtctgaagtgcccctgccccaccgcctttgctgcctgtgggaccagccaggcaggcccagcccatgcacccggggctctgggggagccgctgtccaccctcaggggccaggccgggagaggaggcaggtccacagcaacgggaatgtcggtggcttctgatggagtcacatggggacatggtagccacacccagactggcagtgatacccagcccaargggctctgagtgccggacactgagccgctgtcctggggacaagaggcccttgggaagaaggggccggggcacccccgctctggggccccggaacacagcggccgatgagctgacatgcgagcctcccatgtccacccacatggctccatcccggccctccaagggctcgctgtccagaggaacagctgaaccagagacagcaagccctggcatgggggccgggagaggctgaaagcctgacctgcctggggtctgaggactgggagccttctcagtcggactgagagggacggggccacccggggagagcagcttccaggagggactctgcgggaggcgtctgcaggtagaaggcacaagaggcccgagggacagatggcagggccagcgcagggagggccctgggacactcttcctgtgggcccttcggggccggggagggtctgaggggagatgggacaggtcacaggccacaggattctgctctgagctggaggatgagggtgtcttttgaagtcccactttttggtcagaaataagacagatttaggttgtctgagtgagactaaattgcccagagcacaaaaatagccagagcccttgttgatgtcgaactgagggtcgcagggtttggcatctggaggcctagcctggagtggctggtggccatgcccggtgaaggccacctcctgcccacagtggcctttcctggaagagcagtgtcctgaggttgccttatccgaggctggaggaggaggctgagggctctctgattgtttattttcccagagccacggtgaggtggttcagaaagtaaccttttctgcctcccatgtgcagctccgcgtggatagcattgtctgtcctggattctgagccaagccccccagctggtgtgtctcactggaactggctgtcaccagtccctgttggctgcagaaagctctacaggcgcactgtggcccaagtgacttctcacctcccaaggtcatgcactgtcacaatattggttggcagcaattgaagttttgaagttcttcccaagtcacagggcttctttgaatcactgtgctgagttcttggaggctgagaaacaggatttcttggagatgaactggccttgcctgtcactccaacctcctcatacacctcrgccccctgaccactagattccaaccacaccagcctccttgatgtttctcaaacatgcagagcctttgtatccactgttccctctgcctagaaggctgtccacatcttcacacaactggttccttctcctacagtcgagggtatttttttccccttactttccaggttttagactaatgaatggatccctagcatttttgaaaggcagtgtttctccactactgacaatcttgcctcccaggaaacatttggcaatatctggagacctttttagttgttgcaaatggggaggggaagggagtgctgctgtcagctaaggggcagaggccaggggtgctgctgaacatcctgcagtacacagaacagcccctgcaaccgagagttatctggccaaaatgtcagtggtgccacagttgagaaacctgttcaaggtgacccgtgtttgatagtgatgatgatgatgggctcaccctttattagatacaaggttgtcttattccatcttgtgttgctgtaacagactccctaaggctgagtaatttacaaaaaaaaaaaaaaagaggtttattttattttatttttgagacggagtcttgctctgtcaccctggctggagtgcagtggtacagtttcagctcactgcaacctctacctcctgggttcaagagattctcctgcctcagcctcccaagtagctgggactacaggtgcccgccaccacacctggctaattttttgtatttttagtagagacagggtttcaccatgttggccaggctggtctcaacctcctgacctcaggtgatccacccgcctcagcctgccaaagtgctgggattacaggtgtaagtcaccacgcccagccgaaaacaggtttatttggcatacaattctagtggctgaaaggctcaaggctgggcagctgcatctggtgagagcctcaggctacttcaattcmtggcagaaagtggaaggacagtgggtgtgtacaaagagagcatgtggtgagaggaagcaagagagcaagccagactttttaacagcctcccccatctagggaactaatccattcccctgagagggaaacccacccactggccccctcctccatggcattagtctgtgagtggttcatccccatgacccagacacctcccactaggtcccacctccgatcacagccacattggggatcacatttcaacctgagttttgtcagggataaaacacatccaaactgtagcaaggggtatattatctgtactgttcaccttgcttttttctttttctttttttgagacrgagtctcaccctggagtgccatggcacartgacagctcactgcagtctccacctcccaggctcaagccatcctcctacctcagcctcctgaatagactataagcaaagtgccattgtgtctggctaattttgtttgtttgtttgttttgttttgagacagggtctcactctacctcaaaacaaagagctaaagtgcagtgatgtgatctcagctcactgcaacctctgatgcctggctaatttaaaaaacttttctagagacagggcctccctatgttgcccaggctgatcttgaactcctggcctcaagtggtcctcctgcctggcctcccaaagtgatggggttacagacatgagccatcacagccagctgggacattttcttggaagtacagtttctgagtcacagcatgtatcattttgctagattactgccagatttcctaccctagggattgtgccattttgcattcctgccagcaatgcccagaagtgttcaggtctgatcttagagtatcttactcatgaggccttctcaaacatcacatctaaagaaaccccacactgggccgggcgcaatggctcacgcctataatcccagcactttgggaggccaaggcrggtggatcatgaggtcgggagttcaagaccagcctggccaagatggtgaaaccctgtctctactgaaaatacaaaagttagctgggcttagtggcaggcacttgtaatcccagctactcgggaggctgaggcaggagaatcgcttgaacccaggcagcagaggttgcagtgagctgagatcacgccactgcactccagcctggccgacagaktgagactgtctcaaaaaaaaaaaaaaaaagaaaaggaaaccccacactggactggaattggaggtgccagtatgatctcagatatttaaaataaaaaatatatatgtaccaatacatacagatgtgtgtttttgcacacattaatgtacacacatatatttcctagctctgtgcactgaaagggcctaaaagtattgacactccaggacagtgagcaacccagtgcccaaatcttggtttctaaatctctctccaaaaagcaaaacaaaacaaaacagaactccttgcagaaatggctgattccaggggtggggatggaaactcccaggatgcacctagagcatcttgtggtgccagttagaagtgctcagaaaaggatgatgggggcagtcagaaggacacaggagccaacctgaaggagctgccagtggccaaaactggaacaatttgagcaatgaaataaataacaatagtattggatatagcccatagaataaaataaatacccttgaatccataatgatataaataaataattaggctgggcacagtggctcacgcctgtaatcccagcactttgggaggccaaggcgggcagatcacctgaggtcaggagttcgagactagcctgaccaatatggtgaaaccttgtctctactgaaaaaagtacaaaattagccatgcgtagtggtacacacctgtagtcccaactactcaggaggctgaggcaggacaataacttgaacccaggaagcggaggttgcagtgagccaagatcatgtcattgcactccagcctgggcaacagagcaagactctgtcttaaaataaatatttaaataaataaataactgtagaagaaaggacaagtcttcctttcaaaagaattccagttaataaatgtagaaggaaagaaggaaatagaaaatcrctattccagcctggacargatggcaagaccccatctctacaaaaaatacaaaaaaaatagccaggtgtggtggtacatgactgtacatgactgtagtcccagctacttgacaggctgaggtgggaggatcccttgagccctgggaggttgaagttgcgtcactgcactgcagcctaggtgaccaagtgagaccctgtctcaaaaaatgaaaaagaaagaaaatcactattggctcatgtctatgatcccagcaaggtgagccaagagttcaagaccagtctgggcaacatagtgagatttcatctctacaaaaaataaattagccaggcatagtggcattatgcttacagtctttcttttttttttttttttttttttttttgagatggagtctcgctctctcccaggctggagtgcagtcgtgcaatcttgggtcactgcaacctctacctcccaggttcaagtgattcccctgcctcagcctcctgagtagctgggactacaggcacacaccactatacctgactaattttttkktttttggtagagatgaggtttcaccatgttggccaggatggtctcgatctcctgaccttgtgatccactcacctcggccacccaaagtgctaggattataggcaggagccactgcacctggcccatgtatagtcttaactgctcaggaggctgaggtgggaggatcacttgagtttggaaggttgtggctgcagtaagctataatcacaccactggactccagcctgggcggcagagtgagaccctgtctcaaaaaacaaaacaaaacaaaaaaagtattttcctcacgatatttattatttacaaaatgaaaaatcgtgacattacagtggagaaacctggcagacaccaccgtaaccagggaatcaaatttcacgccactagtaataagatagattggtatcatattgtcccatttgatgctctgagaagggcatatcactttgaagggggcctgcccctccacrcctgtgggtatttctcgaaaggtggagatgagagactgagaaaagaaataagatacagagagacaaagtayagaggaagaaaagtgggcccaggggaccggcactcagcatayggaggaccygcaccrgcactggtctctgagktccytcagtatttattgatcactatctctaccatctcagygagggggatgtggcaggactatagggtaatggtggggagagggtcagcaggaaaacatgtgagcaaaggactctgtgtcataaataagtttaaggaaaggcgctgtgcctcratgtgcatgtaggccagatttatgtttgactttacacaaacatctcaatgcagtaaagagcagtattgccaccagcatgtctcagtcggtatagtgtgagactcttaatctcagggtcgtgggttcaagccccacattgggcgtcagatgaagggggcctgcccctccacacctgtgggtatttctcgaaaggtggagatgagagactgagaaaagaaataagacacagagacaaagtacagaggaagaaaagtgggcccaggcagcactcagcatacggaggacccgcaccagcactggtctctgagttccttcagtatttattgatcactatctaccatctcagygagggggatgtggcaggactatagggtaatggtggggagagggtcagcaggaaaacatgtgagcaaaggactctgtgtcataaawaagtttaaggaaaggcgctgtgcctcgatgtgcatgtaggccagatttatgtttgactttacacaaacatctcaatgcagtaaagagcagtattgccaccagcatgtctcagtcggtatagtgtgagactcttaatctcagggtcgtgggttcaagccccacattgggcgtcagatgaagggggcctgcccctccacacctgtgggtatttctcgaaaggtggagatgagagactgagaaaagaaataagacacagagacaaagtacagaggaagaaaagtgggcccaggcagcactcagcatacggaggacccgcaccagcactggtctctgagttccttcagtatttattgatcactrtctaccatctcrgtgaggggratgtggcaggactatagggtaatggtggggagagggtcagcaggaaaacatgtgagcaaaggactctgtgtcataaaaaagtttaaggaaagttgcygtgcctcgatgtgcatgtaggccagatttatgtttgactttacacgaacatctcaatgcagtaaagagcagtattrtcgccagcatgtctcacctccagccataaggtggttttctcctatctcagtaartagaatgtccaatcgggttttacaccacgacattccaatcccagggatgagcaggagacagatgccttcctcttatctcaactgcaaagagtccttcctctttcactagtcctcctcagcacagaccctttacaggtgtcagactggggttggtcaggtctttccctttccatgaggccatatctcaggctgtctcagtgcggggagaccttggacaatacccagactttcttgggcagaggtccctgaagctttccacagtgcattgtgtccctgggtactcaagactggagaatggcaatgacttttaccaaacatactgcctgcaaacacatttttaacaaaacacatcctgcacagccctaaatccattaaaccytgagtcaatacagtacatgtttctgcaagcacagggttggggctagggttacagattaacagcatctcaaagcagaagaatttttcttagtacagatcaaaatggagtctcttatgtcttcctttttctacagagacacagtaacagtctgatttctctttcccccacacacttctgtggtattcttcaaaatccataacttcattttaaacatgagaaaacatgagacaaactcaaattgaggggcatgctacaaataactgaccagcactcttcaaaagtatcaaggccaggcatggtggctcatgcctgtaatctcagcactctggaaggccaaggcaagaggactgcttgagcccaggagttcaagaccagcctggacaacacagtgagcccttgtctcaataaacaattgtttaaaaaattagctgggcatggtggggtgtaccagtggtccctgctaccccagaggctgaagtgggaggatcacctgagcccaggtggttgaggctgcagtgagctgtgactgtgccactgcactccagcctgggtgacagagcaagaccctgtctcmaaaaaaaaaaaaaaaaaaaagtgtcaaggttgaaagggaaggaaagactgaggaacagtcagatcggaggggccccggggaaatgacactaaatgtattcgtgtattaataacatggggtcctagattgaattcttgacagaaaaaggatattagtaggacagttagtaaaattagagaaaagtctggatttagttaacagtatcaatttcctggtttttttgtttttgtttttgttttttgaaacggagtctcactctgtcatccaggctatagtgcagtggcgcaatcttggctcactgcaacctctgcctcccaggttcaagcagttctatgcctcagcctcctgagtagctgggattacaggcacctaccaccacgcccagctaatttttgtatttttagtagagacagggtttcaccatcttggccaggctggtcttgaactcctgacctcatgatccacccgcctcggcctcccaaagtgctgggattacaggtgtgagccaccgcgccccccccaatttcctggttttcttatactacaggttggttatgtaagaagctgtcattaggggaagctatcagggaaagaatgtatgggaagtctctgcactgttcatgccacttctctttagatctaaataatcctaaagtatttcaaaatcaagttaaaaacataaataaggcagcccccacactccctgcattattcccagccccccttctttgtgtacttcctagcacttagcacataggctaatcttgtttgttaactttcctgtttgttatctgacttcyctgcaagcctgtaaaccccacgggggcaggagctgccccatcttgcttacctcagtgtctcctgcacctaaataatgacttctgcaccattagtactgctttaaaatgtactgaataatgaattaattcatattcctggctgtgaccaggaaaaatgaatgaggaaaagtcagtattcttataaagccttcagatcatgagaaggtaacagagtcaggaacctcctccttcatgcccaaaagtgaaattatgggaccctcaaaaataggatcactgtcccagattttgcagacgggggaactagatgtactgcccagaaaccttgctccaaacatcaatggctcctttcagggccaccatagagagaggattcctggcaggatgtatctcagatgatcgggatcaggacactggcyggacagagagcatctccctcatgggccccccagcctatctgaatctgacagggagccctggaattaacttcccaaccttacaactggcagcagaattttactgggaaaacccaagaaatcacattgtgcaaacctgggcctttcccatgaattccctccatggaccctcaaatcagcagccactgggaggcagcagcaggcattgcatgctgtatattgaggacctgtctagaggcctcgagcgcttttggccagttccagcatggttttaatgccccatttcycagcatcagacggaggtggtccacggtagcagaaggagcccagcgaggagtcagggttccgtttccacgtgtgggaacatgggaggagattgtatttggtactttctgtccgagccagaactgggggaccgtcccagtggcattgctgaggtgctgccgctcagccaggcatctttgggagattccagaccttggttctatgggaaggtgggggctgggcattcactgacaaggaaatgctcccgaatagggtgggagaagcattcgctggaccataaccaagtactgactaccgtcaacaaacctggctcttcacagttttcatttgacccactgtttcaaagtgttattttgcaggcgtggacactgagcccagaaggttaagtgccttgacaaagatcaggcaggtgaaaaggaggcacccagaagttgaactgatagatttctctcattccatacttttatttagaaaaaaagaaaactagccrggtgcagtggctcacgcttgtaatcccagcactttgggaggcygaggcgggcagatcacaagatcaggagatcgagaccatcctggctaacacggtgaaaccctgtctctactaaaaatacaaaaaattagctaggcgtggttgctggcgcctgtagtcccagctcctggggaggctgaggcaggagaatggcgtgaacccgggaggcggagcttgcagtgagctgaaatcgtgccactgcactgcagcctgggagacagagcaagactccgtctcaaaaaaaaaaaaagaaaaaagaaaaaaagaaaactgaacgtctccctttccccaccatggctgctgagtttcagacgtggtcttctgatggtcctggctgggtattgtcactttgatactttaagttggaaaagcagctgttaacctccagagccatggccgccactcctatcccacggcccctgccctttcacagccctgggtgggaaggacagaatccccacttcgcagataaggagactgatatcacataggttgcccacagggtcgggactgggaccaggagcccagttactggccagagaatctacccttttcaatgctctcttagcagctaaagcaggggctgtctgcccatgaaccttcacaggggaaaatctgggtcccaacaaatgctcttcctcagccccagcttttgagaaatatcttttctatccaaaggcacaaccactggccagctccagacccacatggctccagcaaagaaagggcactccctttgcccagtcacagtaatgcctatttcagtgccacaccccaggaagttttatcagtttctgataaaaatcattattttcctaaaaaattcccaacttccaggcttgcctggaacagccaggggaggcagtttcctgtgctggaattcctgggtggtttatcgatttcacaagcccacagcgcggaagtttggaactcaggtcggttcagttgagcaaaactcttgagtcagcctgggtagacccacaggtcaggcggggagggaggccacagcacgggcgtccccacagagctgatgggtttgtgggctgttccctcagtcctcagatcccacatgaagtcagcatgtggtctgccaacagggacaccactgagccccaggacccacccagcagccctgctgtgccctggggcacaagcacatagagccacgctttgaaagcggacaggagaagccgggactgagctgctccatcactgtcgcatgccctgtgacagccaacagcatggactgattttgtcttgcaaatgggggattcttacacagccatgtaacacagggggatctgcagttcctgaacccactgaaattgtcacccaagtcgtgttgtgtgagtgtgttagggaagagagcacacgtgtgtagatattcatggtaggaggtccagaactctgccatcagtgatctctgcctatgggaagagatcgtggcctgtgtcacggcatctgagcagcccggctctcaggcgagcttttgcygcatgcccagcaccctcaggygctgtgggacaagacaagttcatttttcctccgccctggsctgggatgagcggccacctcctcctgcccacacacgtctggccccatcccccgccccgcacagctgttcgcctgcccttggctggaccaggttcccaccacgaggacaggaagtgctccccacatccgcctcggcccgcacagcctggtgcttttccaaacctgacygtggtcactgagcccagtaaccagagagaatttttaaaaagactcacaaacatatcattgaaatctcagtgttgggttttggggaaggcactgggcggctcccacccctgctttcyggaaacacagatttctagagtttgaaasggaygggaggctaaagtgagactgccctaaatatagcgtcctgggtatttccggatatttycrgacacctggggaaatgtgggctttattccgcaactacagcctttgtttgattggcaggccagcccctgccacggggccctgctgcccatctcacttccagcctggcctctaccctcacctccactgtgtcttctaattcccctccacccacgccgcctccctgctgcccccgtcccctgtgcttcccactggccagaggcgcagcccaggctcctggcccgggattcgcaccctcagcaggcaggccgcagcagagctcatgtgccgtccccaacatcgctgacctgtgggcgcctccaccctgtgcatgcgaggtcccctctccctagagcaccctccctgccaccttctccacctaccaagacccatcccacccttcaaagccagttcagatgccacctgctcagatcccatcacccagtgagaccctccgacttccccagcacctgactggcctctccgggagttgtcactcctgccctggtttttcttgttcctttccacgtttcccttcttcctcttccagcttgttccagaaaggaaacgtgggtctcctgccctctgctgtttcctggtgcttgctttccctgccctgccctcagacccctctgctctggccctctgccttggctggccggcccctgcagggccygtctccctgacaccatggcagattcgcactcatgcctcagcccagctcagctgtcagccctgagccctcccctgccgcacctcccatccaggcagygggcaggctctggatgscttrtgtcccctgagatgccgtcggttatgtcggttatgtccctgtctaccaggtttccctgcagggctggggcccttttctgccttgggtccaatgtccatcttccctttagcctggaagctcccagaggaggctccctcctgtctcatctctgggtcccaggaccagccgggccaagaaggggcgcaacgggagttcaggatttggagcctggggmctgctgagcaccagccaggtgcagggctcagggtgagcctggctgcagggcctcttggccctgtctacaccccgggaccaagcctggaacaaacgtttgcacaaaatgaagccggccccacccaggcctscctgggtccgctccaccttgagtggtgggtgtctgggggcggtggctcacaccagctctgccccctccagagcccgagccattctgagtgccagcccagcgctgctttgtcttctagtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacaggtgccttccccttggcccgggtgccccacctaaccccccacctcacagtctcatggtcaaggcagcccagcagggagtcgtggtgggctgaaagagagcctcaaagatgggaaggatgcttggcccgaggcccctgcactgtgggaagagccccagtgacaatcctgacttcaagtccctgccctgccatcctggctgtggggacttggacaggtcactgagcctcagtttccccatgtgtacacctctgtgggctgaggcaatgagatgaggctcagaaggggcgcagccagagtcaggtgggagacgctccggtgacagcccccagcgggccctggagacacggaggcagctgtgccggccgccggttaattgttctttcatgtccacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggatggtgaggctgggggctctgcagcccctggggcttctctgtgccagcacaggcagcggtagtggcttcctgtggccctgggtgcccggcctcaccagctgtgcccgctgcaagggtcactgaggtccagggcacgaggtctggcctagtgggggtgctccctcctctccctctgcttcccaggaagcaggcggctcttcccacggagcagcctccaccttgggagtttctgtcctgggaagggaaggaggggaagtggctgtaccctcaggcactgaggccaggaggctgggtttgaagcccagcttggcagtgccctgcctcagtgaccttggctgggacttacctttccagaccccgtcttctcttccgcaggatggggattcacgcccttgttcattccacaggtgacactggggagagcctcttttatgccaggcagtaggaatacagaggccaaagtgggcacgagatgggtgtgtttgaggcccggcaagggggcgccatggagcagcggtgagggcgggggwcccaggggccattctgagtcagagtaaaccagggccaggtgctggggttcttagcgtcatttattttatttactagcagtggaggacgacaggatctgattcaggttttaaaagagaaccctctgagatgcccccctctcggggtggagcagagctccccaccccttccgtgggctgcacccagtgacttgcttcccgaaagtgcggtgtggacagggcgtgggggacctgacgcgcagcgcctcagccaggtgaggaaggctcactgcagtgaccggcacggtgctagcatgtgccctgggtgaaagggaaggagaaggccactgagcctcagagggccccctccgtgaacccgaaaccccagtccagccacgagaaaaccgtcaaacaaacccaaagagaagggctttccgcagaatacctgacaagcgcttctcaaaaccgccaagctcatcaaaaaaaagggaaggttgggaaattggaggagcccagaggcacctaagaagaccagctcagtgcatgtggggtcctgggttgagtcctggaccagcaaaaggtcattagggagaagttatgaaatccagatcgatcatggtgtttacttaataataaggtatcagtattggttcattagttatgagaaaggtaccctgctagtgtaaaatattagcatttcccagaggaaactgggtccaggtgtatgggaactccttgtgtagtttttttttctttgagacagggtttggctctgttgctcaggctggagtgcagtggcgcaatcacagctgacggtaacctccaactcctgggcgcgagcgatcctcccaccttagcctctgtactatctttacaaagttttatgtaactatcaactgttgtaaaattaaaacttaatatatgcataaaataaagaaccccctgacttcagtggagagagcagactgagatggacaagagtgaagtcagagagacgtgtgggggccccacagtggtccaggtgggcgctgtgagtgacttgttggtagcagtggagatggagaaagatgagtcgatttcagtgtcaggacatgcttatagctggcgaggaggtgagggaacaggaggaagcctgaatgatgtgtggttggagccagtggatttttttcaatagatttttctttttggggaaaagatagatgaagggcaggtttgaggtgggtggccaagggttctcttttggctggaatattactgacccccctgggatgttactgagatcactggtcctcatggaaatgccattacagggaccggtgagcgtgaagacccaggcgagggaggtgctggcatgtaagtggatttaaagcatgggatgggaccaggtcatctagggaaggagggtagtgatggagaagaaagagggcctggcccagagccctgggacctccaacatccagagacctcacaaggaggggccacagagagcccacagagaccagccagggagggagcaggacacctggaggatgaggtgatccagacgccagagtaaagtgtttccagaagcaagggtttgtcatttgtgtcctgctgtgggcactgaaggcaagaacagagaagtgaccaagggttttgccatcacagaggttgttgatgacctaaatatccgtggagtgtgggtctgactgaggaggtggagggagacaggcagtggaggcaggagacagctctttccagaacctttgctggggaaggggagcagagacatgggctggggctggagagaacccgggacaaggcaggtcctttccaggtgaggagacgcctgcacgctgctgtggtgatgcagtgattctgtgcagagggaagaaaactgcaaaattccgcacaagttggagcagggagctggagtgggggaggtggagagggcggggggatgcagaggacaagacggggggcctcttcagagcagggacccttcctgatggaggtgagggatagtgtccccactgtcgcagtgaggggtgaacctgagctctgggaggctgtagtggggcaggcactcactctccgggttgtcacaggattaaaggagggtgcttggcacagagtgatgcccagtgaaggtgttcatgagcgtcggtgtcacccagcggcgcctgctcattggacacttggtgtctttaatgagctggggaagctggggggaagcttgggcggggtggttggagtttgtgtctgaggctccactggggcaggaggggacctagcctgtgccctactcgcggagcctgacctcagctctgtcctgcgcccgggcctgtgcgctggacacggaggactgactcggggcccccagcccagggcggagccggccccctccctgttgcgggtcgcgggcctggcctagagcctgcgcctggccggggagacctgctgggagggagtgcgtcagggcgcgggcgcccgccctgctctgtgacgcgcggcccgaggcgcwcgcagggctcacaccacytgtcctggcctccgacccgggccgactatggcggcgctgcggctcctggcgtcagtgctcgggcgcggggtccccgccggcggctcagggctcgcgctgtcccagggctgcgcccgctgctttgccaccagtccccggccccgtgccaagttctacgcggacccggtggagatggtgaaggacatctctgacggggcgaccgtcatgatcgggggcttcgggctctgcgggatccccgagaacctgatcgccgcgctgctcaggacccgcgtgaaagacctgcaggtggtcagcagcaacgtgggcgtggaggacttcggcctgggcctcctgctggccgccaggcaggtccgtcgcatcgtctgttcctacgtgggcgagaacaccctgtgcgagagccagtacctggcaggagagctggagctggagctcacgccccagggcaccctggccgagcgcatccgcgcggggggcgccggggtgcccgccttctacacccccacgggctacgggaccctggtccaggaagggggcgcccccatccgctacaccccggacggccacctggcgctcatgagccagccccgagaggtgagggagttcaacggcgaccacttccttttggagcgcgccatccgggcagacttcgccctggtgaaagggtggaaggccgaccgggcaggaaacgtggtcttcaggagaagcgcccgcaatttcaacgtgcccatgtgcaaagctgcagacgtcacggcggtggaggtgggggcttccccccagaagacatccacgttcctaacatttatgtagrtcgcgtgataaaggggcagaaatacgagaaacgaattgagcgcttaacgatcckgaaagaggaagatggagacgctggaaaggaagaggacgccaggacgcgcatcatcagacgcgcagctctggaatttgaggacggcatgtacgccaatctgggcataggcatccccctgctggccagcaacttcatcagtcccagcatgactgtccatcttcacagtgagaacgggatcctgggcctgggcccgtttcccacggaagatgaggtggatgccgacctcatcaatgcaggcaagcagacggtcacggtgcttcccgggggctgcttcttcgccagcgacgactccttcgccatgatccgagggggacacatccaactaaccatgcttggagccatgcaggtttccaaatacggcgacctggcgaactggatgatccctggcaagaaggtgaaaggcatgggcggtgccatggacttggtgtccagtcagaagaccagagtggtggtcaccatgcagcactgcacaaaggacaacacccccaagatcatggagaaatgcaccatgccgctgaccgggaagcggtgcgtggaccgcatcatcaccgagaaggccgtgtttgacgtgcacaggaagaaaragctgacgctgagggagctctgggagggcctgacggtggacracatcaaaaagagcacggggtgtgcctttgctgtgtccccgaacctcaggcccatgcagcaggtggyaccctgacgggacctggatctgggcggggtggtgcgctcctcagggcggatgccaccgggttccccaggggaatacatgtccccagctctgggaggggtttgctactggcctcctactttcctccctaggtggacagtgctcctctagagagctgcgactttaattaaaaacaacaggaaaacagatcagttcctcactgtgtttctcgagcactgcaaggcgcaggtctgcagtggtgaggaatggatgtccgctttgctctgtgatstttacacagagcgtgcacagctcagcgcattcacagcaagatttgattcaagcgcctccctcgtacttgaaccatgaaatggagataaaaactgacgagggagaaaatcactcaacccagagtacacctgaagggacattttactactgcagtgagaaataggcgagcaaagatgtgagtttgtgattggaagacatgctatcttcatgagcttgttttttctttttccttctctttcttttttcttttttttgaggcagggtctggctctgtcactcaggctggaatgcaatggaatgcagtgatctcactgcaacctctgcctcctgggctcaagcaatcctaactcagcctcctgagtagctgggactacaggcgcacatcacaatgcctgcttatttttttttattttttaaatttatttatagaaatggagtttcaccatgttgcccaggctggtcttgaacacttgagctcaagcgatccacttgcctcagcctcccaaagtgctgggattacagacatgagccactgagttgggccaattaaccttagcttactgtaatttttttttcttttttagacagaatctcactctgttatctaggctagagtacagtggtccagtctcagctcactgcaacccctgcttcctgggttcaagcaattctcatgtctcagcctctcaagtagctgggattacaggcatgtgccaccatgcctagctaatttttgtatatatatttttaacagtagagatagggtttctccatattggccaggctggtctcaaactctgggcctcaggtgatccacctgccttggcctcccaaagtacaggcttgagccattgcacccggccttcttgaacgtttttatccgttatctggtatttcttctggggcctttgttgttaaattttgtttccctgaagcctcccctcctcctcccacatctctcctcctgggacctatgagatgttaagcttctagatgtccgtagaaggaaagcaggaccatctccaagggaagggaccgggtgatgggagagactgagaggggagaggctgccggtgctgaaatccaccaggaagcttcctctatctgtgtgtggccaaaggctacagcctaggacaggaggagttctagaaccctaaccaagggactagatgagttttctcagcttcatttgaattgttcctgcatcattcacaccagacacttaggccctcctctctgggatggaggcccaaactggccacttgtgtgatggtccgttgtaacccaagaggctgygaggcatttcctcctgaatctatagtctcaaaaactaaaattaagattgtgtgtgtgtgtgtgtgcgcatgcacgcgtgcacacgtgctgttgacagccaagcctggcctggtgcatgcactgcataagtgtagctctgggggttcccmggccaytgggggcatgtggtcagagtagtaagttctcactggtcaaggacagactttccaggggcccattggagcctcaccctgcaggaaaggccagatcctgggaaggagagcagggcagggagagttggcgctcatggagggcacagactgggggtgtggaaaaggggccagggactatggctggggttgggggcttgaaatgaaatgtcatctagtgggcagtggggtgccttttggggctcctggagaggggcacctgatttgccctgggcgtcagtttcccaggagcagtgtggaaaaggctgaggtatctagaagcggacaagtgaccctctgggcctccaactccacctttctggaaggggcctgcccacagctgggcagcctgagagccccccaccttgactgcttggccttccctgcagccagctggagccagggagtcctgcctaagaatgggtgggtaagaagcagagctgatggagaagggaggctctgggctctggaaggagagggctggggatgggggagcttctccaggcctgccagatgcagggctctgaaccsagacccactgttagtccccttcaccaccccccatcttgcccagccacatccagctgggccctgcagtttgctggaaaagtatatgacaatcctggctccgacccaccttgctctgggaccttggacagttgctgctctctctgggccttagtttctgcttctgtaaaatgggaacctgggattagctgcttccaaggttccctagtcaggctcgcctggcctgtgagacctacagaggggttcccagcacccaagccaggcctggctcagaggggctctgtgagggtctgtggtgtaactgatctaatgcgacattctatcctgtgtctgggagaccccccataagacccttgaacacagctgcacagaagcaaatagtgaggaaagcctgcaggactgatggcctctcaggccccatrgcaggcagggctccccagggagtcacaggacagagctgcaagtggagccaggagggctgccctgggccccaggctgtccccatgkgtcagccagtctgcagagtgacactccagtgcccgggctggtgaccaccaccaccccactcaggctgctctgttctctctccgttgtgacctcacttgtcttttcctctgtgccccagctctgttccttgtatttctgctgcttccccataaccttgactcaccgtgactcaagccctgcccagtggattctctctgggcctccttcccatgttagcatctgcagctcacagcctccctgtctcagcagctcttgtccatgctcgtgagagggagggagcctctcctgccagtgcatttgtttgtggcggatgatgtcacgggtcaaaggttggtctctggattcactggttgttcagtcaagtggccaagggacaccagggctgaggcacagctgcttaagggctgacctttgagtgggactgagggtggggcaggcagtgtccttgacctgtagggtgtactggagaactacgtaggaataaatacatctgtgtgtgtgatgtctgtctgagcgtatgtgcatctgtgtgtttatgcaaacatatgcctgtgtgtacatacgtgtgtacatctgtgcttataacatggaggtgaaatgtactttcgtgtaaactgaacaactggcactgtttaaagagacatgaaaatgagctggtaatcatgcttctgcmattcagtatcaggaaatttcacccatgcacggagtgaagaggctccattgcactcccatctttatcatgaaagccgggaaataacctacatgtctatgatgagccaatatcaagtcaattacggtatactgctccaagggattttataaatttgaaatgtttattgtggagacttatttaaacaaccagaaaaagttttgtgttttgtttttttttycttgaaacacactctcattctgtckcccagctggagtgtggtgacacaatcacacctcactgcagcctcaacctcccaggctcaagcagtcctcccacctcagcttcccgggaagttcaccaccatgcccagctcatttttgtttttatatttttgttgagacagggtctcactatgttgcccaggctggtctcaaatgcctaggttcaagcaatcctcccacctcggcctcccaaagtgctgggattacaagcgtgagccaccttgcctggcctcaaaagtttctttacttaattgcttttacaatagaaaggttattgaaatccaaacaagtacaggatgatacacagttttattggtgaggcttggcatctccagggttagttatcatgttttcagcggcatcctcagtctggaagcggctgtgggggacaatcccgtttacaggcttcactcctcctggggctgaggcccaagtcagatctctgtttcagccttttctttctttcttttctgtccataagcccagctcgtgcataagaactcgggctctggaatgagactgccgcaggctgcaacctgggctctgggacttggttcaatgtttctgctctgcctggcatctcccttgtgggcatcagggagacagttaatgccctgctctwgggctgtgcccagcagaacaagcactcgctcaacctggcagatgctaccacgagctgtctcggtgataagtttgacattcacaccccagaaagtgcgggacggaagacagaacacaggtctcggggtccttggaccaaggtgggagcgctggttctcggagtcactggcagtaggactctgggtctcctgtgaagtaggagctgcagggtcactgtaaggacccaatgaggtgatccatgggaaaaatcttccaacttgtaaaacacttcacaaatgttattatttgtgacgcagctgtcactaataacaccgcctgcagctcactgagcaccccctcccacctcctccaaatctgtccccaggagagacgtggactggctggggctggaccaaggactccaggcttcagatgtggaaactgaggctcagcaggaccccttgggtcctcagcctccacgctcctggacctgcccaggccccggcagagagaccgctgctgtgtctgctgcagggccrctgcccgtgagtgacccctctctcctttctgtctcagggcacagcgtggatcctggcctggccggcctgctgggtcaacgggccccacgctcccaacagcctttcgtggtcactttcttcagggccagtccgagtcccatccgcacccctcgggcagtgaggccactgaggaggaggcarccgaagaaaagcaacgagctgccgcaggccaaccgactcccagggatctttggtgagggtcgggcaggctggggccgaggccctgtgggcttctggctgagagaggcagggcgagaaccaagtggtggcccagagccctcaggctcaggtcggttcaagctgacggccactctccagccacctttcctgacaccatcttggccctgatgcaccctggtgaccggcactccggaggcctgtcctggctgtccctgctgcccagaagtctccctctctccccctggctcctccgggtctttctcaggagcctccttcagaatcagctgccccttccctgggagccgcagcccctcatgacctgcggttgtgcctgggcaccctgtgggatcctcggttgcttatgcgagttttctccccaactgggccaagcccttcaggatcagggacaggcctgacccaaccccgtgccctccttcccagggagtcggcccttgactggcctggtcgtgagccacttgaacctcgggaatgggtgtggcaggagagggtgggctggagtcacaggggtctccagagaggaggaggcacaggatggccgagggtcctgctgggctgtttactggagcataaagacgctcataggctgaaggacaggggaggactgggcacagtgtcactctagccattgggagccatggcaggcttctragctgggtcatggtacaagcagagttccagggatgggctttatgagaccaaatggtttcctgtcattcatttatttgacaaatgtgctcatcagggcatcccccaccctggtaccccatagtagctgcacacagtaggaaccccagaaaagaccttgccccttctgtccctgcagatgacgtccacggctcccacggccggcaggtctgccgtcggcacgagctctacgtcagcttccaggacctyggctggctggtaattgctgactctycttgtttctgaaatgacaatcaccacctgtagatcagaagtgaatctgcagggaggacatagaatcatggtgacttcaattttcttatgtatttttttcttctgtgttttccaagttttctaaagtgagaatatggtgagaaagggttttkttgttkttgttgtdttttttgttttttttaaaaccatgaaaatgaagactgaatcaaccaactaagctgtcagcattgcygcagggtaactgagacctccctgcattggctacgactgcagctctgggaggygtgggcaggggagggccrgcwggggagggccggctggggaggggacrcaaagtgaagatgggggwtgttgggcctgagctcctgcccagccttttcygccgggggttcctgggtggattcaagcctcttgggggagacggccctgcagggctggaggatgggtttgggccctgaggctcagggaggrgcacatggatgggactcaccttctcccttgccccccaggactgggtcatcgccccccaaggctactcrgcctattactgtgagggggagtgctccttcccrctggactcctgcatgaaygccaccaaccacgccatcctgcagtccctggtcagtaccgtgcccatcctgcccagccccctggggtgggaggccctgcagagaggggtctggtccagccagccgggagggcagtgaggccacctgctccatgtctsgggggctttgtctgcacagagtcagtaacgtcgctaacttcccacagctctgcaggaactggtcctcatacagccacactactacacatagacccacacccaaacacggacacacrtgaacagtcgcgtatgcatgcctgttctatgcactgaacaaactcctgtgggacacttacacacctgcgtgcggcgctcagaggcacagcacatgaaacagatgtgtacactgtgtgggggctgtgtgatcttaacacacgggcccccgagtacgctggcaagtctgaccgccygtgatatgtgygcacagtgtgtggggtgtgcgtgtgcactcacccacctgtgccgcaccacaggcaggaagcttctagatggtgtggctctcaaccttttggctttttcccgcagtttctctcttggctgtctgtgttttytctggatcccctggcttttgatgccttggtgtctggggcaaccttaaaggacaaaagcaggcttctgatgggatcactggtgctgctcaccactgagtgctctgtgtgtttgcggattctggcaccgaggcttccttctagaagtttttacctagaatcccagttcctggtattgcacagccttatgttttcctcttaggaggttcaacggtgatgccttgatcaggcgcagtggctcaccctgtaatcgcagcacacgagcccagaagttcaagacaagcctgagcaacacagcaaaaccctgtctctaaaataaaaattaaaacacacacacacacacacacacacacacamgtgcgcacacaatgccttggtgtgagaggaaagaaattaccaaaagctgctctgagcctatgataatacttcctttctgggcagtcaaatggtgtttgctggacacctggagccatctccttggaaaggcccaggggtgatgaggacgcgtggggtggcctggcccagccaccctttatgccgtgtggttctcacagctgcatgtgtgggaggtacatgggaaggtgactgcacctgcagctccyggactccatctcctctgcccttgcccctgcccctcaggggctcaactagagtgagtgctcacagcctacagggcagcaaacaggcactgtgctctaggggaggctgtcggtgggcacagaagcaaaccaaccgtggagttgacacctcctgtgaggaagagcagagcagccgtgccgtcagtggagtgagactgggcccagcctctccacacaaggaggggcacgtcagcagctggaggaggaatgttccagaaggagcaagtgcaaggccctaagacaggagcaggctggccctaagttcagggccagcagggaggagaggggctgggtgcagtgaaggggaggagagtggagggaggtgatgccrgggtgagccaggccagctcccgtagggcctggggttccctgggaaggagggtggattttattccaagcaaccccagaggctgtcagaggtcttcagcaaagcagtgtcctggtctgcgtcaccctccagaaggacctttctggcttggggaggctgatggtcgcgggagtggaaggcagaggagcaggggatgagtgagggctgctgtggtcacctggcaggtgatggcagctcgactgggcaggtggtccgaggcagcacggaggtggaggttgagccaggggctgctctcagggaagggaggaggcgaaaggagtcatccaggaggcctcccaggcgggagctatgatgtcagggcgggaggaattctatgttccactgaggcctcattagacccccaagtgcagaagtgggaaggggagcaggatccgcaagtctggagttcagaagagaggtccaagctgagccaggggagtggagaggtgcgggcacatgcagggccttgaagtgctgagggcggatgcagtcctctgggagaaggagcagcacaggagagggggcgaggcctggcctcccagagcctggggagggaggccagggtgtggggaggcagagcctctgggggggtctgaagggctataagaagacagtggtccttccaggttcccccttggggacctcactaagggcacaaacctggccatgaggttctccttcccattatccccaggaggaagtctgagcccttggcctgggactcgaggcccctcattagtgccctgcccacctgccccacaccctggggctgccatgtatccctccctgggcactgtgggcyaccacagctcccgctcccagagctctcagggctgctcttattcctgttaataattcttattattgtgctgctcccatgtggcttggagatggccagggcagggagcaggtggagctggggcggggctaggtgggtcctcagaggaggccactggcctcatgcccctgcctgtgctcccttcctggccaggtgcacctgatgaagccaaacgcagtccccaaggcgtgctgtgcacccaccaagctgagcgccacctctgtgctctactatgacagcagcaacaacgtcatcctgcgcaagcaccgcaacatggtggtcaaggcctgcggctgccactgagtcmrcccgcccrgcccwactgcagccacccttctcatctggatcgggccctgcagaggcagaaaacccttaaatgctgtcacagctcaagcaggagtgtcaggggccctcactctckgtgcctacttcctgtcaggcttctggtcytttctcggtacctctgtgcccctcccctggggtttgtggctgtcactctgcccgacactttggtggcctaaggcacacagcagcctcagagcctgtgctgactgcactgtctggagtgagtcagcacagaagtcctatcttaggacctgtcagactgtggctggccccggatggtctgaggttggctgacccgagcttttctccattcaccagagggtttaggtgtgaggagaagggctctgcctcttcccaggtacaacactggccatttctgggcaaaattggacacgcttatgttctcagcacagtgtgttctgggattcttctcatttggtccagggtgcagttagcatattagaaaaagaataagctggacatccccacgaagccactggggattttttttttttttttccagatagagtctcactctgtcacccaggctggagtgcagtggtgcaatcctggctcactgcaacctctgcctcccaggttcaagsaattctcgtgcctcagcctcctgagtagctgggattacaggggcccaccaccacgcccagctcattcttgtatttttagtagagacggggtttcaccatatcggccaggctggtcttgaactcctgacctcaggtgatccacccgcccggcctcccaaagtgttgggatgacaggcatgagccaccgtgcctggccactggggatattttatgtcatgtgtattcccttgccctgggcctgccccttctcctgcctgggaaagaggtatgactcccacaggagcaaagaatcctgggggcttccagttccctccaccatctctaccatgctgacccatttggggctcagcactgagacagaggcaagaccagcagctccaacatgtagtgtaggctggcacagagcaaatgcccccgcagcctrctccccttgcccatggctcatgtcagtaatcaacctacgtacctttcccactgaaccaggacagggcctccaggcctcagcacagaactgcagacagccaccaccaggcattgtcaataagacctcagttccccctcctgccccactgcagagcaatccattccatccaaagcagggtgactggcagtctccggccaggcatggggcaagggtggggactgccagtgtttgcttgtgtctaggagttatgaacaagctggccaccaaaatyggcgtcaccctgggtgcccaccagcgctgtcctgtgtcttgggtctgtgagtcaaagaaaaggtccctgkcccagggagtgacaggcagtaattaggctgagttgggtggggaggtttgtctcggcctcyactgttcccggaaaccgctgttctccttggaacagccactgggagttggagtgtttatttgatttctgacttgctaagcctgtaatttacctgctggaacagacagagtccagctgcccaaaccgtgtcattaaaagcagatcctgggcccgccccatccacaggcacagcctggcagagtggttccacctccccatgggcccaaggatgcgcctctctggagttcacgtgctgcacccccagggaggggcctggggagagctggtccagcagcaggggtggaggctggggccacactgcgggacagcagcccctccacctggaccagggagggcctccatgtgcaagcgcagaggaagagaccctctcatgtacataaagggtgggcccaggctgtctggaagatggtgagttccccactagtctaaggcttcaagctcagctagcagagattggaagaggcaatggcctgagtgttaggagacaggtattcyggttccaactcagccactgacttggtgtcaggacaagtcccctttcttattcacgcttcagtttctcatctgcaacatgaggacataggactctttaattccaaaggctcttccaacccagagaacccatctgcccccatgaccttctcccagagcttgagacatggcctgagccccctgctgccataggacttggggcctatctgccattgcaggacctgatttaacagctctcttcttccaatactgggcagtagagtttcggaaactgacaaatgtgtggtctcttcagtgcccagtgtgtaacctggcatggtttgggtgtgctaggagtttgtgaaatgaatgttttcaagacgcaaacgctgctrtgcccatcaggtgtgcacagcaggcctgaggatcatgatgagactccctttttatgcagcaaagcacaaagtgtgacagtcgtggccttcctggtggccagacttctagcaactttagccacccaccaaatgacatcacatacagaaggcctcagaaagggaggaggtcgtaaggacacacagctgatgaagggtcagtgctcagctatcaaggtcatcttctggcctggttgcctcccacagcccaggatgcattcaaggctgcacatcaggagcataaataagggtggtcagctcaggcccactggctgcaacaagtagccactgacagggagtctggggccatttggtgcagaacaacccccaacccagtggccatcttcacaactgcagcacagtgctggccctaatgccaggtgagcgtgcaaagtcctgtttctttgtctttacatagggaccgggcgatgcgctttagagaaattccctattatttcacaggaaaggaggctgtgaaaaggagagggcaggttttggagccaagtcgacctggcatcaggtcctggctgcctttttttttttttttttaaagacatacatggtcttgctttgtcrcccaggctggagtgcagtggcagtgtcatggctcactgcagcctcaacctgctgggctcaagcaatcctcccacytcagcccgagttgctgggatgacaggcacaygccaccatacccagctaatttttwwattttttatagaaaccaggtctcactatgttgcccaggccggtcttaaactttgcccaggccagtcttgaactcctgagctcaagcaatcctcctgcctcagcctcccaaagtgctaggattacaggcgtgagccacttacccggcctctgcctcttgttaatttgaccacatcatgtacctgctgtgcccgttccttcctccgtagaagagggtgctggtcctgcccttttgaggcctccatgagggccaaatgtgccatgggacacttagtgccatgcctgcgcagacctgtggaataaacagcaattctgagcaggctcattttaaagggacttgcaaatttgggcgttccttgtgtgccttcctcataaaacccactcctcccagaatatgcttagaggtgctgctgtatttacctgagagctatgcttttcatcaaaaacctaaacgtgatcatctcttggatgaggtgtggccctgcacmctcgcctgctcgtggaaggagtctgggccagcagtgacccaygcgctaggktctctgctgaggaagtggcaggtgtgyggccctgccctggccccgtagtgagtgtggggcccacctgtgccctcatgggcagctgaagggggagctttctaccccaggttcctttccttactgaaaagtcttgagcaaacagttgccgctctccaccccctgctttttaaaaaaaattttttctcacgtaagaaaatgttatctgtgtgctggggaaaattttgaaaataacaaaaaccagaatacaaacacccataatcaatcacagagataaccactgttcataattccttccagtcttcttacttggcacatatacatttgtctttctttatatatgacatatggatattttacaaagttaggatcctactctatgcactgcttggtgatcggatctattcaatgtacaaaatattttgaaagtttctgtgattaaatgttctttgaaaacataacttttagcagccttccatcccttcagttctgctttagcttctcccttgtatgtctggtcttgcgttcccttcctcagaggccgggatggggctcctgtgaccagggtggcaggcagcctagtgctgagatcgcatggccacgaggctggccatgggtctggaatccctgggccaagaacctcctctccttctctgtgcagcaattggcacaagcaggggcaggtgcctcacctctgaggcttaggtgacctcagagtacaagggtcacagatggacccactgggataacttccggggaaaccctgatggttcctctcccactggcctctggctggtcccttggtccctccttcccagggtaatcaggcaagcacagcaataaggtcctcccttgtttcacagggttgtgggaccagttctccctcccggggcctcgggccagcctgcctgtcacccccagaacccacagtgttgagcaattcacacacatcctcttctctcctgggcttcatggcagccctgagtagctgccttatcctggcctcaatgctgcctgtcctgacggccatgactgacyaccagtaatgacaccgacattgaggagtgagagtgcctgctgggaaagctgcaggcccaagctgatcaagcggggagaagccccacccagggtgccagaggtggagctggcttggggtcactggggccagggcaataggcttctcctttccccaccaccctcaccctggtggatactcaacatcaagacttgattcagccagcattctgggaggccaaggcaggtggatcacctgaggtcaggagtttaagaccagcctggccaacatggcgaaacccccatctctactgaaaatacaaaaattagctgggcatggtggcgggtgcctataatcccagctacttgggaggctgaggcagaattgcttgaacctgggaggcagaggttgtagtgagctgagatcatgctccagcctgagtgacaaaagcaaaactccatctcaaaaaaaaaaaaaaaaaaaaaaggcttgattcagacagagctcctaggacatgtcatgggagccagtgggcagccctgggggaggtttctggagactgatagggctcagtttcaacacctgaaagaggccatgaggtggcctggctggcccaaaatyggtgcagggtgagaggccatcctagcacaggctgcgcaccatgacaccacactgcagtttccaggtaggcctggggttggggaggaggaagtaggagccacccctggcttgtttctccccagcaccaagcacatccgctgactaaagaagcgccctgtgtgctcctcggtaatacagttctgttggttcaggaagtgcataatgagtgccaggtcagtgagactgattacaaatgtccatcaggcacaagaccagctggtgtgagagcaggaatggtaactgaccagaaagaaaagacacaggcacttttacatggctttgacttctactgccccacaatgggctgccgagggcatctcctaagggacttggcctaagagagaagagcagcagccgagatgctatggcctgtcccagcagcaacctctgaaaacacctgggacctggctggcaggcagcagtataagaactagaatttattttagcaaaccaaagagaacaaaacatccaggagccacattggtgggcccacagcagacccagcagcaaatgccgagaaaagtggtggttggagaaggagcacctgtgctggttcgtgggcccacagctgcacttgggaacagtccaggctgtgcctacagaggtgctccaagctgaccctaaggtgggcctcatgccacaaatcctgcttgcttcaaatagggcaccctcggtgctgcctcctctgaggctggcagctccttcctggatgtgcaggggcaagagcagagtggagagcagagagagtgccgcctcacacatactccccacagttgccaatgatcaccttctgccttggcttcccatccttgcctttgcagacagaatagaagaggggacactcagg

SEQ ID NO: 13411 - DNA, 17263 bp, Homo sapiens
ttgccctaacttgtcctgtagacaagcaaccacctctctctttattccaagcctgtaaatcagagcatatctgggagggcagctggactctgataagggatgtgatttattttagttacaaataacttggttggcatctctgatatctgtggccaaacctggccaaacctggggagagacaggccagggcagggcagccaagagtccacagcctgccggggatggagagagaagccacccatgcaagagttcacttatgctggccacaggggacaggtagtgtgggagagccacgtatagcttccaaagtcctccagacacrtaatgaattgaaggagcataagcattggagtctaacatgggaggatgttagataatgcggaaatcccaactccaccactggatcctggggcaagtcatgccatctccacaagtctcgatctctttatctagaaaatggagttaaagagagtgctaggtgtattgggctgttgggaggcttagataagatatcctgtgctacccccggcttcacatctagtatagagtcagtgctcactgagcagtatttcctagagactcaggacttaggaccctgctttacacaggaccatatggtaccacagcagagcatcaggtttttaaaactttggtgctcctgaccatctagcgatgttccaggaggtgctagaagccccaggacaatacagagaatcattgtcgaacaccaacattgctatatggtcaaaaatatatatcattattattgtattaaactcaaattgggtatattgtagagtaatatataaaactgtaatgagtctgtaaggtagtatttaaggtgtgaaacaaatgttgttaccccagtagaccacaccctccccacccactgcagggggtggggttgaggctcccacagtcctcatgatagagatacatgagagaaatgccctgccctaatatcttaacaagtcgcagagaggggaagtcactagtccctctctttcagattttctaaatgatccttagagttcccatctctgagtctatgacaatgagtcaggaaatagttcctgaatgaatggaagggaatctgtcatgaactaagaatttcatgctgtccagcatcccctcctttgtggggaaatttgggaaaaaacaaatggaacattttcctactggctgccagcctcccacacaaggacttgtcaccatgcctttgcagcaagtagatgtccaatgtgtaaatggggaatacctgaattagttgatgctagccccaacagagatgaagctttgcctctttgctccttcacatgggaaaacacagctaaagttctaactcccagcarggggcggagtctctaatgctcaattagagagaagggagcagaaaggtgtgtgccagccctaagacccagggctctcagacgctctcctctttctcaacaccaggcatgcaattcccaagcaaagatcccctcayccagtctatcattgttggacatttgggttggttccaagtctttgctattgtgaataatgccacaataaacatacatgtgcatgtgtctttatagcagcatgatttgtagtcctttgggtatatacccagtaatgggatggctgggtcaaatggtatttctagttctagatccctgaggaatcgccacactgacttccacaatggttgaaccctaaaacttaaagtataataataattaaaaaaaaagatcccctcacccacagagacaaggagatgcatgtgcatgaaggactcatcccccctggcctccaccaagggccactttcttcctcctgcacaagaccccgaattcaagatatctgttccccaactcagagtttctgggtccaatgtcacttaactacatttggccatttctccactttttgctttcccatacaaagactggactcctcctcaaagccttgctcctttccaaagtttcctcrtggttgtccagagtccaccactcyccagaatggggcaacaagagctcctttccttcccctttcctccttctccccttcgccacycacaccatgcccagccccaagccctctgacaaagtcatgtctcctttccaagtcccagttcctgccaaacaactttacaagcacatgaaagcgagggccggggcagttattgctactggcacttcattgtacttcctctaaatgatgctgcgcaaaggggccgtggaaacacggggcaggagggagactgcgggtctctgggagaacctcaagggttaggacagtgccaaatatttggaagtggggccttttagaaggaacggggagacaggttggaaggagtcaggrgtcagaatgcccaaagacaaagcagaagatggcactggtaggtaacatacaaataaacttccctagagactatagggaaaccaccagggccctcttctttcaggccaggcccagggctctccctgatctccagcttgactcttctctcccatcctgaatgtttccacttttcaagggcttatttgagctccagtcccttttggaactttccctaaggcctagagtccaccaaaatccttccctccctgaaatccttccaagttcgtccatcttatacagtctaacatattctaagcctaggctttggagctcrgtggagctgggtttccatccagcactgctcctggctatgtgaatgccagcaagtcacttaacgtctctaagcatcagttttcctcctgtcaaacaggcctgataacaggaagcttcttactaggccattgtgagggtagaatgagataacacatggaaaatatttaacataatgcctggcacagtgaaaatatacagtaaatggtagctagcactgtattcatttttttttttttaacagagtcacgctttgtcacccaggctggagtgcaatggcataatcttggttcactgcaaccttcacctcctaggttcaagcaattctcctgcctcagcgtcccaagcagctgggactacaggtgtgcaccaccacaccctgctaatttttgtattttttgtaaagatggggtttcaccatgttggccaaggctggtctcaaactcctgaccttgggtaatttgctgcctcagcctcccaaagtcmtaggattacaggcatgggccaccatgacaggctgtgttgttgctatcattattattattatttcagcttcagtagtataaatcctagatccccaaatccccacctagcaaagacctctcactcacacagaaagggagatgcatatgcacagagaactcatcctgcctagcctccacctagggtcactttcttcctactgcagaaagtaggaagatagagaaagcagaaagtaattcaagatactttatactgggtactcaatctaaactacctgggtgagactrtgtgtttcaatttctcagtactcccgtggaactgggttaataaatatttgctgagtagaatttactgcatgcaggctgagctgtcttaatgacccagctggcacttcttaaaagaaagattaattttggccagcgataagcaaatcggccatgtaattatctgtacatacatagacaaagaaagagaatgcttggagttgagccgtgctagaatataccttacacgcagcccctcccctccatagccaccacaaagcactgaccctgtttggatgagatattggagccctagctccagggtccctgatgttgccctggtatcaaggctcttctctctgctctgaggctgccaggcagggaatatragccaccttactgttgagatttccccacactgattggcagaagcaggaggtggtgaggaccaagcagctggtccagtggttgcctctcatattcatgctccctatcccaggctggaatctcatggagacccaagacctcaccgcagagctggttcaagcttccacagcgctaaggtggcagtgacactgcggactgtaagctttggaacaaggctcagtggggagctgggagaacccaggacccctytctggaaaacccattgccagctagtctcacacttggaattgtgatcccttctgtgaccaccttgataacagccactcgccctgttccagccccagtctctgccccgcccagctctgccctgcctagacacagccyggtggggcttggcgagcccttgggcacaggagcctgttagtccagacaacgactgtgcgcatccgggagaacggttactttctgccatgtgctgcagctctagcgacctcgcccaaaactgcgcgccggcagcctgcccaacaaactttcttctctttctctttttctttcaaccaaatggtgcttccacagacacattctccaacggtttrgcgcaaatcccagccctgctttccggagcccaatgcacttcgcagacagctcacttgactccagtcccccagggccgactcagccggaggggctgccgccgggtccgcgctgagcaccccgcacccatcttgctgcccaggctgcggcgggcactcaccgatctgcgccaggctcagcggcacgaggcagagtccccaggctgcgtgccaccaaaacttgtccatggtgtccggagygaacggagggcgcgggcgaaaggagctggaggatccctgggcgcggggcaggggccggcggaggacgggacgaggatggcggaccgaacctggcagaggctggggtccgctgggcaatgaggctgcctcggaagttggctgcagtttttattcgaggttgaaaacagtgacctaagacggagggagggagcgagcgaaggacacacccaagcaaggggggctgtgactaagcagccmgcagaggttttaagaagtagcagccctcccgggcgggcccctctgcccccgccccgtgctctgctgaggctgtaaataatcggggctgccagggacgtgggtcggggaacctggagtgtcgcggggtgcctgtgcctccgagccccactggcccctgcgcccagagacgcactggctttcttctcccgctggccccgcggcgtcaggacagaggatgaccgaaccgtaaaaccttgcaccattgggttcagcctttggcctctcctttcccgctaaatttctctgaatccggctggagcaagatctctkggtttcacaggatgttggatatcctgggagaggagctggagagagggcgaggtcttgccctgggtggcgcagtgcctccgtgcccacagtggggagtgaggggtggggagttggtgaatcttccaagtggaaagagggagagctcattctttttcccctcaataacaagtccacatggcttgaatgaattttagcttcttggcagaacagctcagggaaagctactgatggcctgtcatagggctggcatttggctcagctaacccatgtgttcaagccagtgtgaatgggcacctctctccacacacatgctcattcatcctcctaaatatccttccatccgcccatccatctatccacccatctttccttatgtccttctggggctctcacatccatccatcctcctgtccatccactaaccacttaggtccatctatcatcccactcattcattcatccaaccacacaccttttaatttattcaaccacctattcttctattcatcttcccatacaacttctcatccatcattccacacttcctttttcacatctcttcataaaaccacaaccatccaccatcctcttctccacccatccacccacatatctgtttattgatatatccactcatttcccatctgtccaagatcaacatatccacctatcattttatccattctctcatccacccatacgttcatctattatttttgcccccattatcctcctttctgtgtaaacattaattcattttctcccatctttcctacccagcagatcttaaagagaggaagagtttgtaatattcttcaggggaagccttttgagattgaaatatcatactttgaatgataactctatatctatctataatatactatggtttaatgtttggaaatcaaacgcagtatttatttgtcatgtgaactactamaagtaaatctgcatggacttcttgcctggtgagttacacagaaaatgaaagtgattatcagtggctgtggcaagatgaaaggaaccaygccaggacttctgagggaaggtaagattttgttatttatttcaagaaattgaaaagttgagagaaatgcacccagccatccccctatgcattcattcatcagacatgtaatgagtgttgtggggtatcgaggtaaataagacctggcgctatcttcagagccctcaccctctggtacggaataaaactcacaagcaggccattaccatgcaaggtgaaatatgctgcaaaatgtgtgtgtttggggtgctaccattcctagagaagggagtcacactctctcctggagaacaccaggcagtcttcacaggggaagtgatatttgaggcaggcctcaaaggaaaaggaggaggaattcttcagatgaaactacagggacaagtaagtcatccacaggcagtacagtgtagtgacgaacagcatggattcaggagctagaacacctagatccaaaccctattatggctgcttcttagttgtgtgaccttgcctaaggcaattagctcaatttgctcaagtataaaatgggcttaataatagtatctattattactattacaattctattacttcatagaattggtgaggattaaatgactcaaaagccctgcatgtattaagccgtagatttatgtctacatatgcatgcagtaagcactttaaataagtgtttgctatcattactaaaagcaaaattgtgtttgagcatagaaaagtgaaagaacatggcttgtccagagaatagagagcaatgtgagctgatctgaacatagatcagatgaaggggctgggggaagatagcagacatgaggttacaggtatggggactacaaggtgtaagctatgccagggagtttgaacttgrccctgtaggaaataaggaggcaacgtacttagttaaaattattatcattgttatgttaaaatatgcataacataaaatttaccatttcacccatttaaaagtgtttatagcagtgacgtgtagtactttaacaatattgtgcaaccactaccactgtctagtccggtataaatttttcagttgtggagattctgtttgactaaagactactcctcttgcattttcaggaagagtgtttgggactgaaaaatccttgtctggatctagtcctcagccactcagaagctggcatgccatgactcaaagagcyrcccgtctggaatgaagrcagtgacccgtaactcccacctgaagagcaggtgcttggaaaatgctgccagtccgcaggaaaaagttgttactgctgctgtctgtgaccaagaggacactttatttcttgaaacaactgggggcaaactggctcycagataaggcttcagtccctactcatgtgaggaaaccagccctggtaggttccatgcacaagaatacaggacaaggagcagcttttttcacctcatgcaacctccagggatttcagcttccttttcttggagcaagaaagtgaagtgacgtggggagtcactaggaacaatgtctgtcttactgtgtttcatggaacctggaggttccttagagacccctcagaagcagacctagtggtcagagtaaaagctgaggagtaagctgtgcctctccctccccaggmcccatcccaaccacagaagttccacttgcatcagttttatataccagactattgcatgaaattacattttgacagatgattattcttaaaaaatatataaaaaccaacaaactaggccatatcaagtcctggtcccttctccattagtgcagtaaacaattccaccaaggaaaatataggtgtgaaagtgctttgcaaactgtagaagggcatgcaaattctaggggctgtaattaggattattctccccagaagcggggattattttgtttgcttgcttcccgatagtttggtgagggactgaggtcatttgcccccataccacaaatgactcatttcaaataacagacctggtgacttactgagtcaaggtccacctttgggaattcctggatcacctctttgagctcccctctcatccactttccattctaaagacaccctgcccacaccactggtcacacaaacccttcccaaactcttagatgcttgatatctgttgtgtgttgcaccatctttctttctaagccaaaccatgggatgtgggaaactggaaaggaaacttgaattgatttgagttgacacgagattacactatttgggaagaatccagaattcaatcagcagccttggaccragaaagtccaggtctgagcattggctttcccccttatcagaggatgacttaacctctgggagtttcggtaatcccagccacaaaacaagggtaatcagacctttcccatagtttattatgagtagtcagtgaaagaagacatcaagaccatttcctggtgtgcctgcctcatggtgggactcaatgacctctaagctacctgagaacagggacatgtccttctggggtgccagcacatactcagctctcagtccctaacatatacactgtgctccataaataagcattacataaatgtatgagggactgttattttttttccctcccatcaaagcgcataggggtgtttcaggaatcacatgaactggtgggaggaaacacatagacaacttgacagtttctaaataaatgcaagcagtgacatcctatttggggtgactggttcagggagacttgagtgcaaacagagcattactcactctggcagactagggttctttgctgaaatattggggmctgatggcttctgactggtagtaataaatcctgttcctctcgagcaaagaaaagccaaatctaaaccaaatgtgagcaggagtgtgaaatggaaagctgggagatcttgggctgaatcatggaattcaaggattacaaatgcagcaggtcacagactcttttaaagggacaatatttaattatttcacgggacagcttcccagaaaaggaatgatctggcacagtaaagaaaaaatgacattccagttaaaccttaactcttaaaaaaattcatccttagttcatattcacagtgtgaattctacacatataaatgagcagtggtgaaaaaagctcttgcgaaataattattagtaaagtctaaataaaccagtagctgggaagcaatcttcatgaaaaataaataacctctaaggattagtctcaagctaaccaaatgtgattatagagctgagcctttaggattaataaggctttcaaattatggtaaataaagaaattggtgtggctgctgcaccctggaagtcccaaggggagagatgcaactggattttttagatagatccatgttagccacaaaatgggttttacgcagacctttggaggttaaaatagtatgcagataggacaattcctagacttggatgataacaaacttagaaatgtgaatttttgacgatgaaatttgaattaatggtatgtggctttatgtagcaagctaactggaaggaacacaagcaaaacagtctatattttatgcactattayttaagggaatgtaattatatttatttttaattatatttattttatgttcatgtagtaactaaaattcatatttattcctcttctctccacttcatacaaagtggttaaacatctattggaaggctttaggaatctgttttgatgaacatttaagcatgatttgttttggacatatccatggttggtatgtaaatggtaactaagagccttgtaattatctaaaaattgcttgttctctgcactcatttactatgtgactactatgtgctgagaacaatttatacattcttggttctgtcataattaatcatcaccactccttcactgccactattgccatcatcaccactaccacctccaccatcaccactgccactatcatcaccacgatcatcaccaccaccactaccattatccaccatcaccactagagttattactaccatcactacaaccaacattatcttcaacatcatagctaatagccagtactttctacatgtcaagcctaatgtcatttaattgtcacaacaatcctatgaaaagttaatttctattttacagataaggaaacaaagtcttagagaggttacaaaacttgtccaaagtcacatttttatttcacttagcaaatctttcctggctttaagagatatggggatagaaaagtttaatccctttttgattcttgatgtagcaaaaatgctaaattaatggagtcctaattcatyagtctttactaaattttattctgaatcatggaaatcagtttcttttaagaaggaagatttcctttggaagcttttgttggagtggaggaggtgaaaagagtattgctaaggtagagaatggagaatgttgactctcacagccctctgacaaattagaatcctagaataagacaactttaaatgtgtagactcggacygtggctattcaatggacaattttagatttgcataggactatgccttgattccttagagtatcattgtgagatggttgtatattctgactagaaataacaccattttctctttrcagcacctgagartttattcagtgacgataatactcacaagaccctttttggatttgtggcccamcccacaagttatagttccttctctgaatatttcatccagattgtgaagagcagcttctggcagccacagttgtactatgtgacccctacttcccatgcccaggactgattcgaccccgtagtagacacctaaagcaatcctgatcagtcagagtctttgttcctgacatttgggattagagcatggctgaaggtttaagacacaaacttggaagctgtggggcagcaatacacctccatgaggacagagaagcaggggaaataagaataaaccagaagctcacagaaacgcaggaaatacttctagagttctaacacttttcgggtttcttgttctagtccattcttgacacacttgtgcctcacagaagccaatggcaagaatgcagtcagatccttccaataaattccttttattctgtttacattagcataagctggtttccgttgcaaccaaaaagacttgatgaatataggagagcatcacaccattttacaaaagagtaaacagyggctcaagtggatggcggatgcccctaccactgggtcttgaattcaggactttgactctaaatcttaggtcttctgattctgaggtctgtgctcttttcaccagttggcctcacctataatccctccccacatcatcccattctacccaaagaatacagttctctctccttcgttgtgatagaaactagacatctctgatactttgcctacagttgtatgtcaatccaaatgagtgrcaggtcttccgagtcccatcctcccagatcttctccagagagcccctgtctgcctgaacatgcctcacagtctatttkcaaagggcaaaacctttcatctggcagatggtaacagctgcttctctttaaaacacccaaagggtagaaattctgggctctaacgtacaggcataaggctcctgccaagtcctgactgggcttagcatcaaatcctgtagaaaaggaataggtacagaacatggatgtgaggccaggccaaaacgcattttattgctggcyactgtttcccagccacagaagaatgctgctgtagaaggcatggcgtgggtgagaaagagacttgttgaactgaactttaatgggagaggatgtggggagggtgggctagggagagagaaaggaagagacgtcttgagagagcttatgaaggtgaaagaaggcaaaagacacagatgtgactccatgatgaagcaatggaaaataaaagtcttttaatcatccaatggraatttaatggacaccttctgtatgcactacatggattcgccacagaggacaagccacagatgagraggacctgccctctctcttcagagactatgatctagatcagagttggcagatcagttgccttcattagtttaagaactattttgtatgcacctctatattccaggcactactstaaattccaaraatacaacagcacaaaaagacagactggcattttattatcatcgaggaagtgggtggagggtgcaggcaattttaataaggtagactaggaaggtctgggtgaagaggtaacatttcaggcaaatttacatgaaaaaaaaagtgcaaagcaaatgtaaaggctttgagattggagtatttttagtgtgtttgaggaaccaaaaaggttaatgtggatggagcagagtgaatgagaaagcaagtagtaggaaatgagattgaagaggaaggtaaagccagctcttgtgcacccttgcaggccccagtaagaagtttggattttatgccgagtggaatggaatgactttagtgggtttcccctaattttcacctctaatcaattaataatgactgcttagttcactgtgatgagaaagattctgaggctttacagttcaatggataaaagtccattgatggattaataatatacatcatgtctgtagcatgaggcagtggtaacactgatgattaatatttgacatctctgatcatgatggaagattaaattgtatttgtcaaagtactctgagttgtgctgcagtaacaacataagcaaagtctcattggtttcacacaatcacccaggtgacttcttgccatgctaagttggctgtgggttcaggaaactctctaaaacaactgtcttccatgcagttgctcactgatcttgtgctacctctgtctcgtaacacaattgctgcagcagggaaaaagaatagtagaaggcctcatgccagtgattaaatgctttgtctcagaaataatagatgtcacttcttttcccagcccattagctagagttagtcacatgatcccacctaagtgcaagatgactggggaagggtaatccttccatttgcctaaaggtagataagaacccaatgtgagtaagcagtaaaaatctagcatataaatcraccttagaacaagtccagtaatactctaaggaagcttgtaatgcactgggtaaggagtagtaaataataaagaaattcagaggccaggtgtggtggcttatgcctgtaatctcagcactttggcaggytgaggcaggcagatcatgaggtcaggagatggagaccatcctggctaacacggtgaaaccccgtctctactaaaaatacaaaaaaaattagctgggcatggtggtgggtgcctgtagtcccagctactcrggaggctgaggtaggagaatggtgtaaacccaggaggcggagcttgcagtgagcagagatagcaccactgcactccagcctgggcaacagtgcaagactctgactcaaaaaaaaaaagagaaaaaaagaaattcagagtggtgataccaacaygtgtagctcaaaaagtctctatagagaggaagggtactcgggccagatcttgatggatgagcagcrtcctgttactcaatcctcaccatctgatgcccaataaacgccccactttccctggctcaatcccatccactattctgcaagtcactttaactgactctttagtcttattattttggatgtaagatgatatgctgttgaagagcattgtttatttgctgtggaattttgggcactgtactcaacctctttgagcttaagatccccatttaatgcttgatataattatcatgaaaattaaagtatataatgtaatcatgcatctattcaacttatcgaagagtttagaatatggcagggtctaaaaaacagtcattgttattattgactcacccttccttaaaattatattttcccttgtctttatagatacagctatagcctatctttcattctgcctttcagatkaatttatctttctgtgttttgggtccartttcagctacgaggtaaaacggcttaaacacatacacatttatcctgtggttacctaatacttgtaagggtttctggttagataggatggtgaagagggataaacaattcaggctgatagagactctccaattttcttttttttttcttttttytytttttttttttgagacggagtctragtctggctctgtcgcccaggctggagtgcagtggtacaatctcggctcwctgcaagctccgcctcccaggttcatgccattctcctgcctcagcctcctgagtagctgggactacaggcacctgacactacgccgggctaattttttgtatttttagtacagacggggtttcaccgtgttagccaggatggtctcgatctcctgacctcgtgatccgcccgcctcggcctcccaaagtgctgcaatacaggcgtgagccaccgtgcccggccaaactctgcaattttcaatacatgacttccgagttcactgaggtcacttccattcagttggtggaaggaaaaagagtatggaggagaattgtttgtgaggtttttatgggctagacctgatagtgggaccctcacttccatccacattccattggccagaacccagtcgcgttgcctcacctaactgcaaggaaagctggaaaggttatgtggtccagttgtgagtccagaggaaagagaagaacgtggagttcaggaagctgttgtctttgctacacttctctctccatcccttgctcctcctctgagtcttttcccctgtttcttcttctaatggggggttgtgcatgttgatgtcttggtctgtactcatttcttcacttatttcctaggtccactgcacctgtcacaccacaaacaatgataaaaacggagacacctgggtgagcctcactcactgcgcatgcctccatcttcgaagagctcctgttcactgtactctgaartagactgtgcaaaacattaaaactgaccaaatcaataaggtcttgttttcaacatctctatgtttatctatgaataggaaarggactgacgtgaggtgggaccattggtgattttgttctgaaataagtgaaagtttaatggaaagatacatatggcacaaaaggaagataaaattttttttcttttagaaaaaaagaaaaaaaaacacctctttttcttttctttttgagttggagtttcgctcttgttgcccaggctggagtgcaatggcgtgatcttggctcaccgcaacctccacctcctgggttcaagcgattttcctgcctcagcctcctgagtagctgagattacagacatgcaccaccacgcctggctaattttttgtatttttagtagagacagggtttctccattttggtcaggctggtctcaaactcccaacctcaggagatctgccagcctcggcttcccgaagtgctgggattacaggcatgagcaaccgcgtccggccaaaaacaacctttaattatggaaaatttcaatcataaatacatacaggtaaagagaaaattataatgaatttccacacagccattacccagcttctacaattatccactcatagcccttgttatctgtctgtacctcctacctcctccccaactgctggattattttgaaacaaattccaaacatcatatacacttatctgtaaatattcagtatgtatctctaaaagataagggcttttaaacccttatttaaccacaatactattattacattattggtaattttaaactctttctactagtggctttgtacatgtattataaaaatatgtatattacttttgaattgagcaatattattttaaaaacattaagattcagtaaacatcacmcacacacacacacacacacacacacacatgttgagtggctctgagatcacctctatggaaacacccttgtcctgaggacagttttcaacacatgctaggtggactcgatacatctgcattagaagtgaaaaggaagcctctcatgctcacactagtcctgtgggaaatgggggctggggatctggcccaatcttacacccagcccacagcacaagcatagtgagtggtcccaacaggggactctgaatgacactgacaaagaygagaaagcaggaggcaaggcaccctayggtgtccttcagagaaggtccttctggcccctcgtctgccagccagctgatgccccaaagtctaccatctgagcatttaaagtctgatcagtccctttgcctttgggtcaatgagtttagatgatctttcctccccaggatgtttgacccagggtcgtagatgtgggtgagggcatgagaactctgagcactcagaaaaaaaaacaagggaaaacccagaaacacccagctggctttagccccagttatgcctaagtctgactttctcagaagtaaccaatgtcctctgtcccagtccagatggagctataccaatggtggttgctggtaytctccaagtcattgcttgcccttgttcatggatggaaaacttcctccattctcacctmgtgttgtgggtcaggggacatccagcatgggggagtcatgtctccacagacaaaccaaccaacaacaacatttccrttgcttcgcccaatggagaagccgcccctcatccagtgaacagtgcctgctccccaaatcattgcattcaacaggtgcctcctgctttctccaggatgcagaagaatgatgacgattctaccaatttcccagatatttttaacctttctcaacctccccatcctttttgtcttcttttaatttctgtttttctcccactttttctccccttctctttttctctgtcctcctcactttctcattttgcatcctctccttattttcccttcattcctatctcttgccctagttcccctcccaccagtcaaatatatgactgttttggggagttttttggtttaatttcwctctttcttccccaccttggtcttgctgctgcctgccwcctcctcagactgggtttgtccctttttcttcccccacccacagagtgtcagctcctagtggcctgattcagaccttttatattaggttggtgcaaaagtaattgcagtttt

SEQ ID NO: 13412 - DNA, 25257 bp, Homo sapiens
gagctgctggcccatgtacaggggatggagagggtgggccagcgcccaccagtcagggctggctgactggggttctttgtgaaccttcagggtctcccaagctggaaacctgggggtcggccttgctcccctcactccatggccagccgctgcatcatcccctgccctgggccacctgccctggacgtgggccacagtgccagagagagggacccttgcaggtacagctcagaatctccctcctacccagacacccccaggttctgtactgccccgggactggtgccctgcccatccgcagccyggatgctccctcctccctcccagcatcccctgtggcagtggccatgcctgcccccagagcagctcaggctcccctttcatctctccaagccttagcccctgcmgccctccgcctggagtgtttgcctccccctcgctgctgctcagggtctccctctgcccccaggctccctccccagcccctgagtttctcctctcactgtgcttccccagccctgagtgcttaggggtctgggtggcatgtgtggcatttaaccccatgctctctgctgagccctgagctcccagagttccctccagccctggccctggggagggggtagcatgtgaccaggagggcggaggggcttgtgtgtgtttctgagacgcagtctgagagagacacgggtgacagacagttggggaccccaaacactggggagcagagatagacaggaggggcccgcagtgagacacagaggtgagcaggagaggacacatagccctggagaaaaggagcaggtgtgggcgggcttccctccactgcagtcacagttccctcactcataggcagatcttcctgggtcctccctgcacaaagccccagtggctccctcgtgtcccccagccacagtccaagctccctaatgtgctagataaggccccagtccagcctttcggtcccagcactccctggacttcctgtttgggcctccaagcctttgctcccctttggccttcacccccatctgctccctagacctcagtccatctggcaaacacttcaccatcgccctctccatgaagccttccggcccaccttccaggatgacrtgagctggtgcccttgctgcgaggctgtcttcccccatcagcacaagtgtgagattccctcagggcagacccacatgctacttgggcctggtacaagtgtctgatgtcaggctgggcactgtggcttcacacctataatcccagcactttgggaggccgaggagggcggatcacctgaggtcaggagttcgagaccagcctggccaaatggtgaaaccccacctctactaaaaatacaaaaattagccgggcatggtggtgcatgcctgtaatcccagttactcgggaggctgaggcaggagaatcgcttgaatctgggaggcagaggttgcagtgagccgagattgcaccactgcacagagccagactctttttcaaaaaaaaaaaaaaaaaaagcaggtgtctgatatccccaaccagctctgtccaggaagggcaggaagagaggaggagacaggtgggttgggggagatggcaggggagcactcggggtcatggagaggctttggctagacggagcagaggaaccactcagggtctgtgtcctggctgcggggtccatccccctccctacccaagaggaggctctggtctgcccccagacacctcccagcacccagcagagggcccacccaggcggtgctggttgaggggctgaattggggaaccacaggtagaaagagaggccaggccgggtgcggtggctcacgcctgtaatcctagcactttgggaggccgaggcaggtggatcacgaggtcaggagttcaaaaccagtctgaccaagatggtgaaaccccgtctctactaaaaatacaaaaattagccgggcgtggcagtgggcgcctacaatctcagctactcgggaggctgaggcagagaattgtttgaacccgggaggcagagcttgcagtgagccgagatagcgccattgcactccagcctgggcgacagagcgagactccgtctcaaaaaaaaaaaaagaaaagaaaggggggccccaggcgagctcggtcccacccagcaggcgggggcggggcagggcagagtgctccccccgccccccgcttcctccccgagggccccggagcccagctcagcctcagtccccgcagcttgtgcggcggcgtcggcaccatgaggcgagggccccggagcctgcggggcagggacgcgccagcccccacgccctgcgtcccggccgagtgcttcgacctgctggtccgccactgcgtggcctgcgggctcctgcgcacgccgcggccgaaaccgggtaagggggacccacggggcgcgcggcgccggcagctgcggggagaacggggccccgatcgccagggcgcaggcagagccccgacccccgggggcgccgagggctgaaaggaccctgtgggcagggcctggaggggcccgcgatcaccgcgtggccctcaccgccgcctctctccctccccttgtccaccgccccccggctgtccctcccctccccggccagcctcgcccccctccgcccctccccgtccccgctcctccctcccctcggccccctggcctccctccctgtcccctcccgaagcagccggggccagcagccctgcgcccaggacggcgctgcagccgcaggagtcggtgggcgcgggggccggcgaggcggcgctgcccctgcccgggctgctctttggcgcccccgcgctgctgggcctggcactggtcctggcgctggtcctggtgggtctggtgagctggaggcggcgacagcggcggcttcgcggcgcgtcctccgcagaggcccccgacggagacaaggacggtgagttccgtgtgtaggggaaccagtctgagcggggcgcaggggctggggtgtcgggacggtctagggggagatgcatggcccctgagggggagagaagggctttaaggggaaacggagacagagtggaaaagagtttgcgctgaggagctcaggctggggagggagacatagtcctgcccctgagaccctggtcggagccaggaacagctctgccctgacagaccccagtgtgaggaagagacaggttgcaggaagggggccccgtctgagggaggagtctgtcctgccctttgggagtctaacggagcttggttcccccataaatccctgaagagtttgccagactgagccccagctccccaactccctgccctgccagctccccactggccaggcctctggactcagggtcagccaggtgccacccctccccaccctgcattgggcttcatttracggaggactgcccctccagaggagtcttctaggggagggagggaaggctgtgacygagtacggagcctctaccccctctgcctgcagccccagagcccctggacaaggtcatcattctgtctccgggaatctctgatgccacagctcctgcctggcctcctcctggggaagacccaggaaccaccccacctggccacagtgtccctgtgccagccacagagctgggctccactgaactggtgaccaccaagacggccggccctgagcaacaatagcagggagccggcaggaggtggcccctgccctccctctggacccccagccaggggcttggaaatcaaattcagctcttcactccagcatgcacatgccctctttctgggaccaggctaacyctgcagaagcacagacactacagaccacagcattcagcccccatggagtttggtgtgcttgcctttggcttcagacctcaccatctttgacagcccttgaaggtggtagcccagctcctgttcctgtgccttcaaaaggctggggcactatgagtaaaagaccgcttttaaaatggggaaggcaccattaagccaaaatgaatytgaaaaaagaccaagtgggaggatgcctaatttgtagttgggtggttttttgtgtttgtttgattttttttttttttttttttttttttttttgagacgagtcttgctctgtcgccaggctggagtacagtggcgcgatctcgcctcactgtaacctccgactccttggttcaagkgattctcctgcctcagcytcccgaatagctgggattacaggcacgcaccaccacagccagctaatttttgtatttttagtagagacgggatttcaccatgttggccaggatggtctcgatctcctgacctcgtgatccgccctgctcggcctcccaaagtgctgggattacaggcatgagccaccatgcccggccttgttttgkgttttggttttttttgaracagggtcttgctgtatcacscaggctggagtgcaacgatgggtccccagctaattgcagcctgggctcaagcaatctttctgcttcagcctcctgagtagstgggactacaggkgctccaccttgcccagctaattttttttttttttttttttttgagacagagtctcgctctgtcgcctaggctggagtgcagtgacgcaatttcggctcacttcaagctccgcctcctgggttcacaccattctcctgcctgagcctcctgagtarctgggactataggcgcccgccatcacgcccggctaattttttttgtatttttagtagagacggggtgtcaccgtattagccaggatggtctcgatctcctgacctcgtgatccgcccrcctcagcctcccaaagtgctaggattacaggcgtgagccaccgtggctggccttttttttttttttaaagacagggtctcggtatgttgcccaggccagtctcaaactcctggcctcaggcagtcctccccgaagggctgggattataggcaggaggcgccgggcctggcctctatttctttaatacctgccctcagagccgtcctgcttttaaactgatgcaaatggcagcagtgaataatcaattcatgggttcgcttgctttgggatttagtacaagattattttaagaaataacaaaggagaaaagattgagctggattttgctgattctcaggtatctgtaccccagggtcaaccctgagattggcccaatctgccagaacctaagatgccattttgaccccagtggcagcttccagagccacaagcctgcatttgggaggaggtgcgcagcctccagggctggactccaaactcgagctgaaggaacatgctggcaggtagctctctcagggtccacctggggttccagctgctccaagacacagcacatttagccataaacatggaagggctgggacctacaggaggctcctttgtgtaraggccagggcaggcgtgtgaccttgaaccaggtggacatgaggtcccttgaactcccttctctctctggcttgttcccctgaagcactggccccccagtgctgggcttatttggccatcctgtgccagccccctggtcacccaccgtcacagtggaagctgctccctcctcttacaatggtgttccttgctctggggtctggggacaagaccatctctttccactcctggacgacactgtgcactcagtcagccgcctcctacctgccctcctgcacagggtcagaacctcctgacctggacttcgccctgggcagcttccttggaacttgttgcagcttagcatctttggaagggagcactggactaggagtcagaargtggagttctgggtgctgttttcccactcttgggccctgggcatgttctgttctgtgcatcagatgttttctgcctgcctccccctgagctgccaccagagccacctgtagacccctgcttctcctgcccctcctgtcccttgccaggcctctggactcagtgcttcctgtcccaaggacctgttgtgtgcccagcttggaagacagtggccactcacatccaggtctctgcctggctatttgctccatgaacccatctcagatgcccctgcccccagggagccaggtgacagggtgaggtcaagtgacaagcagtaggtgtgggagaggtttggtggggtcaggcccacatgggcccagccatccactccccttccatctggagttgggggagtctgagctgctcctggccaccccatctgccccaccccatcttttcctggccaccccagctcccaccccatcttctcctggccaccccatctcccaccccatcttctcttgacaccccatctcccaccccatcttctcctggccaccccatctcccaccccatcttctcctggccaccccatcttctcctggccaccccatctcccccaccccatcttctcctggacacccccatctcccaccccatcttttgctacagccagggttagctcagcaggtgaaaaccccgagggtgggtgaaacccctctggggctcagacatrcaaaccttgggcatctctctgtcccagctggccccgccagccggtaggaagtttcccctgagttctcagttttttcttctgaaaaatgaggggttgtatgcaaggttctcctcctggcctgtggtccccagagaagggcaggaaggaaccttagataattctcatatgcatttaacagacgaggaaactgagacccagagccgtcacatcaatacctcatttgatcttcataagagcacctggaggaggggggtggggtgtttgtgtttgtttaaatttttttttgtgaaaaaaatgaagataggcattttgtagacaatctggaagttctggaccggaatccatgatgtagtcagggaagaaatgacccgtgtccagtaaccccaggcctcgagtgtgtggtgtatttttctacataattgtaatcattctatacatacaaattcatgtcttgaccatcatattaatatttggtaagtttctctctctttagagactccmcaataaagttttcaacatggtaaggttttccacctgggcatttggatactttggtttttgctgttgtggccaagacggcacaggccacatgcgcctgtgcaggagtctctgtttcccagcacagttgttgcgccaaaggccttgactttttttttttttttttgagatggagtttcactcttgttgcccaggctggagtgcaatggtgcaatctcggctcaccgtaggctcctcctcccaggttcaagcgattctcctgcctcagcctcccgagtagctgggattacaggcatgcactaccacactcagctaattttgtacttttagtagagatgaggtttctccatgttggccaggctggtctcaaactcccgacctcaggtgatctgcccgccttggcctcccaaagtgctgggattacaggcatgagccaccgcgcccagccagccttgacctttttgttttktttttttttttgagacggagtctcgctctgtcgcccaggttggggtgcagtggtgcaatctcggctcactgcaaactctgcctcccgggttcacgccattctcctgcctcagcctcctgagtagctgggactacaggcgcccgccaccacgcctggctaatttttttgtattttyagtagagacagggtttcaccatattagccaggatggtctcgatctcctgacctcatgatccgtccacctcggcctcccaaagtgctgggattacaggcgtgagccatcgtgcccggcccagccttgacctttttaaaggtccctgttggtccaaattttctcctgaaaatctagaccatttcacatccatgaggagggattatatggtccagtttgcagataggaaaagagaggccctgtgaggtaatgggatccggcccaagatacaacaggtgggtggtggagctgggcgaaccctgggctcctrcgcttggcggccatgcctgcccagcagaatgtcattggcccggaccccctccttgggagcggagaactcggggactgatgccaggccccactccctggtttcatcactactcagattttctccccaactgttctctcattttgataagagggatcccagacagactctggaagcgccgttttgcgggtgggaactgaagggaaaagkcctctctctgagcctgtgtttcgggccagcttttcctgaaggagggtctgattcccaccaggtccccagggccctggccggtgggggcaggcctggctgaagtctcgcttcctcctggggcttcctgcaggcccctttcacttcctgcctggtagccagaggctgggggctccaggaggggttgtggaggcccagctggtgaggccagggaggaaggcctgaccccccactttcgtttcagcagggatggctcaacacagcactatccctgcaagctggtagcatctcactgggcctcaactctctgggcccctcttcccatctgcaaaatggggctcttgaggcccacctagctgtccttggagattgaagaggtcctgtggcatgtagggacagagggacccctgctagagccagggaacgcccccagcagggaggtgtgagcaggcctggtcctgccctcatgacccgagggtggggagagaatgggggtgcggtagaaacgactgccccaaatagcggaatagcggggcagagtcggggagcaaccgggaggagagagatgccagagttccccgcccctacgctttcctcccgggactccgaagggcgctcagtggttggcgtgggggacggggggagggacgctactggggtcccgggacccagaggaaccttgggcatctctccactcccctaggctgcggataatctgggatccaggcccgaatccagcgacttcggggcaagcgagtctctgcgcggcttccgccgtcagccccggccaccaccggccccgggagatttggacgtggggcgggggtagggggtgctgccaaggggcggggtcaagaagagaggcggggctgagggacccccaagcctcaaggtggccggaaaggggcggggccagcggcatgcctaaggggtggagtcaaggccaaggggcgaggaaaaagcttgggaccggataaggggcgggaccaaggccaagggcgcctgcttcgggctcccgacctctgcgccctcgggagtccgggtcctcacgcgcatcccgagccctgggggcctggatgcggcccacggccccgactcaagggcgaggctcaggggrgagggcgcaagacgcctccgcacagaactgtgaccgaggagcaggggggctgccggggagggcgcacctgtccccgtgcacgcgctgtggcctccgtggagctctgtcctctcttggttcccgcgctaaggtctcggtgtccgctccggattcgcacgtacactgagggctttggagcctcccagtcccgccgctccctggcgacctcaggagcccgggcgccccctccctcccacgggcagctggagcctgagtcagagttgcctcgcgggagacaaagacagccgtgggccctccctccagaacccctcctggtatcggcatttgcaccagcagggagcccagagtccccaagagcctctgcttcttgggtaactgcatcattgaggaaatggaagtgaaattagcttaggaatgaggccttggaggcttgtgggtggcatccgcggtcacggtcttctcagcctggcttcagtgtctctggggcccactgcttctccctgtaaccctgccgaaatgctggtagcccatcttgcagatgacaaaactgaggcctagaaaggttgaatggccctgaagagcaggaattccaacccggtcagcctggctccaaaataaaggataaaggctgggcgcagtggctcgcacctgtaatcccagcactttgggaagccaaagcgggccgataacttgaagtcaggagttcgagaccagccctgccaacatggtgaaacccccgtctctactaaaaatacaaaaattaggccgggccccgtggctcacgcctgtaatcccagaattttgggaggccgaggcgggcggatcacctgaggtcaggagttcgcgacccgcctgatcaatacggtgaaaccctgtctctactaaaaattacaaaaattagccaggcgtggtggcgtgcacctgtaatctcagcaactccggaggctgaggcaggagaatcgcttgaacctgggaggcggaggttggagtgagccaagatcgcgccactggactccagctgggcgacagtgtgagactccgtctcaaaacaaaacaaaacaaaaattagccaggcatggtggcgggtccttataaatcccagctactcgggaggctgaggcaggagaattggttgaatccaggaggcagaggttgcagtgagccgagatcacaccactgcactccagcctgggcaacacagagagactccgtttcataaataaataaataaaacctagaaactctgggcatgtggggctggaaaggggttccaggaagagagggcagcctgcgtgaccagacagggggcaaatgagcctgggtcaggtgttggcaagggccctgtcgtggggtaggrgtgcctcccgggtgtgctgaactggccagaatgtggattcgggactcatagtgcaggttccaggccagaccctgcccttcctggctgtgtgccagtcacagcaagtcacttcctctctctgagtcttgagtttctctctaggaaatcccaaacctttcccagggctcagcagagctggcagactggtcacccaccacctaaaatggggacactgaggcccagcacaggctgtttgtcatgtccacacctctcagggcccccagccttccccagccagaactgagcaccaggtgagggctggacatggaggaaggccgttcgtgcacaggagcatgtatgctgacaaacacgtgtgcacacacatgcccaccgtgcagggaaggccctcatagtcatgctagccccagacatgcacactcttgctgtcacccaaacacgcgcagacacccgcacactcgagctgccagcattgggagctgggggcggggcgggtgccyttcaggagcagggactcggctcctctgcccgccccgcggggcttgctgcagatgccaggggttattttaagcctggatcaatggatgagttttggtgacacaggcttagtggtagtggaggggggcaggcagaagagataaggggtggctgccctggagccttgatggggtgagagacccyggggtccagggcaaaggggtcactcctcggccgggctgctctatctccagatcccctcacccggcacatggccaggcacctggggcagtgtcagctgaatgggcgatcagatcccaggactcagccagtcagggtcagctgggctctgtgttcacagctgccctctcctgctccactcactccccgcggccaggtgttcccatggagagaagagggtatccagtgcctggcacagacccagtagttatggttacctatggctgctggctgaccactgaatcagattgagacggggaggaaggtgtgtgtgtggtggggggtggggggtggtgttgggggttggacatcagtccctgggaggggctggaatccacttccttcattggacaaatggctgtcactatgtatatgtatgtgaaggcctgatggggtcaacatgaggaaagcacccagtgccaggacggtgggggcaggagggtgtccaggaagggggagcactgggagacttgctctgacccctcactctaacttggaagaggccccagttccaagggggcagagacaagcctctttcaacccagtgcccggcaacgggtgggaaaggtgggagaagaggcccccctcagagctcctgcagcctccagggcagtgggcagagggcggtggggacttcaataccagtgatacgggttgtgccacggattccatttctaggaatggccctaaggaaaggaagcaggaaaggacgctccagaaagtagagctcagaagctctgagaagaatcacaaatgagaaggtttttttttgtttttttttttttktttgtttgtttgtttttttaagacggagtctcaatctgtttcccaggctggagggcaatggtgtgatctcagctcactgcaaactctgcctcccaggttcaagcgattctctggcctcagccttccgagtagctgggattacaggcatatgccaccatgcccagctaatttttgtatttttagtagaggtggggtttcaccatgttggtcagcctagtctccaactcctgaccttgtgatccacctgcctcagcctcccaaagtgttgggattacaggcgtgagccactgcccccagccaaacgaaaagtttaaggatggcaaaaagtaaaccacaaactagttacaatccagcatgtaaatgtggcatattttagtgtggttgtctctggacatgggattaaagcaatttcatttaattcctttgttcatctgtgttttttcttctaaactggtaataaggggtcctttaatgagggtgggttttcggggctggatgggaagtgtgtgtacatgtgtgtgcacatgtgtgtgtgtaggtggagggagcaggctgtctttggccagggcacaaggagaagctctgagtggggaggtcacctcctcttcctgtctgaacccattaatacctgaaattagtctgtcagcccctcatgtcaggcaacagacttgatcctccttaaaatgtaaatccttcctcttcttctcccccaccttctccactttcataagctggtcccagttgctgagagaaggacggatggaaaggggaccaggagggaccctagggagccccaaatgtttcatctcacagaaactaggcgctggagtcctttcattcatttattcattcagcaaatgccgacagaggcctgagctgcacactgggtgaattgcacgcccagtccttgccctcctgctgtttccgtctggacagagggaggttccatatcgacccctatctcctggaaggggcagattatgagtctgccctccaggaagagtctttgatgttaagatgagatactgaggcagggagaagccaagcaccaggaccttctccagttcaactcaaccccgaaaacaccactgggccgtgctgggaccgggtccgggctccttagggcccccacaccctacccctcggtttgtgaaaggacctgcgggtgggcgcagggcggaggtcttccttttccaggctttccttttccagggcaggggcgagcccagtccccctctcctcacacctggggagggagcagatcgcggaagtgcgtcagccaagccgtgcccatcgacgcagggatggggacatccctggaccccagcccagcgttcgaggggttctggaactgggctcgcgccgtggggtaaatccttggccctctgaagcggcgctgccaggggaagtccttcccatttgacaggtgggaaaatcgaggcgccgagaggggaaggggccctccttatgttatgatcagaacggacagaggggacgggaaggaggtgagagggtggccctgcccgtcccggggcaattccgggctgctttgacctccgcgcctgtaaggtacaggtccccgcacctgtaagacagggacgctctastcgcgggccctagaactgatccccttcgagcgcccagttccgatgaatgtttcggggcagtctttgtggaggggggttccctgtggggcctcccggctccgcggggcctgctgcctcctctcgcccctcgcggcagccgcgctcctcccccggctctgcctcccttccgccctccctcctctctccctcccccgcccgcccgagcccgcgccgagcccgagcgggagccggagccggagccggagccagagcgcgggctgtactgagagcgcggcgggaaggtagcgcagtcgggcggcccgcggccccggcgcggcctccgctagggccaagacccgcacacctgccgggccggggagaagccgggggccgcgcgcaggcgaggacccgccgcccggcccggggaagatcycaggacgcggaccgggcagctcgggtccgaggtgagcccgggcggaggacgcgcccaccggaggtgcggcctcggagctccagacccagcccactcggggctggggtccccagaggaggccgacggccgaggcggcgtgcgccgggagccagcgcgatccctgcgggagcggaggagccgagccggagggagccgcggcgcccggccatgcaccgggcgcagtagcgggaggcgcgggcccgatggcgcgggccggggcgcggggactgctcggcggccgccgtcctcccggcctccggctcgcgctcgcgcttcggctcgcgttgctgctggcgcggccgccgtcgggccgcgcgggagcccccgaggcgcagggtcccgcggcgcccggcacgacagccccggaggggggcgaccgctgccgcggctactacgacgtgatgggccagtgggacccgcccttcaactgcagctccggagcctacagcttctgctgcggcacgtgcggctaccgcttctgctgccacgacgggccgcggcgcctcgaccagagccgctgttccaactacgacacgccggcctgggtccagacaggccggccgcccgcccgcgcccgcgacaccgcagcgccccgggaccccggccgcgagcgcagccatacggccgtctacgctgtgtgcggcgtcgcagcgctgctggtgctggccggcatcggggcgcgcctgggactggagagggcgcacagcccgcgcgcgcggcgcacagtgaccaggtgagcacgcgccgcccagggacccccgcctgctcctcggactgctctccctgcccgctgatccttcccgccgctctmgaagcgctggttctcccagcaggccccttctctgggttttcctgtctccttctccccccgccgcccccccaacacttcatcagggagacacctgacaccgccctgactccctttgaccttctgcccgtgctgggcgccgcaccgcctttccctgctcgagtctcctctggagggcaggggggtgggggcgggctgggagggggacaggtagccttgcacagagggcaccgggtcactgtccagggtaaggggcgccgctggccagggaggtgaccgggcgtcttgggcacgggaaaggaaggggcgcttggttctctgggtgcccatctcctgcttctccccactcctccctcccctcttccacctcctgcctctcccctgcccccacagctgtgactcaaggctgcccttccctccttgggtttcaaaggcctccccccactcaccccatgccacagctcccaggtgaaggtcagggctccctctgcgtagaaaggggactctggaacacagtcgtgtgttgctgaggccaggacaggtgcttgttgcattctgagcttggtgtgaagtgggcactacagggtccaggtccccttcctcggttggaacgaggactctaggactctatgtgtcctgaccctggamctcccacccacatgccacacgtggcactcacatgcccccagcaacccccatgccctggggcctgtgccctcctcatccacccggtcccagcaccctttgggcctgtgggctgctgacaccgaatgtgacaggctggtatttaaaagtgaccatagagaagccttcataccctggyaggccagatgtggacacttccccctcctgggcctcagaggcagggggtgasggcttccttggcacttcagcacccctcgctcccraaaccacgtagcccactttctcccarggagctctaarggaagcccgggctggcaccctggcctccaccctcagcttctgcactgccttcaggaggtggagcctcctggcctggcttctggatgctgcaggggtaggggctgggctgcccaaatttgggggtcccccatgatgggtgagggtagcttggaagaggcctggatatgtctttgacaggggcggggaaaaaggaacttagggctgcratggtgaggggtggctgcagcagcccagctgacatgttcatcctgaactccctgcacctgctggggatggggcagcaggtttggtgatgccgcaggaaagccatgcccacccttgctgtgctgtgtggtgtaggccagtcccttctcctttctgggcttcaggctcccatggccccractcccttttctctgctggggagacctggaatgggacgtaggcttgtgtgtgggtgtgtcctgagtccctgtcctcccctcgagtctcacccttcattctgctgtgttggggttgaaggccagggaaggcttctcagagggcttgggcggggcatctggaaagagtttgtgcaaaggcccagaggcgtggtggttactcagctgtcagggagacaggagcttgaggtgcttgcccagagatgaggccacagaggtgagcctctggggagagggcagggcaggaaggtcagcccaggcaggtactaggatggtttcagaccctgccaccaaacctgaagccaaacctcggccatccctggtgtcctgcctcctgaatgaccttcacgaatcagccatttgaggctctagccccggaaggagggtcaggctgagtgggagaaaatcatgggttccgggttctgaaggcagctgggctgcagacactgtcacatcacagctgggtgggggctgggtgttgggtccaaggaggtggctgtccaaggtcacacagcctgtgggtcctgggctgccaccagggggtctcccaamatccccattccgtcacccatctgtccttcatgcccgtgatggcagctttatcccaggtcccagcagaagcygcggctgcaggggcagttaggcaggcaggtaaataaggcatcctgggccgggcgcggtggctcacacctgtcatctcagcactttgggaggccgagaccggcggagttggagaccagcctggccaacatggtgaaaccccgtctctactaaaaatacaaaaattagctaggtgtggtggcaggcaccttataatcccagctactagggaagctgaggctggagaatcacttgaaccggggaggtggaggttgcagtgagccaagattgygccattgcactccagcctggacaacagagcgagactctgcttcaaaarataaaaaaattwaaaaaaaggattcctggaggaggccgctgatggggtctgaagaatgagtagcagttttttgggagaagaggcaggaaagcagagaaagctcgcattgggaggggaggctcacctggggaaggtccctgagagtgggctccagggaggggaggggagggaaggggagcctcattagagtttcctgacctgctctgggaagcagctgtcttggggccacaggtgaggctggcagatactgcctgggaggggaaactcgtgcgtgatttcgagcaccggagaggacggcctggagaggccgaaagaactgcccagggccacacggtgagacggtggtggccggggctggcttttgatgaggtgggagacagagggccacccctgactgctgtccccgcagggcgctgacagagcttctgaagcagccgggcccccaggagccactgcctcccaccctgggcccacccctgggtggctgtgtccaggtgcagatgggggacggcctcccccggggctccccccacaacagcgcaggtgagtcggtggcgggcggggctgagcggcggcggagcacgcggaggggcstgagaggccgagaggcggtccctcggctggggcatagaggcttccccggtggaaawgagccgcggcctctgcgggtgaggggcccgaccggccagccagctcgccagggtggaaagggaccccccacgggtcctgcggcctcgagtctggggggctgtgatgtgtgaggaaggttccagatgcaggatttgctggccggggctgtgatctgaggctcgggctccagagcctccccctgggtctctcgagaggcaggcaggcttggcagcccccacgccccgtctgggttctgttcctcagacatcccccgtctcggcgggagcaggtcccaggactccgcgcctggctcgagcgtcgcctccgggcgagccgttcatgagggtggcaccccccgggctggctgccgccgccgctgcgcgtgactcggagccaggccctgttccaggcgctggaggctgcggcgaagacaggcttggctcgcagcctcgcccggagaacggtcccccaggttctcaccgaacggcctcggggagaggactacggagaggtgacagcgagggcggagtgaaccggggcatcggaccgagccgcgtctcactcctcgctccagacaagaagcgcctcaacaacgcgccccgggggtcggccgccccggggcccccgcgcggcccgcggctgcagggcggcggcagcctgacgctgcagccagactacgccaagtacgccacgttcaaggccgccgcgctcaaggccgcaggtgagtggcgggtgcgggcagcgtcagggcacctgggcgcacgagctcccggactgcgaagcgcggggccgcagctccaagcgccaaattcccagttccgcgcgcccgccgctcggccaatcggctccctcgccccagcgggccccgcccccggcccgccccggcccggtccccgtcccagtccccggccgggaccccttgtccagtcctgagcttgggtgctcggcgcggcgtcactcttccctgccctgtccccgcagaggccgccccgcgggacttctgtcagcgtttccccgccctcgagccgtccccgcggcaacccccggcgcgggctccgcgaccatccccggacttgcctgcgccgctggacgcctgcccctgggccccgccggtctacgcgccccctgccgcgccgggcccctatgccgcctggacctccagtcgcccggcccggcccgccccgctcagccacccgacggctcgggccttccaggtaccccggcgacccgggcacgcggcccggcgccagttcagtgtgaagatgcctgagaccttcaacccgcagctccccggcctttacggcagcgcgggccgcgggtcccggtacctaaggaccaatagcaagaccgaggtcaccgtgtgaagcggggccgcggtgccctcgaggcatgggctggggtcctgtctgcccgtyggagcctcaggccacagggagaggagcgcctgccgtaaggccagctcttctgtctgcctcaacggcagtggtgtcttggagcctgcaggccgcgggttcgtcttgtaaataagcccttttatgtggttcctgccyctgagaataaagaagccccagcgtggctgcgaggcaccattggtcactgactgtacagatggcagtgcaggcagwgggcacggcgagtgcaaggttggaggactgctccagtgcaccggccagagccagggggaagtggctggagaggggggccagggttgaatgtcagggttaatgcccacccccgtgggagccctgggagagagggaacagttagacttcagccatagaaaggcccgggcacaggagagagggctgttgggtccaaggcccagtggggggtccatgccctgtactgaaggtgagccccctccagccgccactctgcagcttgagttggctgaacctggctgatgctcactgaccactggctgtgggccagcccctggcctgcaggtcgcttggccagattggccccgggctaccccccttaatgggtgtgggccgtgtggacatctggtgctccggatgggggcgcctcctcccaggagcttctctgaaggaaatgggggaaaagctggagcagggtccctggcagtgtccctccgggagggcttcctgcacctggctgtggtccagagcactgctagcagtctgcgtgcatcttccacagagttcctctccgccaggtaacactggggaggctaggggtcagggctgtggctggttgaggtgtgtgatgtggggaggctaggggccagggctgtggctggttgaggtgtgtgatgtggggaggctaggggccagggctgtggctggttgaggtgtgtgacctcagcaaagccacccaggtgggtctgtttccctcctgagtacctgaagtgtgrtgtactgttttaagaacaatggccaccatttgttggcctttctcaggaaatccacaagcgcctcaagtgggtgtgtctttacagaggaggaaatttgggttttgaaacctaagtagcttgcccaaggtcacccagcagactcccaggttaggactctcccgaattgctgtgaatcggctggaatggcaagcaacaggcagtttggctgggagggagggttctgagggttggtagggaggggtccctgttcccagggtatatataaacagtctggagctttccttctgctggttgggctgccctgaggccccagaacccaccaggcccggtctccgctcctgccacaaagggtccacctccctgtccctttaggctgttaaggaaaccaaggcctagaagcaccaggacagagctctgggcccacggtcctgcccctgtcccacagctgtgcagagctggaggagggtgggggctgaggcatggagcctacacagactcacaaaggaatctggttgcttctcaccccacctcccaccccctgctgggctgtgccaagagtgggcaattccccctgctcattctcagttccaagggccctggatctccatcccagtggagccaggctgaggctgtgggcagtggccatccctgaaaatgatggagctgtgcacgggaccagctgcaattgggcctcaccgggctgctctggtctcagggtagcctgctgtgactacccttcagagaaggatgtggctcatagmtgagggattcagccacatgctcagtcacatcctgactcctcttgcgacgaggcccagcactcccatcccagtctgtggtcctgtcccctggtgtgtcttacgccaagcctggcctcaccagccacacaaggcactcgctgtaaacttgcatcccatcactcagtcctggcagacaagcctttggagctgcagttcatggctgagcttagcttcccaattctgcacacgtggaagtggagactgaggccaggtcccaccccaggtgacccagctgggaagcacaggacctggacttggatctgacttgtgggccagtgagcctcctggctcagaggatcactgacttcagggagggagaaactaaggagcagtttacccagtgggggagagggtcagcaccccaaatctgtcagccagcctgcattacatccagggaacaagctggaacctggatacagtgacctctgacccccaaagtgccacccacagcccttttatcccaggctggagggtgcgccaggcaccggaaggaaggtggacaagggaggcccattagactgaagccaggggccctctcagcagttggggggctgccctcagtccctggcccattgcctgccaagtcacgcagccccttggctgggcaccacagcagtcgcactacagaccctcacacacctcgtgctgggtggtaccaatctgtgtttattgaatatgtctgggacacagtgactgattgattgaacatcaagaaagctataggtgtaccccccttttcagtgaaaaaccaccccctcccacacccaaacaatagtgagaaaaggcacaggacatacacacaacacgcaggcgggcagggtccataaattacagtgagagtaggggaggggcaggagagaaagaaagcaggtggggtccaagcacaccccagggataacattccagcctgcatcaaggtggccctgctgtgagcaccccccagtctgtgctggggctcctgcccaccctctgctccaaccagcctgaggatgaggcacagggaggcagggcccatcactcaggaggccatgggagaaacagtctcygggaggtgctgcacctggggacccagaaaagtaggactttttctcctaggacccgcatcgaggcaggggacctcattcctagtgcccaccataggcaaccctctgcccactytgaaaagaggggcttgccgctggggagggattaggggttggtccctgccatcctggtttatttattttcagctcaagaattaattaggtttaaatatatacagatatgcctcaacttaccatggggttacttcytgataaacccatcataaatgaaaatatcctaagtcacaaattcatttaataccccaacagaccaattgtaaagttgaaacatggtttaagttgaaccactgttaagttggggacagtctgtactgtggaggtaggagatggggtagggggaggagggaacctagaagccatgctgaaggcccctggtccccagtccccaygggtggcttcatttctcccagccccctgggcctaccctgagcttgggctaacatcctaggaggcggggagtgggaaggaacaggacaattaaataagataccatttattttttaaaaaattaaaaaataatgccaacattatttcatgcatcygcaggcctgccccctgcctcccaccagcctcccagggctgggcccccctcctcccctggctgtcctgtgtaataaagggaaaaacaatgagcaggctcagtcaggcccaggggagggaacgcagacccagggagagaatcaagacgctacagcaactcagcctcgcatcatggcaaacccaagcacactggtagaaaacattcgtataaaaaggggagggcatgctgggcacaggcctgagggcaactgctccctggtgctcagagactgctgtcccccagagaaagcctgataaaaactgaggaagcaaaaaggagagagtagggttcaggagagagaaactcaggaaggctggaggcaggggcttrgcagcttgggagctccccctgctgctatcaagtcagggctgcccagtttctgccctgccacctatcctctcacgcccaccaggccctggaccatgggcatctagtgacagcagctttaaggggctctgcccaggggtgcactggcctgagtggcccagaagcctcggcaggtgacagctaagaagacaaggctcytccccaccactctcagcgggaagatgctgagggggrgagagagaaatcgagagagaggtggaggggtgggctgagcctggtggtcaggaggcggcaatggcagtgccaccacccagcttaacaatcatctgctggcagtcgttgcaggagcgccggtcgcccaccttctccagggtgcgggcagcttcggccagcagcactgcccgctggcccggggaggagaggaaggagaggggcaggtggcggcaggccagcaggatggcggtggcccgctctcgctggccgggccaggcatccacctctcctgtgggaaggagatgtgtgtcacaaccgagaatctaccatgaagttggtgcagttccttggcgttacctggactcattcactgaacgctcacatccatcctgggaggtggrgtctgctgccccacccaatccacggaaaagaagtgaacttgtccagcctctcacggccagcccgtggtggggctgagatgggcccacatgacctggctcgagcttctgcttctatgcctgcacctgtgctgggacgccaccccaaccctccttccctgatcacagcatgacccatgaccaccccaacccctgcaacccrccaagggcggcctcgggcttctttcattctcagagaggcgagaggtgtgctgggcaccaatgccagatgtgggagctgggctggcccctcttctcctctcttcctagggcgcagggccyggcccagcctgtgagctggggaggggtggactcaccgtgcttggtgctctgcgtggtgcgccgcckcaggctgtgttccagcagctggtgggtgcgggtggggctggctcctgccatcaggcgcacggtggcttcatgcaggaacacctggggaggtgccggggtgacatccatcacacccctggtccccacccatctatgcccagggtagctctccctgagccatctcgcctgccacctcatgacatcccttcccacaccaccctgccttgctcacccctgaaaagcaacstctgttgtcccrtactctgaccctgagccaggcaggaaacctggctgaacagcaggagcaggatgagaggagagagaggcaaaaggcctgcttttcccaactggtgacaagaaagccctggacgcacctygtggggctggtagacaagtgccctgggtgaagccccaaggccctggaggctgcctgcagtttgacaaaaggacaggtgtgacagggacagaggggtgaggagggacagttgggctggtaccagagaggtttggtatcctctttccgtatctttagaaaggaagagagtctagaggtgtgcgggtaaagtctgcagcgcttaggtatgagccactggtgggtgaagggcaaggctgaggtctgtcatttcttaaaatctcaagctctttttgatgcctttatatctcagtcttcagggagggtcttcagtgctgccaagtggattctggtcctggtaggcaatggggagccgctgatgggctctcagcagggagcagcagaatggaaatggtatttaagaggaggcctttggaccaggcraggtggctcacacctgtaatcccagcactttgggaggccgaggcaggaggacagcttgaggctaggggtttgagaccagcctgggccacatagcaagaccccatctattaygaaaaaaaggccactgatgccagccatgctgtgagcagaccagagagctgaccagagtgggctccaggaggcaggggtgccgctccaggcctggggtacatgccctcttctccacagtaaggaatggctctccgatgatactgtctgttgtgtctgtcttggcttgctgcacacagtggccacagtgcaaccctgggtgggccccgcagcacctcagggtgatgggtgtgggggctgaatcccaagctccacggcagcagcctcgctctgaggccttcttccagcccag

SEQ ID NO: 13413 - DNA, 12722 bp, Homo sapiens
ataaagctctacaacaagaaaaattcattagtatgatgtttagagatacatataaagtactgaaacttttttttttttttttttttgagacggagttttgctcttattgcccaggctggagtgcaatggtgtgatctcggctcaccgcagcctccgcctcccaggtttcaagcgattctcctgcctcagcctcctgagtagctggaattacaggcatgaaccaccatacctggctaattttgtatttttagtagagacggggtttctccatgttggtcaagctggtcttgaactcccgacctcaggtgatccacctgcctcggcctcccaaagtgctgggattacaggagtgatctaccaggcctggccagtactgaaacttttttaagggaataataacagcattcagggccagacacgatggctcacacctgtaatctccgcactttgggaagctgaggtggtggatcacctgaggttgggagtttgaaaccagcctcaccaacatggcgaaacccggtctctactaaaaaatacaaaaattaggctgggtgcggtggctcatgcctgtaatcccagcactttgggaggctgaggtgggcagatcacaaggtcaggagattgagaccatctggctaacacggtgaaaaccatctctactaaaaacacgaaaaattagcctggcatggtggcgggcacctgtactcccagctacttgggaggctgagtcaggagaatggcatgaacccaggaggcagagcttgcagtgagccaagatcgcgccactgcactccagcctgggcgacacagtgagactccatctcaaaaaacaaaacaaaaccaaaagaaaagacacgaaaaaaccagcattcaggggagtagatgaggagcatgggggtgggaagagaaggaygaagctggaggcaagggtgatggctggtgggtttatgggtgctcgcttcgtattatgctccataacttacatatatattttattagatatcatgtttatgtatatatgctacataataagaaggcaaggccgggtttggtggctcacacctgtaatcccagcactttgggaggccaaggtgggtggattactagagatcaggagttcaagaccagcctggccaacatggggagacccccgtcttggaggtgagaatggtttgtttagactctagactagcactgtctagtggaccgttcggttatgatgtgtattagtctgttttctcactgctatgaagaaccaccttagacagggtaatttataaaaagaggtttagactgggtgtggtggctcacgcctgtaatcccagcactttgggaggccgaggagggcgcatcacctgagatgccaatacaaaaattagccgggcgtggtggtgcacgcckgtagtcccagctactccggagggtgaggcacgagaatcgcctgaacccaggaggcggaggttgcagcgagacgagattgcgccactgcactccaggctgggcgacagagcaagactccatctcaaaataataataataataataaggcattttaaaaaatgaaagcctgtctccaacgccctaacaaccaaggtttctactgcagcgacagtgtgaccactgcactaactcctacagggctctcaaaggcccaggcactgcaacgggtgccggtgcctggcctgaaaatcccagtcccagagatctgcgggggtcctccatgcttccccgggggccttgcttcccaccgaccacccttagaacaaacagcccatctgtgcacccttctccctcctctccctgaccccctcgcctggtgtactcttccacgaagcagcatcatcccggattcacatttatttgttgtctgttgccacccagatgcgtgtgcagaatatggctctatgggagctggaccctggctgggtcatggcccaagccccracgtgcacatgcctggcggcaagggggctcaggaaatactgcagagttaacagaagcagccgggggcctgtgatgtggatggagagaactggggctatcaacctgagctgctctcttgacagctgaaagcataggctatgttgctgtttttaccctgggtagacacgcctctggtaaatgtatgatttgttagatattttgaggtctggaaaacagtcatcagaccctcataagcaccttcaaggactctgatatggtttggccatggccccattcaaatctcatcttgaattgtagttcccataagccccacgtatcatgggagggacccagtgggaggtaattgaatcatgggggcaggtttttaccatgctgttctcatgatagtaagtctcaagagatctgatggttttttttttttttttagatggagtcttgctctgtcgcccaggctggagtgcagtggcgccatctcggctgactgcaagctctgcctccttggtttatgccattctcctcagcctcagcctcctgagtagctgggattacaggtgcctgccaccacatctggctaattctttgtatttttagtaragacggtttcaccatgttattcaggatggtcttgatctcctgacctcatgatccacccatctcagcctcccaaagtgctgggattacaggcgtcagccaccgcgcctggcccaatctgatggttttataaagggcagttcccctgcatacactctcttgcctgctgccatgtaagacatgcctttgctcgtccctcaccttccaccatgattgtgaggcctccccagccatgtggaactgtgagctcattaaacctttttttctttatgaattacccagtctcaggtatttcytcatagcagtatgaaaacggactaatacagacccctaggggtccaggatcccagctggaggtaaccattcctaggtgagccttaaagtactttgcaaagttaggattccgcatttccacggcagggtgacctcctggggtctagggctcttcatcaccctcattggcatcatcaccgtcataatccagaccccagacagatgtgtctgaaggcagttgggtgtgagccaggagcccagcggggactgggctggaggtgtgaatagagaaactgccttcagcttcagcctcaaaacctaccacaggatcttaaccccaggtctgcactgagcagccagcactagtggctacttaacgtctgaaatacggccagtgtgacttaggaactaaattttaattttacttaacttttattttgagacaaggtctcattctgtcacccaggctgggtgcagtggtgcaatctcagctcactgcaacctatgactcccaggctcaaataattctcccatctcagtctcccgagtagctggaactacagacacccaccatcacacccagctaattttagtatttttttgatagagacaggtttcaccatgttggccaggctggtctcgaactcccgacctcaagtgatctgccagccttgatctcccaaagtgctgggattacaggtgtgagccactgcgcctggtcttaattttaattaatataaaattttaaaatggaagcagtgtaaatgtttttatattaaacacaactttattgctatagtaagactacatttcactctgttgaaaattgagcctctgaattgagatgtgtaaaatacacaccagattttaagacttggcacatacaagaaggtaaaatatctcattaataatttttgagctgtgtgtggggtggctgcacccttgtagtcccagttacgcaggaggctgaggtgggaggatcactggagcccagaagttggaagctacaatgagctgtgatcacaccactgcactccagcatgggcgacagggaaagaccccatctcttaaaaaagggggtggaggggttaaagaaataataattttgatattgattacatgttaaaaatggtactattttggatatattgggttaaataaaatatattaaaatgaatattacacctttttcactttttctaatatggctactagaaaatataaaattatatatgcagctctcattatatttatgttagacagacatttccatcatgatatggcttggctttgtgtccccactcaaatctcatctcaaattgtaatccccacgtgtagagggagggatctggtgggaagtaattgaatcatgggggcggacttccccttgctgttcttgtgatagtgagggagttctcacgagatccaatggttgtttttttgtttgtttgttttctgttttttgtttttttttttttttgagacagagtttcactcgtttcccaggctggagtgcaatggcacaatctcggctcactgcaacctccgcctcccgggttcaagtgattttcctgcctcagtctcccgaatagctagggttacaggtgcgccaccacacccggctaattttttgtatttttagtagagacagggtttcaccatgttggccaggctggtctcgaactcctgacctcaggtgatctgccctccttggcctcccaaagtgctgggattacaggtgtgagccatcgcaccaggtctaaacctcttttctttataaattaccctgtctaagatggttcttcrtagcagtgagaaaacagactaatacacatcgtaaccgaaaggtccactagacagcgctggtctagagtctaaacaaaccattctcacctccaagcaacccggttcctcccacatccacttttgatttaagctccctgcctgggggccctaaccctctgattctctgaagctaagccctgccttcctccatgtgaagctgtcttgcctgtcctttcctgctggtaggaaccatcttcctcccttaatatccactatttataccagacttcagcacttaggcttggagaactaatttcctcttcagctcaatttttacattaaaggcagttaatacccttctctcttaattgagcgccttgcatataaggaatggtaactgatgattctaacagtattaatagcacctttttttctgtggtgctttacagctcaaaaaggatctgtcatctccccacaaccttaagagggaagacaggtagagattttcatagccattgtacacatgaggaaactgaggctctttgaggttattttgcacagatcataaggcttgttaatgtggcccccatttttccactgtaggccagtgctgtttcccctccatgtgcttttggtgcccacgtgaaaatgcagacagttaaaactgaatatagagctgggcgcggtggctcacgcctgtaatcccagcactttgggaggccgaggcgggcrgatcacgaggtcaggagatcaagaccatcccggctaacacgatgaaaccccatctctactaaaaatacaaaaaattagccgggcgtagtggcgggcgcctgtagtcccagctactcgggaggctgaggcaggagaatggcgtgaacccgggaggcggagcttgcagtgagccgagatcacaccactgcactccagcctgggcgacagagccagactctgtctcaaaaaaaaaaacaaaaaaactgaatatagaaagaaaagactagcatggttggggaaactagggctgcttcgtgttagaggcaagacttgaactgaactttgaggaatgggcaagctttggccaaacaaagaggagtatgcggacttttggggacagaaccacagcttctgtgaaaaccaatccataaacagaattcttgattaacaaagaatgatggaattaaacatttggrctttttttttaaaacaacagttttatcaagatatagttcatataccataaaatycccccttttaaagtatacaactgagtggcttttagaatattcagagttgtacaaccatcactactaatgtcagaacatttcactacccctaaaagaaaccccataycacagattccgatgccgccgggagccctrycatgccatgtcacatatattatagtatatmtatgcccagccatggtcaacccaccgtgttctttgacatcaccatcaacagcaagcccttgggccacgtctccttcaagctgtttgcagacaagtttccaaagacggcagaaaactttcctgctctgagcactggagagaaagggtttggttataagagttcctgctttcacagaattattccagggtttatgtgtcagggtggtgacttcacacaccataatggcactggtgtcaagtccatctatggggagaaatttgatgatgagaacttcattctgaagcatacaggtcctggcatcttttccatggcaaatgctggacccaacacaaatggttcccagttttgcaactgcactgccaagactgcgtggttggatggcatgcatgtggtccttggcaaagtgaaagaaggcatgaatattgcggaggcyatggagcgctttgggtccaggaatggcaagaccagcaagaagatcaccattgccgactgtggacaactctactaagtttgacttgtgttttatcttaaccaccagatcattccttttgtagctcaggagagcaccctccacctcatttgctcacagtagcctctaatctttgtgctatctctcagttccctttgggttccatgtttgccttattctcctccatgcctagctgkatttcagagttaagtttatgattatgagataaaaactaaataacaattgcaaaaaaataaaataaaaagaaagaasaggctgggagcggtggctcactcctctaatcccagcactttgggaggccgaggtgggcctaccaaaggtcaggagatcgagaccaccctggctaacacggtgaaatcccatgtctactaaaaatacaaaaaaaattagccaggcgtcgtggcgtgcacctgcggtcccagctactcggaaggctgaggcagaggaatggcgtgaacccaggaggtggagcttgcagtgagccgagatcgcaccactgcactccagcctgggcaacagagcaagactctatctcaaaaaaaaaaaaaaaaaaagacggaaaaggcattatatatttgtgaagacatggacagaaatgtgtcctgattgtggtgccacaaagcactgagcctactagaagacgtcagcaaaagatcccctgaaaagtgactccaagccattcactgcaagggatggttacacagatgcagaatacagaaggtcaatagtagcttaatgctacatcacagcttaacactacatcawccacctcacttcatctcaccccatcgtatygtgtcactgtgctcaccatcacaagaacagggaggatagcacaggaagatattctgacagagaaagagagagaccacatttacataacttttattacagtatattgttataattgttctattttattattagttattgctaatctcttactgcacctaatttataaattaaaccttgttattggtatgtatgtataggaaaaaatatagtgtatatagggcttggtactttcttcaatttcaggcatccattgagagtcttggaatgtacccactgaggataagggggggytgctgtacatactttgcaaatatcttctctcatcccatgggttgtcttttcattttctttctttttttttttgagacggagttttgctcttgttgcccaggctggagtgcagtggcacaatctcggctcaccacaatctctgcctcccgggttcaagcgattctcctgcctcagcctcccgagtagctgggattacaggmatgaaccaccacgcctggctaatttttgtatttttagtagagatggggtttctccatattggccagcctggtctcgaactcccgacctcaggcgatctacccacctcggcctcccaaagtgctgggattacaggtgtgagccactgtgcctggccgtcttttcattttcttgatggtgtcattgaagcacaaaagttttaaattttgatgaagaccaatttatctgttttttctttcatcacttatgcttttggtgtcatatctaagaaaccattgactaatccaaggtcacaaagatttattgcctatgttttcttctaaaagttttatgattttagttcttacatcaaggtctattttaagtcttttgttttgttttttgttttttgttttgagacagggtcttactctgtcacccaggctggagtgcagaggcacaatcatggctcactgcagcctcaacctcttggcctcaagcaatcctcccacttcagcctcccaagtagctggtattatagacatgcgcaaccatgcccagctaatttttttgtagagatagggtttcaccatattgcccagactggtctcaaactcctaagctccagtgatccgcccacctcagcttcccaaagttctgggattataggcatgagccactgcacccagccccaaattttgtatatggtattagaaaggggtccaacttcattcttttacatgtggaaatccaattgccccagcaccatttgttaaaaatattttctttcccatttaattgtcctagtgttcttgtcaaaaacaattgaacataattgtatggrttcatttctggactctcaattctattccattgttgagcatatttttaagggctgkttttctctcctgtggtaactggtgacctgtacttcctggaagagagatgaaaagattcccaagccaactgagttacctcacgtgggtcaggtctctgtggctctctgcactggcctattcataatgatatcctcctgcaggatttgagccttctcctttgttgtgacggcagccgaggaggtggctgactgcccagacagccttatctctttcctacctttcaaggttattgtaaataccaaattagattgtttatacacaagaatttagcactaaagcactatacaaatgtaagctatttatttytatttatccttctccttcatgaataagaccctaaaaatagaagatatttttaatttttactcactgggctcaaggttgcagtgtctgtattattgcaaattccaaattaatgaagtctggctcttcttatattattcctgcaaaaggctgtgtgctcaccccccggagtgtgaatacgagtgtgggtcatttcctctttcctctgcacccttccttygatgaggttttgccctgtgctaggcaccatgctaaactctgagaaaaccacagagaacaaggcagacgccatccctgccctccagtaacatacaatttagtgatgaagctgggggatttaacaagccattctaataaagcgttacagtgagggaggtgcagggtgatgcctccagcagccctggtgtcagctgctccaggtccaggggaagacttccattatcttccaaccctgtcggaagtggaggcggaggctgtttattgctgacacagtccctaacccagggtctatagacattgtggaaatgccttggagtcagacgggagaatgaaccagcagaagcaatgcccgccctccaccctcctgaagagggttctcaggaactctttggaggcgaggccagcctctggctgagggcctctggatacaggttaggcctcaggctcttctcctctctactcatctctcctcccttggcccctccttcagaggctgacagagccccactctcatctcttccccacccaagcctctttccacagaaagactgcttcctcccaggagacagcagctcatttgcacacagacacccacagccctcaaagcctggaaggccaagctgttaggacccctgagagcagggtggctcctgggaggagagcccaggccaccaccttgccctccctggcccctggccttcgatggggctgctctgatcacaaacgtccaccaacgtagccggcccagaagtgcacccatgtcctctggtatccactggctctccaagccaaactgggcagggaggagttgtgagggaaaactgcaggtcaggagggaggctggcaaagcgggccagggccaggcctgaccccagctctcctctcccggccccactgccggccagtgtttaacaaggccctgccttctccctctagtgctagggacagccaccttcttcctctccccaccgccccctctcccctgcaacacgtcatctgacaagtcagtgcgatctcactggaggtgcatctcacaggaacgcggggtcacagcctcctgcacacactccatgctgcacagcaaggtgcacgtgtccctcagagccccagacaccatcccccactcacccagaagcccaagtgattcccaacagcccccagcagcctaatgggttggggtcttgggagcagctgtccctggctccttccctgatcccaccgcccagcctcaccccacggttcctccattgccccacctcccactgcgccgccgggcctctgccagggtcaaggggcttcccccctctggcagcagacgccatggtgccgaggtggcctccacaaccrccctgtgcgccaataggacaagactgtcctccctcccccacacttgtcactttgagggacacgtggatgagacaggaaaacacaggggagtgtggagacctgaggtgacttggagcaagcctctcaacctgagcggcaatttcttcatctgtaaaatgagggggttgttctcatctctgaggctttgtgtcgctctcaaagcctgctagcctcgggttctaggactctgttgggatcgtgtgtgatgttttctgctgagcgactggcagcctgtgtcctcggggggaaagagggcaggcgctccaaagctcctgcgctctgtggctccccctccctcgcagccccaagccccaggtgtgccggccgccctgagcccctccagcacctcccggaggcgcctgcaagacacctaaggtccccgcctccctcctctcccccccgccacacccctacccccggcaggcgacgtccccgcccctcgaccatggcctggtgaagaagccggccaggcccgatcagccccatccccgccgcacgagcggcgcctgcggacagctcctggggccccggccttgtcactccggaggcgggaggctccggggggtcgggctgggaagatcgagccggaggccgctaggctcccaggccccggccgaggctgcgcggccgcacggtgggcaggctcgggtgttccggcaaactgccgggtccccatcttcwaaagagaggaggccctttctccagcttcctctgcggragcccgacccagccccatcccgccacccccgggctgcacctcggcccctccccggcccgcgcccctgcccggggcgggccaggaacctcggcccgcgccgctggggactytggagcggaggaggaagcgcggcggggcgggggcgggggtgtgtcgggttttataacccgcagggcggccgcggcgcaggagaaggggcagagccgagcaccgcgcaccgsgtcatgggggccgcctcgggccgccgggggccggggctgctgctgccsctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggccaggtggcgcccgggcccgggcgggggcggggcgggccgcggcggccaatcacagcacgcggccggcttgtggggcgggcaggctggcgcccccgacccgaaccccaccccgaccccggaccctcgccccgacagtcagccgcggggcccgagcgccgggctgcgcgcacggcctacgctcccagcatgcacgagttggatggatgaggstggctgctcccaggccgcgcccgccttcgccgaaggtgctgggcttggctctggggcccccgcgctctcgggcagctgccttctcacctccggacgctgtcgctgtcaccgtcaccgcactgcactgtccatccaccctccactcgcccggcctcttttctggtcccaatttctgctccaccattcccatgaggcagattccctccagaaggaggaagcgcggcttccgcaaactaaggtctcccgcagggatctccccagggcccggkctctggaagcccttggccttcctcccctcccccagcaccgtggcttctcctttatggcctgcatctaagcagggtcctacaccctccctgccctcctggtgcccaataggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcgkcagcaggtgggctgagggctgaggcagagctcgggggcggcctcctagtgccccatcgtgggggtcgggggagagcagcccatcagggagggaggaaccctgggatccacatgggccctgacagaagggaaagcccaggtaagcacagaatggctttctgagcattgatttttcttggagatggggtggggagttactttctgttaaaggaagcattctggagtag

SEQ ID NO: 13414 - DNA, 26277 bp, Homo sapiens
agtataatacatcatgactaagtgagacttatcctgggaatacaaaattggttcaacatcctaaaaaatcaatataattcatccaattaacagaacaaaacaaaacatatatcaacagaatgtgaaaaagtatttgataaaattcaacagtatttgatgtaaaaattctcaaatttttacatgagtaaaaaagaaacttcctcatcttgataaaaaggatctaagtaaaacctgtagctaacatcgtatttgtgaaagactttctccttaaatcaggaacaaggcaatatcaattcttaccattttattctaatctgtactgaaggtcttagccattgcagtaaagcaagaaaaggaaataaaaggcacatatattagaaaagaagacatggaactgcctttattcacagatgatataattacatatataaaaaaaatcccaaggaatctaccaaaagctacaagaattaataatgaagtcctagcaaattcacaagatataaggccaatatacaaaaatatattttggtatactggcaatgaaaaactagggactaaaatatttaaaaattaatattatttacaatagcataaaaacattaaaaacttagggataaatctaacaaatgtgtacaagatttgttcactgaaaaatataaaacattactgagagaaattaaagattttagtagagcaatgaactgtgtccatggattaaaagactcagtattgctccaaagttaattattgtcaaattgatctctacctacaaagcaattctaataaaaccccagcagccttcaaatttttttgcagaagttgacaagtatattctaaaatacatatagaaaatcaaaaacaattttgagggaaaagaacaaagaggattcatattacttaattttaaaattggcttttaagcagtttagaaaacaatcaaaacaaaggggtattggcacaaagacagatatatagattgatggaacagaataaagggtcaaagaataaactcacatacatatggtcaattaatttttggcaaaagcaccaagataacttaactggaaagtatagtctttgcaacaaatggcagtataacaattggatatccatatataaaaataaaatcctcaacccttacctcactacaaaaagttaatttaaaatgamtcatagacctaaatacaagagccaaaattataaaacttctaaacaaaaacattgaaagtttgttttgtgggtttttgttttgtttttttaccttgggttagtaaaagatttagtggaacaataacaacaaaataaactaccatttagaaaagaaaaatatgtgaataatttgatttcatcaaaattacaaattttcttcaaaagacactatttaagggaataaaactgtaaacatttgtcaaaatatcaaactacaatatgaaagtgtgagttttactgtacaaaaattatgcctaaatagaccaaatttttaaaaaacctaatttaagatttttaatctttaagaatcctaggagagaacatattttttaagttttaatttcattcatatcactaataactacaacttattacatgttcctgtggtgggtcttttacccatattggctcatttcgtcttcatatttaagtatagttccatttttatagatgaagagaacctaactctgaaaattttattatccatgtcaccctgagatgataaacatggactttcaaaatctaaagcccttcctttcccactatgttttgctgcatctcaagtatttatttaatgcaaacatgttaactgtatttacattaattcatgcagtccttggaaccaaagtgtaaggtgtatgccgttatatccattttcagatatggaaacagagggtaaattatttgcctgggtcacatggctcttacaaatggaggccaatcctgctgtaattcaaaagactatgctctctctactctcattgccccctataatgatctggtcttgaattgtctgtgtgtgtattctaataaaattgtattttgtgacactgaaatcttaaatttttaaaagctttttattttgaaataattttagattttcataaagtttccaaagaaaaacgtatagggatataccatgactgttgtacacaatcaaaaccaggagcaaattgacattggtacaatccacagattccaaagtcactaatttataagcacacatttgkgtgtgtgtgtgtgtgtgtgtgtgtgtgtcattccatgcaatttcatcacctttgtgtagctttgataactatcactgcacacaagatacagaacagttcatcagtccatgcctgatgctatccctttataggcattttcaacccttttcttccccatccctaactcctggaagccactaatcttttctccatctctataattttattaatctaagaatattatgtaaatagaatgcagtatgtaaccttttactatttttttttcactcagtaaaattctacggagaaccttcctaagttgttgctcacatcaataattcattttccttgttattgctgtgtaggaccctttggtattgatgtaccacagtttgtttaaccatttacccatcgaagggcatttaggttgtttccagttttgggttccaggtttttgcatgagcatgtttcctttctttgggataaatgcctaaatgcaatttttcagtcatatggcaagtacatagtttttaaaatgtggctgtaccattttacattcttaccagcaacataagtgatgcagtttattcacattcttgccagtactggtgttatcacgattttttagcttagtcattaccatggcatgtggtgatataacattgtgggtttttttttttttttgtctaatagctaatgatgttgaaaatcttttcatattcttctttgtcatctgtacatcctcctccgtgaaatgccacttcatatcttttgcctattttcaaatttattttttttactattgagtttcgagagtcgtttatctattatagatacaagtcctatgtcagacgtgtggtttgcaaatattttctccctgtctgtagcttgtctttttcattctcctaacagggtatttcttacttgaactgttttctaaaaatatccagtaaatgttaatttttctaagcaactttaaacaaagtcaattagtagtatagaaactatagactgtaaagtatactgcatttctgcttagagttctctatacacagaggcctaagacagcacaaaataagtatgatttatttagcccaattttcctgcatcgtttccataaaaaatattgaagtggctcataatattagtattcaaacacctgtcatacacattccatccctggccttaacctttccccctttatcccttacgtatttgtattaggataagaatatcctctctcccaaacttcacataccggggcctgtcaaggggtggaaggataggggagggatagcattaggagaaatacctaatgtagatgatgggttgatgggtgcagcaaaccaccatggcatgtgtatacctatgtaacaaatctgcacgttctgtacataatgtcccagaacttaaagtacaataataataaaaaaaaaatcccctctcccttcttttccgaaaccaagggcctctcaagactaatgggaggaaagtttatttattataaaactcaagatattttgtttaatatagtatgggagatatatgaggggagcttaatcttaacagtgcaatgacctgatttttaaaattaacccgagtccctgtccaacagcagagcatgacagaacaaactaatgctacctgctccagatacagaaaaggtaggacattggaaaatctgggtggatgggggtaaaggattcrgatcagcccataacggccacgtgatataccctgacgtcctaggattaaggccatgagccatggaaggakgttggaggacaaatgaaatacagaaagtcataatatctacaaccctgtggtctacaaaggagtttggttatactacatgaacctgaaatagatgatggattaaagtctccattattccatgtaatgataaaacaatttcaagtgatcataagaccattttataatgaattccttctttccactgtaaaggccatagtgttagattgcttactcttgttaagatttactggatgctaacagtccagcactggctaggcatcgagaacataaaaataaatgagaagtgttcctgcttttaagatgttcctactgtggcaaacagagagctacaaaatataataatatagaagtatgtaaaaaaaaaaaaaaaaaggaataaccaattctrccaggttgaatagtagggtcacgaggaaacgacgtttgagctaggtcttgctagatgtttttaaataaaatgtttttcttccataatgaatatgaaacaattagaaaaaaaatgggaaaattgagttttcaaggatgagttcttcaggaaaagaaaagctttggcttttagagaaattggattcattcattcattcattcatattcatttagcaaatattcattgccttcactccaagctagattccgagaatccaacaaacggtacttgccaaagggaacctgtcggctggtgggatgatagagatcagacagttgccacacaatgtgaaaagtgccgtgaaaaagtaagcatagggtgatgtggaagcacatggttgcctctaatctggacagactgaagacactgagatttacagttaggccagggtcatttgaagcactgccttgttgtatttgtatgtaatgacatttcgaaacgtggaatgaaaggaaaagtasaggcagactataagaagcttccacggatgtgtctaactttgcaaatgaacaaaaatctaatgtagacatatcctggaaacttctagtttgcctgcacttttccattccaaatggaggtttggacatttaacagaggcctcaaagggttatcctgttaagattttagtatatacagcaggggcttgaaggaatgttgattccattcctcttggcctccttttatgaatccagttctgtgctagctctgtgagtaaatgaaaatgccttcaaaattgggatgccagagttagacagcaaaggagcaaaggaacccgtatcagctaagtgtgggaagggaaatatgtaccagttgctatatactttcacacgttattttaacctcataacaactcttatcaattcagatgatggaacagggttaaagaatagaggctgagcacctggctgtccacggacacactgagccagcaggagcacccgtgccccgcagcagcacccagggccctcctagagttccggccttaacgcctaggaacgtgccattggctcctgcgtttctcgttcccgtcgggaacgccactggctagtaccttgcctggcccccagtgctcaatccctggtagttgggaggacgaaaaggaaatccctctctggtcggtcctcaccgcagccctgtgtcaggccgtcacacggcggcctccagagtcgaaggcgctctgaggagatgcaggttgtgtccaaaacctcccacctcggggtctcctgaacgtcccaacaagctccttgggcccttaggcgttaggccaaccccaggcctcggctggccccgcccactctccgcggccggaagtggcggygccgagtgaggtaaatgcgtgcccggaagcgcgacctcgggcggttggaggggctaccgggtcttaccagtccgtggcgggagtcccggaggaccctcgacgggggagttgccgagaaaaggcctcgccggcattcttcccctccactgggtcctttgaacctagtttggctgggactcgccttcaggcggcgcggaggatttcgaggccctgaggcgcggcccttaatttccggaagtgggggccgcgccgcgccgtcaagatgtgctcgacgyccggaatgccggcgccgggggcctcgctggccctgcgggtgtccttcgtggacgtgcatcccgatgtgatcccggtgcagctgtgggggctggtgggcgagcggcggggcgagtacctgcggctgagccgggaaatccaggaagcggcggccacgcgcggccagtgggcgctgggcagcgcctcggcctcgcccggcgagctgtgcctggtgcaggtcgggcttttgtggcaccgctgccgcgtggtcagccggcaggcacaggagagccgtgtcttcctgctggacgagggccgcaccatcacggccggagcaggctcgctggcgcctgggcgcagagagttcttcaatttgccctcggaagtgctgggctgcgtgctagcgggcctggtgccggcaggctgcggcgcgggctcaggcgagccgccgcagcactggcccgccgacgccgtggacttccttagcaaccttcagggcaaggaggtgcacgggtgcgtcctggacgtgctgctgctccatcgcctggtcctcctggaggtgcctgatgtgttccaacagatgcrggagctgggcctggctcggcgggtgcccgacagcctcttccgttcgctgctggagcgctatctcacagcggccactgctagcgtgggctccggggtcccggttctctcgcgagtccygctcaagcaaaagcagcctggtctggattacttctatccccagctgcagctgggcgtgacggaggccgtggtcataacccaagtgtgccatccccaccgcattcactgccagctccgcagcgtctcgcaggagatccaccgcctctcygagagcatggcccaggtataccggggttccacggggacaggggatgagaactctaccagtgccacctgggaggagagggaggagagcccagataagccgggctctccgtgtgcatcctgtggcctggatggacattggtacagagcactsttgcttgagacttttcggccccagcgctgtgcccaggtgcttcatgtggactatggaaggaaggagttagtgagttgcagcagccttcggtacttgctgcctgaatattttcgaatgccggtggtgacctacccttgtgctttgtatggactctgggacggtgggagaggctggtctcggtcmcaggtcggtgacctgaagrcactgatactaggcaaggcagtgaatgcaaagattgaattttattgctcctttgagcatgtgtattatgtcagcctgtatggagaagatgggattaatctgaaccgtgtgtttggagtacagtcgtgttgcttggctgaccgagtccttcagagccaggcaacagaggaggaggaaccagaaacatctcagtctcagtctcctgctgaagaagtagatgaagagatttcactcccagccttaagatctatcaggttaaagatgaatgccttctacgatgcgcaggtagagtttgttaaaaatccttctgagttttggattaggttgaggaaacacaatgtcaccttcagtaagctgatgaggagaatgtgtggtttctattcctctgccagtaagctggatggtgtagttttgaaacctgaacctgatgacctttgctgtgtcaagtggaaagaaaatggttattatagggccatagtcaccaaattggatgacaagagtgtggatgtattcttagttgaccgaggcaattcggaaaatgtggactggtatgacgtaaggatgctgcttcctcagtttaggcagctaccaatattggctgtgaagtgcaccctggctgatatttggcctttgggaaaaacttggagccaggaggcagtttccttttttaaaaagactgtgctccacaaagaattagtcatccatattcttgataaacaggatcatcaatatgttattgagattcttgacgaatcaagaacaggggaagaaaacattagtaaggtaattgcccaagctggatatgccaagtatcaggaatttgaaacaaaggaaaatatcctggtaaatgcccactccccagggcatgtttcaaaccactttactacggagagtaacaaaataccttttgccaagactggagaaggagagcagaaagccaagagagagaataaaaccacatctgtttcaaaagctttgagtgacacaacagttgtaacaaatggttcaactgaactagttgtgcaggaaaaagtgaaaagagcatctgtttattttcctcttatgcagaattgcttggaaattaagccaggctcctctagtaaaggagagctggaagttggaagtacagtagaagtcagagtgtcttatgttgaaaaccctggctatttctggtgtcagctgaccaggaacatrcaaggacttaaaactctaatgtctgatattcagtactattgcaaaaatacagctgctcctcaccagagaaacacccttgcttgtttggctaagcgaacagtaaacagacagtggtccagagcacttattagtgggatacagtctgtggagcatgtcaatgtaacatttgtagattatggagacagagaaatggtatctgtgaagaatatttattcaattagtgaagaatttctgaaggttaaggcacaggcttttaggtgcagtctttataatttaattcaaccagttggccagaatccctttgtttggratgtaaaggcaatacaagctttcaatgaatttatagataatgcatggcaaaaaaatctagaattaaaatgtacaatatttgctctggcttcaattaatgaagaactgtttaacattgtggatttgctaaccccctttcagagtgcatgccatttcttggtagaaaagagacttgcaagaccagtaaaacttcagaagcctttggagtcctctgttcagctacattcctacttctattctacacatgatatgaaaattggaagtgaagaattagtttatataacgcatattgatgacccttggacattttattgccagctggcaagaaatgcwaatattttagaasagttgtcatgtagtattacacaattaagtaaagttttgctgaatttaaaaacatctcccttgaaccctggaaccttgtgccttgccaagtatactgatggaaactggtataggggcatagtaatagagaaagagccaaagaaagtcttctttgttgattttgggaatatttatgtagtaacaagtgatgatctgcttccaatacctagtgatgcatatgatgtcttacttttgcccatgcaagctgtcagatgttcattatctgatattcctgatcatataccagaagaagtggtggtgtggtttcaggagactattttagataagtcattgaaggctttagttgtagcaaaagatccagatggaacactgattatagaactatatggtgacaatattcaaattagtgctagtattaataagaagttggggctacttagttmcaaagatagaataagaaaaaaagaaagtgaagtcctctgttctacaactgaaactcttgaagaaaaaaatgagaatatgaagttgccatgtacagagtatttaagtaaatcagtagggtacaagttacctaataaagaaattttggaagagtcatataaacctcagatcaactcatcatacaaggaactcaaacttttacaaagtttaacaaaaacaaacttagtcactcaatatcaagactctgtgggaaataaaaatagtcaagtgtttccattaacaacagaaaagaaagaagaaatttctgctgagacaccyttgaaaacagcaagagtagaagctactctttcagagagaaaaataggagattcatgtgacaaagatttgcctctgaaattttgtgagttcccacagaagactataatgcctggatttaaaacaactgtatatgtttctcatataaatgacctttcagacttttatgttcaactaatagaagatgaagctgaaattagtcatctttcagagagattaaacagtgttaaaacaaggcccgaatattatgtaggtccacctttgcaaagaggagatatgatatgtgctgttttcccagaagataatttatggtatcgtgctgtgatcaaggagcaacaacccaatgaccttctctctgtgcagtttatagattatggcaatgtttctgtggttcatactaacaaaataggtaggcttgaccttgttaatgcaatattgccggggttgtgcattcattgctccttgcagggatttgaggttcctgacaataaaaattctaagaaaatgatgcattacttttcccaacggaccagcgaggctgcaataagatgtgaatttgttaaatttcaagacagatgggaagttattcttgctgatgaacatgggatcatagcagatgatatgattagcaggtatgctctcagtgaaaaatctcaagtagaactttctacccaagtaattaaaagtgccagttcaaagtctgttaacaaatcagacattgacacttcagtatttcttaactggtataatccagaaaaaaaaatgataagagcttatgccactgtgatagatggacctgagtacttttggtgtcagtttgctgatacggagaaacttcagtgtttagaagtagaagtacagactgctggagaacaggtagcagacaggagaaattgtatcccatgtccttatattggagatccttgtatagtaagatacagagaagatggacattattatagggcacttatcactaatatttgtgaagattatcttgtatctgtcaggcttgtggactttggaaacattgaagactgtgtggacccaaaagcactctgggccattccttctgaacttctgtcrgttcccatgcaagcctttccatgttgcctctcagggtttaacatttcagaaggattatgttctcaagagggaaatgactatttctatgaaataataacagaagatgtgttggaaataacaatactagaaatcagaagggatgtttgtgatatccctttagcaattgttgacttgaaaagcaaaggtaaaagtattaatgagaaaatggagaaatattctaagactggtattaaaagtgctcttccctatgaaaatattgactcagagataaagcagactcttgggtcctacaatcttgatgtaggacttaagaaattaagtaataaagctgtacaaaataaaatatatatggaacaacagacagatgagcttgctgaaataactgaaaaagatgtaaacattattggaaccaaaccaagtaacttccgtgaccctaaaactgataacatttgtgaagggtttgaaaacccctgcaaagataaaattgatactgaggaactggaaggtgaattagagtgccatctggttgacaaagcagagtttgatgataaatacctgattacaggatttaacacattactaccacatgctaatgaaacaaaggagatactagaactgaattcacttgaggtgccgctttctcctgatgatgaatcaaaagaattcttagaactggaatctattgagttacagaattctctggtggtggatgaagaaaaaggggagctaagcccggtgccaccgratgtgccactctcccaagagtgtgtcacaaaaggcgccatggagctatttacactgcagcttcctctcagctgtgaagctgagaaacagccagaactagaactacctacagcccagctgcctttagatgacaagatggatcctttgtctttaggagttagtcagaaagcacaggaatccatgtgtactgaggacatgagaaagtcaagttgtgtagaatcttttgatgaccagcgcaggatgtcattgcatctacatggagcagattgtgatcctaaaacacagaatgaaatgaatatatgtgaagaagaatttgtagagtataaaaacagggatgccatttcggcattgatgcctttgttctctgaggaagaaagcagtgatggaagcaagcacaataatggtttaccagatcatatctcaggtatgtgaattttttttyctttttacttttttttttttttttttgagacagggtcttgctctgtcacctaggctggagtgcagtggtgtgatcttggctcactgcagcctctgcctcccaggctctagtgattttcccacctcagcctcccaagtagctgggactacaggtgtgtgccaccacacccagcttatttttctgttttttgtagagacagggtttgtcatgttatccaggttggtctcaaactcctgggctcaagcagtccttctgcctcagcctcccaaagtgtgcttttacttttaagtttaacatagtgactttccagagttgttatttgttttaaagaaaagagaataattcttatatggatttctaaaaaataattttttgtaagagattaaaaacctggaaagtgaatcagattggattttatgaagggcattttaaacttggggaaaatatattgtgaaatcagtgcaaaatatgtgctggaagaaacactgaaatattagttttgtgtttaaaagttgaatgcttgaaatctattagtctccaaaaggtaatcacatttaaaatgtaatcacatttataatcaagagggcatgtgttggtaagttttataaaacatggtattcccttgccaaatttatggcactactayaggcattaatttacactaaggattatttcaacagggtcttttagacttaactgtatcatgcattgatcttgcaattcattagaaacccttaaagaaaaaaaatagatttaggtagcctatattaatcaaaaactgtttcatgtgtaaatcttggagaacatttattaacttttttataaattatttttactactgtttgctacttaaaaagaattgttaaatgggtaacttttagctttttataatcaatgctatactttttaaatgtcaatttttatattattaaatttgaaccattgtaaaaataaggaaaataatggaatagtgagaatgaaaatcaacaagaagtgatcaatgttaacaccatgatgtattttctttttgttgtcttttactgtctttgtgtatgtctactatatagttttaaaaacaatttagatcatactatcatacagtattgaatcctgcattttagtcccttaaaaatgctttcaaaatattttaattgcatggtatgccatcctatgggtaacacataagttatttaagtattacccttgcattagatatttattcctcattgtcatatttaataatagtattaactctgtgataagaatgtctgctcatttgtaacatgctgctttcttatagaaatggctgttgtaagtataaaaaacaccacttgtcttaatagtaccatattttattagcgattttcactgttagaaatcaaattcacatccttgtggtgattttttgtttggtttgttggtttagaaaagcaataagagattatatgggggggcgggcactgtaagaattttaaacaaaattgagggagacagtcataccaatgtactaattacatgatattratgatatagaaataatgcagattaggaaaatgctttgcttgtgtatgttacattaaggaattaagagatatgcattgagtcttactcaattcaatttggcagctcaactacagaacacctacactctgaaagcctttactgttggatctaaatgtgtkgtgtggtcaagtctaagaaacacatggtctaaatgtgagattttagaaacagctgaagaaggaacaagggtaagtgatgtttaagtactttatctccaaatgtatttgcagactattaaggaaagtttaccagactctgtcagactagagaacgcgattgaacaaatgtttacttgcttgttccccctgataacttgatgtaatgcacatatattttaaatctccatatataagaatcgtagcaagaaatcatcctaggctgtatcatctatctcccttactctttctaaatgctattagtcacctagttccacactttacacatcttatctcttagttggaattttttatatctaatgccactaccttagttgagtcatttcacaactacattaataaccttctattttgtttgcttcttctagtcttccttaaattgattgtccatggtgtcagggtgaagtttgtaaaatgtaaatttgattacttcattattgtgtaaaacttattagggagcctgttgatcgtgtttctcccgtgatttgaaaaccacctgttcgagagttayttggtatatatatatatatrtatatgtgtgtatrtatatatatatatrtrtatatgtaatatatrtrtatatrtrtgtrtrtatatrtgtrtatatatrtrtatatrtgtgtgtgtgtrtgtgtgtgtgtrtrtrtrtatatatatatatatatatattttttttttttttttttttttttttttgagacagggtctcactctgtcacccaggctggagtgcagtggcgccatcttggctcactgmaagctctgcctcccaggttcacaccattctcctgcctcagcctcccaagtagctgggactacaggcgcccaccacgacgcccagctaattttttgtatttttagtagagacggggtttcaccttgttagcgaggatggtctcgatctcctgaccttgtgatccgcccacctcagcctcccaaagtgctgggattacaggcatgagccactgcgcccggctgttttttaaattgtattatagattcctacgccttggcctggactgctaattcagaatttctggggttaggattccagaatatgcattcatattccattaaaattggagagcccctggcctggaacataaaagtcaagctcattaacatggcataggaaatcctctagggttaagtgtttatgtactctctttggccctaattctttatattttgtactttatattaaatggacatcamaattcttgacttctcttacatataccatctgcttgctctttcgatatatttaatattgcagttctattttacctatattccatcctgttaccaaactggttaattccaatttacttacccattgcctctaccagggagcattcactgatgttattttctaaatttattcttgtcctcaaccttcccccatcccaaaaaaagccttatttctgtattacaatcctatacctcctactacagaagtctgaacttcctatggtgtattgtaattatctgcttagaggtcttttctccactagattttgaactatttgatgttgaaattttatccatctttgatcaccagtcatagatactctacatatgtttgggaaactgaagtagcatggagtttgaaacataaggttgaagctcaataaattcattttcattgtcttttaaagtgtttcattttagggccaggtgcagtggcttatgcctgtaatcccagcactttgggaggccaaggcaggtggatcgcttgagccaaggagtttgagaccagactgggcagcatagtgaaaccctgtctttatccaaaatacaaaaaattagctgggcatggtggtgtgcgcctgtagtcccagttattcaggaggctgagatgggcagattgcctgagcccaggaggtcaaggtcacagtgagctctgatcctgccactgccctccatcctgggcaatagagcaagaccctatctcaaaataataataataataatagtatttcatttttaaaataattgctctggtacataaatcagttatttttttgaattggacactttaaaaaaatttgttttctcctgtaggttttgaacctttcaaatggtatggaggagatagtgaaccctgagaatgtctggaatggcatacccaaattggataagagtccacctgaggtatggaattctataaatagtaattagtgagagcattgttcttcattttgaaaggtgatttaacaaactatttccaaagtccttgtgtttggaaaaatgggagaaaaatcctgtgacaatagttaaaaacagcaataacaaaatcagtgattttagtccttatgccaagtattcttctgagaaaactagttattaatgttttactccttgattagaaaatgttttggtcttcatgactctaataaaatacatattagatgcagaaaacctgagaaatataacaatattaaaaatgagaaagtaacaatcaccgataatatacccatccagagacaaataggttgaccagtttggttttcttttataatttttctgtttatatgtaatataagtatttcatctacatattttagacacaattgatttcatcctatgtatagttttatattctgtttttcttcatttaagactatatggtgggcaatttgccatgacattatgatgtgtctgggcatttgagtttatcctgtttggggttggttggacttcttgaacttctcacttcacaatctttgtctgatagttttaatatctggtcatcttggggtttgtagctgttgattttcttttccctagagaaatggtcagcttttcttggttctttgtatgttgagtaattttggattatatcctgaacattttgcatattatgttttaagacattgggtcctgttaaaatctggagaatgttgaagtttttgttacagcagatgatcagctggtttcaattcatcctacatgttctctttctccttctgtggttggtgattgtcctgtcagtttagttttcaaagcctttgttgttcaggtcttccaggtacataagccacccagggtagtcagggactttggtcagtggtttatatagtagttaagtgtcaaagactttgctgtgcttatttggctctgttctgcatgtgcatagctcargggcaatcctgagacttagagttcacatgtagcattaggagttaaacattttcaactcctttcctctctgagatgtcctccacattttctggctcccaggatcctctcttatccagcctccaatggcccctttttctggtcacctagccagacagtatttttctctcagcctctgctccaccacacagttctgtttgcccgtaagagcgaagcagataaagagakaacaaaaacaatctcctattactattcttcagatgacagaaagctcttttcctggttccactggctagagagacgggtcatctctcacatttgtaggtgcctatgttgccatagctgtcaccaggmagtaactggggttagccaccctcagggcagggccagaaaaaaaaatagaaataaacataacaccacaatacagcaaagagatttcctacctatttcttactctctagcattcagggttcctttatccctagtccactggctataaataagaaatttctctcagagttttgctgtctaygctagctaggcagttttgatttggcccaccctcagatcaaaatcaggagacaaagaagtaaaaaaaaagaaaagaaaaggcctatgaaactcactcctgttgtgagtcattattcacgtttttactttaattcttaatctacctatttctgttcacttttgagtctttgagtagttgctttttatattctgtctagaatttttcattgtaatcagcgaaagaggttatagtcagcttattccatcttggctgcacccagaaggccataaacaatatttaatagctaaataatgctgcatgacactagtgagccataatgtattaaaccatttcccatagtgttggatatttaggtcatttgaaatttttactataaaaaatcaatgaatatctctctttatgttaattacttttttgcttaggtcaaaaataccagcctactacactttttgcatcagtatttactaaaactttttacatttgggttgtctccatccattaattatgaagaatccacagccaaatgcatacatatgtacatacaagattcagtttggataaagttctctatgcctgctacatagaaaagaactatttaaagtagacataaaattatatatctagataagtaaatagataactacctctggctttgactaggccagttagcagacatatagaaactacttatgagtaagactctaaaaattttgatttggttactaatgagatttaaatatccttccctcaaattcgaggaagctcttaactctggatacctgtctacaaatgagctagctttccttacaaagtgagtgttgtattatgcatgacttttttttaatgatacatcaagtcactatgatctaggaatctaattactttttttaaaaaaatggtttcttatctgagttattttattttaccataagagtattttgttagttactgtatcacataatgcatgcacatgatgctattggttgttaaaaggaatataggagaaatatttcccttttcattgtccttaataaagcatctgtggctctacatggatactgtgtttgaataacagccccttgaacaatgatgtccctccctccttcaccaattaccagagttgttggggatttgagagctaaacattggaaaagggtactttactccctgtgtagagtgctccagggatatgttctagagaaatgagtatttgaagaatagaaaaagtacttgacatgattcctcattataaaatcagattgtcataattttgatagaaatrcattttgttgttyacatcttttctggcttatctgtggttccatttctgatttgaattattttgtactcgtgataaagaatcaatagcaattcaaaggttccttttgttaggctgtatcccaaagagtagggaaagatctttacttcatgtcagtgggtgataccactattaaaggtaacttgtgtttttaaaacaaaatacttttatcacccagaattacaatttcttaaaaatattgttatgctgaatccctcaaacaaaaatggtttatcaatttctttggacataggtagcagggaagaaaaaccactttaggtaaaaaaatttaaatatacttatggagataaataacccaagatgaggatttcttgaaatataggaaatttattaattgaattaatcttgaaagttaaattatgaatgtgataaattcacattttaaagaattttctctgttaattagctcatatgttcaaatgatatttgttaaataatctcttggaatttctgaatctttagtttatataagattcaaattattggctggttcttggtattgcacattcttgttcataaataatgcagtggttcttagaattgaggcacattgagaataaaatcagctaatggtagctttaatatcatgtgaaaaatatatactaatcaaaaaggaaaaakaactaattgattatcagccttgttcacaccattctctagcaaaatataaaatatgccaatttcataatttttagagaaacttgatttgatggtacagtgtgagaaccaaaatattaataagaaaataaaacattgtttctatagaaataatgccctatagtaattagaatactcatctgtcccctctcccttttagagaacattacatttgtcatggtaacacccatggaaataaatttttttgtttgtatgtttctttctcagtttgaagtttttctctttttgtttcagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacmtttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaataaagtttatccttaatatgatggtctcattttattaaaaaggaaatagaactcttaaatatacttggttccatctctcctctgtaatggaggattggggaaagcatagtaatattaaatgttagctcttatgtattagtcacttagcttatactttaaatgcattttttcactttattcatcaactttgaagtgcatatcaatattatccatattttataggtgagaaaattgaagcttcataaagaggttaaataacttgcctaaggtcagatagctgatgagtctcagaggcttgatcaaacccagacctacctaactttgaagcccatgactttttaaacatgattttgcaaagcatagatcttagcttttagaaacagatctgagctatatgctgcttaacagatatgtgacatgggcaaattatgtaatattttgaactttgatcttcatctgtaaagtggtgataataaaacctttcttgcagtgtttttttaagatgagaaataattgatataaagtccctgaaaaggagtaggcatttgataaatgtgtctttctttaccctgaaaaatactcagtgtgcactatgttaggttatttctttttaaccttaacttattagatattttcaatagttattttctcctttcagcatcagcatgcgccaycaacaaaagactgtaaaaaacaaacaaacaaaaaagtgttgaatgggacatccatacagttggaatgcttatttctaaaatgaatagggaaaaggtttgctaaatgagactggggtaaaggtgtatctctgtgaagcattatcagactctgaagcctaatggaaatagaattatgaaccttaaaaacccattataatttccgtaagtagaagggagagaggtttgcattaaaagtaattgaggtagatgagtatattacttattcctggaataatgaatagacaagtttggcttactcatatagataatataatgtgaattgccagaagcaaagctcagagaagatgcattaggatcagattataggaagccttcaatttcaagctgagtttaactccctattttaaaaaatttaatctgaatggctacagaagtaaaatttctcagaakgagtgactttgcacctgacaccactaagataggactagggtaccaaatgagtggtataaatttttatgtcccctgggaaataaaatcattttccatgattcccatatttataagtataaattcttaagctatatttttacctccatttaatcgtgttattctgttttactactacatatagaattgaaaacattaaataaaattaactggaatatgaagaagctaaatgtaattctgaatgttttattatccttcacagcctttgtgtgagtaactaatgtattctaactggaatccctgctatatgctgtaatacctgtggaacctttctttagcaagtagaatgccttaaagaattaaagaaagtgtcaaaaaattaccaatttaatccactgcctttgcctcatctctaatattcttaacccttctctactccttttagtcatcatttgaaattgtgtagtaccaccaatcctgtgctgaaacaatggcttttgcttgttctaatttttcttaccgtgaccaaaagtcaaagagaagagctgccaaattctacctagaatatcatgttgctataattaaactccactgcccatagtagataataaaaggcaagaaattgttttttactctatgtttagggagtcttgtatcattgcaacaggttttcactgggattttgcctgttttaatctacttgtctgtcaaagtaatgtaaaaacagtttttaacttcgacactgaaaaggaatcatctttaaaattaaaatttaggctgatatgaatattgtatactgtattctttctttacatctaaagggaaaaaattcttagtccaagcttcaatcacgattacagtatagcctacattttaaaatatgagtcctttgggaaaatacattaaaattctctctctctctctctctctctcwctcwcwcacacwcacacacacacacacacataattttagacagttttgaaacaagacttttaaaaaacctattttaatcctaattgtatttctctattcctgaagagttctgtaacatgatgtgttgattggttgtgttaatgttggtccctggaataagattctcatcatctccttcaatcaagcagtcccactgatcaaaatctttatgaagtcctataaaatataaagtgttaatcaacatattaaacttttgagagcattaaacagtttggtgcccctaggtggcaataaagatttacaaattacacaagttccgttaggatggtagagacgatgtgctctgtatcagctgcctcatggctgctttagcagctgaatgcaaacgggataggagtgaggcaacctgctgtcagtatcctcaacatggaagtccactctaggcttcatacaaagaatattacctttaacagttggatttgctttctatgatatagaggatgtaaagcagcaaaattgactttctcaaatttctgttttcaaattgatatactgctttgttccattgtaaaccaactggaaatagtttaaatagtactaaagctgtattaagatagacagctttgtcctgagattcatctggtttaggtcatgaaaaaaatagtttcttacctaaatgcttttgtaagaatgctratgaagctttgttgctaagatcaatagctrcatttgaatctatgtctccctttaatttgagcatgtgtccaattattttgccagttgcaaaagtgaagtcagcaaaattctggtggactgaacccctaaaagagaacaagacatttaaaagtcacattgtttgataaaattattatttttttagttagagtgtaagaaaggtactggtcttgttggtctgtttactgaaaaccaaagaagaaataaaacttgtaatttgatctacttagatgtgtttcaagggtcacaggctgtttgtttagggatcccagagtatattcttcttccctctagaaatacaactcaaagaatcttgttcttgcttggtatcttgattttagaagaaatgattcttgctttttagtgaattggaatacttccagtttgaatactggaatgtgttctgtattgaagggtccctgaactcagagccagagcctgstacctgccctcaccactgaacgtggtatgtatttgatgctagtcactttaaatttaaatcactttagatttaagccttagaggaaacagatttcaaacaccacttttcccagtattaaactgtaagcactttataaatatcatttgcactgctctgtaaattcatcaatagcctaacgtcaaatagaatggccttttttaagtcctcgttttctaccaccactgggacatttgacacttgatggccttcttgcactttttttctttacgtttccttaacattgcaccttcccttctgacgctaaccactctatgttcttcactggctcttcacccatttcccattggctgaatgtaggcattccttaggattctactggcagaccaactcttttctcactttgcaatctcttctacttcaaatgtttcatctgtgttatcatgtaaattatgtaatcatccaatgtgtggccagacatctgtgtacagattcctcagttctcaagctaagaaattgtgaagttaaaagacatcttcccagtcctgcccaaagctgctctgcctcttgactctgctggttcttataagcaacccatcattcttttagtcatctaagctcaaaacagggccacttaactccctctcactcttccccacattgtagtaggaaacttgaatgtcagaaacataaagaagataaacagcaggaatacaagagaattgcgagcagaagcttggatgatctgactgtagagaactgccagaggagaagaaatggaaggagtggtataaatgacaggagaagcagcaaagaggtgggtcatagtagccaagggagcaggaagaggggtggtcagcaatgttgaacagatgcagagagcaaggttgagactctgaagaggctgctggtgtggcaggcagcaggcctttagtgtctttgttttggcatgcccgtgggggcccaggaagctagaccacaagagtcaaagagtgaatagaagtaagcacatgcaatgactaatattggctattctttgaaggtttctagcagagaagggacaaaagcaaaggtgagagcttagtaaggaaatagggttgagggaaggttaggtgttctgtattatttccgttttagaattagaaagagttgcacatacacataagctaaatgaagtccttgcctgaaatacctaaacccttccttactatctaaactctcttgatcttacaaaatccaattttagtgtcatctatgaatccttttctgttggaagagacccctctattctctgagcccatagtgtttattgcctatactccatatatttccttcctgcctcttctcttctcctaaataaaccagatttcagataggaaaggggtgagttcaggtccatctttgctttgtaatatctcatcgagagttcaaaaccttatcaggagttctttttcacctccaggatacaagaattgccaacacgtcatggtaccccattatagctttggggaatttataaactcatattctttctcaacaggttagtatattgcaggtctcagtcgataatctgactttttctttaaagagttcctaccccagcctaatgatggaatacttccccctagctctamccccaaaaatctgtaggcatattctggtgtttagattgaagtagcatgtagtataatgctaattttaattaccagtgatatagtttggatctgtgtccccaccaaatcacatgtcaaattggaatccccagtgtcagaggcagggactggtgggaggtgattggatcatgggagcagtttctcatggtttcacaccatcccccttggtgctgtcattgtgacagtgaattcttgtgagacctggttatttaaaagtgtgtagtaccttcacccatccctctcttcctccggctctggccatgtgaagtgctcatgccccggttgccttccaccataattgtaagtttcctgaggcctccccagaagccgagcagatgccagcatcatgcttcctgtacaggctgcagaactgtgagccaatgaaacctcttttctttataaattacccagtctcaggtatttccatatagcaatgcaagaacagactaatataaccagtatatatactatatacgttaacattcccattttaaaaagagtaagactaaatgtacttagaaactgagattatctaattctctccttattgaaagtctaaacaaccaattcagcaattctttaatagttaccaaatgatatcgattgatatttacccaagcttcaagtttgtttcacataatgaaataagtcactaatacttacctgattgtaatcatctttctttctttatcaggtgagtagcattttttcatttttatgatattagcaggatattggaaatattcagagttgataaaaaagaggggctgaggaattctggaatatacttcatcacccagtggaaacatccatgcatccagggcaataccacatctgtagatatttgttgacaatgatgaaattaaactggttacatactagccaacattgaggacatcctaataatgctaggattggtggacacgcaccataccagtttattatgggttatctsattggaataaagaggtatcatacttcaatgtgggaaagggatatgattaactttgtaaagtagcagacctggaattttatataatcattttctttatatgcctttaggaattgcaaccatttgagtgatatatccttaaaactttttattcaaaataa

SEQ ID NO: 13415 - DNA, 12591 bp, Homo sapiens
  misc_feature (1)...(12591): n = A,T,C or G, or insertion/deletion polymorphism (see Tables 1-2)
ttgctgaaagatattagagacagcataaagaagtgaaaatatatcctgtgttcatgaattggaagacaatattattaagatgatagtactacccaaagtgatctacagatttaatacaatctgcatcaaaatcccaatggccattttttttttggcagaaatggaaaagccaatcttaaaattcatgtgtaattgtgcaagacctcaaatagccaaaataatcctaaaaaataacaaagctggataactcacatttcccaaattcaaaacttcgtataaagctacagttatcaatgctttgtggtactggcataaggacagacatatatataaatggaatagaattaagaagcaagaaataaacccataaatatattcatgggtatgtacctcaaatatggatggttcccagcttataatggttggacttacaatattttgactttatgatggtatgaaagcaacatgcattcagtagaatccatatgcataaaagtacttaaagtacacatacaaccattctgcctttcactttcagtgcaatattgaataaattacgtgagatagtcaacacttcattataaatttggctttacgttatatgattttgcccaactgtagcctaattgtaagtgttctgagcatgtttaaggtaggcctggctaaattatgatgattggtaggttagccgctgatatggtttggctctgtatccccacccaaatctcacatcgaattgtaatccccgtgtgtcagaggagaggcctggtgggaggtgattggatcatgggggtggatttccccttgctgttcttgagacagtgagtgagttctcatgagatctgatggtttaaaagtgtatgacatttccgtccttcactctctgtctctcctgctccaccatggtaaggcgtgcttgcttcccctttacctgctgctgggactgtaagtttcctgaggcctcacagtcatgcttcctgttaagcctgcagaactgtgagtccattaaacctcttttcttcataaattaccaagtctcaggtagttctttatagcagtgtgagaatggactaatatagctgtattaaatgaatttacactaataatggttttaactaacaatgggtttatcaggatataataccatcccaagttgaggagcgtctgcaatttaaaacatctgttcaaacaaacacttgtacaggagcgttcatggcagcactattcacactatccaatcagtaatgtaggggatcaaatgccacctcaaaatatgccactttggcatattgattattttgtgtttaaaggcacttgaaagtagcagatgcaagaagggcacactgaccttcctttttttttcatgaaaggaagagatgaaactctgatgtgaaaggtattatctgtataccaggaagaagaaacacattcttattgccagagatggggagtccaggcttgagggaaagctgcaccaaaaaaccttgttacacaactcttaccttcttagtgacttttccacaattaactctcctagcccaaaccccaatgtcttgttatgttttcacaatttaccatacttttcccaccctagtatgtaagtattcagctgtaattaatcacttgagtcttcgtatttcttatgagggctcccatgtacatgtaaaaaatgccaaataaaattttgtatgcttttcttttgttaatctatcttatttaagtcctagctggagaatctaagaggatagaggacaacatttacctcccctgccatggaaatcatttaatgaactgttcatcaactgatgagtagataaacaaaatgtggcctatttatacaacagaatatttctcgttggtgttgtctcaatgcttaacacagtatacctggcactacccttcaatattttttgaagaatgagcacatgaattatcatgtctccagctaggttcaccagtatgagtaatatgtagtgagtgtctactgtgtgccattttactacctaaactttttatggactctgtcccctagtcttatctaccaatgccattgtcttagttgagatatctgtcatttcttgactggtataatacagcagctttctaattccaatctcagtcctctctgttctattctccacacacaatcctctctgttctattctccacacagcttccagggtgatatttctagaggcaaatcagaccacgtcactcccaagctgaaagaccacagtgggttcagtgtagcctacagggtattctaaaacctgagcatggcataatagaacctccatgtcttggctcctgcctacctctttcccagccacatcaaccactactgctccactggcatcgtactctccagccttaatgaattggttgcaactcccctcctcccaccggtgccttggcttctcatcatgctacagattctttaacacacacattgtcctccaagaagcttgccagatccactcctattctttcaacgaaatgtttattgaccactctttatacactatgaccaaataggatttatcccacaaatgtaaggttggttcaacatgtgaaaatcaatttatataatacaccatattaacagaatgcatggcggagcgggggcgggggagggggctcatggtcatcttaatcatgtacaaaaaggatcatttgacaaaacgcagtaccctttcatgaaaataaattcaacaaaccaggaacagaaagaaacttcttcaacctgatagagggcatccatgaaaaacccagagataatatcatacttaatggtgaaagactggttgatttccccctaagatcaggaatgccacttgtaactcaacatygtactcaaagttctagtcagggcaattagtcaagaaaaagaaataaaaggcatccagattggaarggaacaagtaaaaccatctctattcatagatgcatagatggcatgttcttatatagaggacactaaagagtccaacaaaagaaaaaaaaaaaaactgagacggtttggctctgtgtccccacccaaatctcatgtcgaattgtaatccccacctgttgaaggaagggcctagtgggaggtgattgaatcatgggggcggacttccccyttgctattcttctgatagagcgctcacaagatctgatgattgtttgaaaatgtgcagcgcttccccctttgygtgcgttctctctctcttcctcctgctccaacatgtgaagaaggtgcttgcttccccttcgccttccgccatgattgcacgtttcctgaggcctgcccagaagcagaagccttgtacagcctgcagaaccatgaggcaattaaacctcttttctttaggaattacccattctcaggcagttctttatagcagtgtaggaacggactaatatgccaaccctgtctgagtatgctcagcaaagcatattcggctcagcaaagttgcagtatccaaratcaatctgcaacagtcggttgtatttstacaccctagcaatgaataacatgaaaataagattaaggaaatgattcattttacagtagcatcgaaacaataaaatgtcgaggaataaatttaactaaaggtgtacaagatgtatactctgaaaatttcaagacgttgctaaaataaattaaagaagacctaaataaatcgaaaggcattttgtgttaacggattgggacacttaataytgttaagatgcccataatctccaaggcaatatacagattcatcgtgatgcctgtcagaatccaacctgccttctttgtaaaaactgacaagctgatcctaaaattcataagaaaatgtaaggggctcagatagccaaaacaatctcagaaaagaaaaaagttgaaggactcacacttcccaatttcaaaacgtactacaaaaccgcagtaatccgaaaagggtggtactgccatcgtgatcgatacattaggtcaatgttacagaactcagagtcaggaataaacccatatatttatgtaaagtttattttcagtaagagttccggcacccctcaatgggtggaggggaagaataatcccctcaacaaactgcgctgggacaactggatagccacatgcaaaagaaggcccctggacccctacctcacatcatgtaaagaattaattcaaaatggatcacagatctaaatgtaagggctgaaactataaaactctaagaagaaaacggagatgtaactttgcacgaccttggattaggcaacagctccttcagtatgacaccaaaggcaaagccacagatatcttttcatttggcaagttggactacatccaaatgtaaatcttttgggcaacaaagggctctatccagaaagtgaatgggagaaacatttgcaagtcacatatctgataagagtctattttccagaatatatgaataagttttagaagcccacagccaaaatacaatcaaccgaattaaaaaatgggcaaagggcttgaatagacattcctccaaagcagaggtacagagggccragaagcacatgaaaagatgtcttagtctgttttctgttgccataattgaatacccgacactgaacaatttataaagaaaagaaatttatttcttaccrttctggggactgggaagtgacccggcatctggggacggcagagggtatcacacggcgagagggcaagagcgtgtatgtcgtttcaggcytctcttcctattcttataaagccaccagtcgcatcctgggggtctcaccccgatgaccttatctaatcctaattaccgtctcagaggctgcgcctccaatcaacatgtgaatttggggattaagtttccaagacacacaatttgggggatgcactcaaaccacagcaacatcattagccatttgggaaatacgaatgaaaaccaccatgagatagcacttgacacccagtaggatggctactgtaaacaaaacaaaatgaggcaaacagaaaacaggttttgatgaggctgtgaagaaattgggactctcatgcactactgttgggaatgcgaaagattacagctgctgtggaaatcagtttggtggttcctcaataagttaaacagaattaccacacgagccagcagtttgactgctagaaatagacccaaaagaactgaaaagagatattcaaagaaaaacctgtagagagatggtcatggcagtgccactcacaatagccagaagggggaaataacctgtccatcaactgacgagtgggtaaacaaaatgtggcctcctattcatacaacagaatcgtactcagtcattcaaaggaaggaagtagtgattcatgcctctacatggatgcaccctgatgaaaccattacgctaagtgaaagcagccagacacacacggcctcacatttggtcgtataattccatctataggaaatctccagaacaggctaacctctatggacagaaagcagatggactaggggttgycagggactatcgggaacgtgtgtatgggcgggggcagggggtgtgtgtgggagggtgtgggggctggtagtggtggtgtggaaggaggcgtgcggcaagtgactgcttataggtacaggggtttcggtttcttttcggggtgttgaaaacgttttggaactaggtggtcgtgatggatgtgcaacattgtgaaggcgtggtacccgtcctcccctcgcccacccctttgtctttcccacggtgttcccatccagtagaaagggaaagttcccactggcaaagagagggtcaccagcgcgattccccctgccccgccccaccccacccccacggccctccagccacttctaggcccaggcctgctccctcgaggccaatgggaaagtgatgaggtcacctgacggacgtgtgtcccttgtgaggggccgtcaccacatgcgtgcccgtcgccggatgtgcgtgcccattggtctcggctccctagccaatgaggggctgggccctggtcgctaggatacacagtactggacgcggtaactgtcctcttgagagccatcttgcctagctgggccaagccgagatagcacactcaacgcccagcatgccgaggaggaggagacgccgagggyyctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtccyggagctggcgggcaacgaggcccagaacagcggagagcggaacatcactcccctgctgctggacatggtggttcacaacgacaggctactgagcaccctttkcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagccatctgcccgcttcagtcactttgccttggggtgggggtgggggggcggtgagatgggttggggggttgtgagacctccacagctggagggatggagaggtggtgggggtctggggttgggtgggagccagggatggcacagaggagcmgtctctccgggtgacagtgcaggggagtggccctgggtgggaaggggacacccccgctggttctgagcaagtcagggcctgcccgggaaagtcctcagcatgatggtgttcgttggggcgggtgggcctcaagaccatgactgcagtgttgsgacaggacggacttctaaggcaaccggggtggggacggagaggtggacccggtgcttggcaaggggccctggaccggaagacggaggactgagtagtcggggcggggggggggggggacaacagtsyagaaatgcgcagacatggaattagggtcacgagtttcctttgggtcatgttcagatggagaggctgtgggatgcctttagcaacctagaccacttgcattgcagccgagctagcagcagctggtgccccgccaggccccgcgtaccttcccagggtcttggatccgcatccccgagaccctcgatttgcatacgccgctcacagcccggccaggccccgcctccgatcccgctctttgcacctcaycagggcaaggggcaggctcgggctggggagccggcgcgggcacggcggcagcccgccgagggggacgcagggcacgtcgccccgccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccmgctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggcygcgctgcttcctccgaactccggctcggcggcgccctctccygccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcmggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcckggactttttgcatcagtcacgttaaccagatgactttgcctgttaccaaacctcatgcatccacgtttgcgtctggggaggaataaaaagacatcgttcccgcttctgcgttttgttatycctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccaccyaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcatgtgtggttttggtgtccgtcgtctataaaatgtgactctcttacctacttgtcaggaggccagcagcagaaccagatagctgtttgggctccaggatgtattcgttcctttgaaatttgcgctatgcctcctatgtgggcaacgaacctgcagagatcatctatgatgtgctccgtactcgggtgactgcaatgcagatacatccagtgcagcgggtctggtgccgatgcatcgatttgcattggaattcacggttctggttccattcgcagaggtatatgcagtctggatcacaacagcttttatttgtaatagggatttttttttttttttttttttccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatacgtgaatagtacaaagacaaagacgtttgagaaccgctacgccggaggaaggtggtcaagactgaaattagcgtgttaggcaagatctggttcctaggtgctgaggattctggtgccaaggattaatgttaaccgtgcaggcatctctaccaccgttagaggagaccagcagcccacagactctttctgtcaagggcgggatagaaatgtgttagtctttacagaccacaggtggtctctgttgcacagtcttctttgtttctttgtatgtttgtctttgcaatcctttcaacgtgtaaaaactattcttaactcacagtccgtacaaaagcaggctatgggccaaattctggggctatagtttgcccacccctgaattagaacccaggacatagtagttgctcagtgactgttcaaggaatgaacctcatgagagtagttaataactgtaagtaatttatccttatcgttaaaatacaaagattgaagaataagtgaactaagcattcacctccagattgtaggaaacaaaccaaaagaaaggaaaatagaatttttaaagttttgaacagagattgatgaactagaaacagctctttcaaaaccacgtttgggtttaaaactgagctgattctttgaaaaattaatagaatagacaaacacttgccaactcttgatacagaagggaaaaaaggagaaaagacatatgtgtgtatacagatatagatgtatggcacaggaagggatatatgactctaatgtgcacatttgcagacattaactcaaggcaacacaaatgagaatagcaataatcatataacgattggaaaatatagcctagtatctctcactaaataaagcacatggctcatatggctttttcatttactctcattaaatactggattcctacattaaataagctattctagagcaatagtcttcatggaaaaaaatggaagctttcccactttatttttcaagtttaatataaccctcatgccaaaacctggtaagtagagctactgaaaaagctaaacccatttcattcatgaatatagatatagaaattataaatgaaatgttggcaaattggatccagctaagttttaaataactaacacactatgactgacgaaagttttcccagaaatggagcacagtagtgctcttgcactggtctgtgagagccaattgtaagtaagcatctcttcccatccctggggccaggcatgatgggagtagtatttatgtcagggaaatctgccaatgctataaatcaaggcctttacttcttaacctcttctcactttgctcccctgtgggttgttaatttcttgtcagcacactattgaatgttaagtataatttgacaacacaaaagagaaatgtgaccatgtcaaagatgctggaaaagcatttgataaaattcagttgccattgcaaataaaatagggataggagaaa

SEQ ID NO: 13416 - DNA, 16326 bp, Homo sapiens
  misc_feature (1)...(16326): n = A,T,C or G, or insertion/deletion polymorphism (see Tables 1-2)
tgtgctcaccctgctgaccgtcacccagcctccggggggggtcacagctggcccccaggaagctgcttcccagcagggcaggaattccatttgagtcttgtccctgttccaggagaagggctgggtatgtgtcccccaaaggggagagcattcgagaaggatggcgccagcctccccagaactgacctgtggttwaaaaaaaaaaaaaaaattgtgctttttaaaagatgagttttatcagctcacacatccttctagagtctaatggagattttttgtgtgtgtggaaatagtaaacaaggtcttgaatcccacagagcaaaaaagacttcctttcatgggcagcactggaagggttgttactctggaatggtttaaaagaggcgtcacatggcttgtttgtgctgatgtcactgcctcgctgctctcctgtggcacctcctcggtccctggccacagggcacagagccaagcacatctcrtgctcttggcccagttacgcttctgcccaggggtaagtcagctggagaggaattcacagcccaggcatttcatgtcgttatggcctattttaatttttttaaccccaatcatttttcttaggaagtgatggggagtttggaaaggcaggcttatttgtcatcaagctgccagyttttatcaatgcaaaccacatccctgtgacatctgtgactgttccttggacagttaggtgagggagggtctcctggtggccccagggttactcttatttaggttgagaaaaattcctttttccaggatcgttggtgatcaaagtgtagtcattctgttgcgcagagaactccatcccagctccaccctcatgaattttgtaatcttggacaaattatttagtatcttagtgcttctgttccctcatctgtaacatgggggtatattatagtcagtagcacctgcttcacaaactcgtgaggacttcagcagttcacacacataactscctcgctgcctggcacctagygtgcacatggcattctaccgtggggtagacttttaaaattctggctacagagatacttttccataaaagtggccacatggaactctccaaatctaagaagcayactgtgggggccttcatattttgtctaattcttttctccccagaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggccccatgccagtgcagctgatgtagaggcgggcagccccgggttaggccctgtggagacgcaggcccccgggctctagaacgctgaattctagtgaattctggatggctctccctcacacccaggcccaccctccctcaaggttgcaccwtctccacctgaaggaagctgccaggtggccataggagcccttctcttggcaggccagcttccaggcccagtggcttctcttacatcaggggcctccccttggaatgttccctgaaggccagacacgggcaggtagtctgtggtcaagcagccaccctgacaggaggctagatgccactgggtgtgctttgagtttcctagatgtggagagttctgtgtggccacttttatggaaaagcatctctttagccagaattttaaaataaagaggataacttcctggtgagaacagacgtggaaaggaaggcactttggtttcacgctcaygtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgygactctgagggcctcacaggtatttgcagcccaggtgctgtcggagcccagccgatgckaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactyggagtgtgcatttcttcgtgttgcaagcctggcctcacagtgccttcttcctttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagaygcctcagatagaaaactggttatttttgtttcttagcactgccaccatagataacagctgtcacgatggacagtgtggacctggattagtccttcttgggaaaggagagtttgggttttgtaccrtggtggttytgggttctgrgggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccrgtttggaccccctcccgtgtgtcttggctgcaggtttgaactgatgygcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttaygcccacatgaacgggggccgcaagaacgagcgggccttgccgctgccccagtcttcgacctgctgatccttggatcctgaatctgtgcaaacagtaacgtgtgcgcacrcgcagcggggtssggkgggagagagagttttaacaatccattcacaagcctcctgtacctcagtggatcttcagwwctgcccttgctgccygcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatcygactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagyctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcrgtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttyccttgcctttgcttaggttgtgacacacwtatatatatatttktttaattcttgggtacaacagcagtgttaaccgcagacactaggcatttggattactatttttcttaatggctatttaatccttccatyccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgkgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaggtattatatgtaggagttttcttttaatttattttgtgataaattaccagtttcaatcactgtagaaaagccccattatgaatttaaatttcaaggaaagggtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttytcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttytgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagargaaggtgtccaggcagcaccatctctgtgcgaatccccagggtaaaggcgtgggkcattgggtttgctccccttgctgctgctccatcccygcaggaggctcgcgctgaggcaggacygtgcggccatggctgctgyattcattgagcacaaaggtgcagctgcagcagcagctggagagcaagagtcacccagcctgtgcgccagaatgcagaggctcctgacctcacagccagtccctgatagaacacacgcaggarcagagtcccctccccctccaggctgccctctcaacttctccctcacctccttccctaggggtagacagagatgtaccaaaccttccggctggaaagcccagtggccggcgccgaggctcgtggcrtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataayggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcaytttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacaytgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagacygtgttcgtggccgacctggcctctcctggcctgtttcttaagatgcggagtcacatttcaatggtasgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagcygaatggcttgccagtggctctgtggcaagatcacactgagatcgatgggtgagaaggctaggatgcttgtctagtgttcttagctgtcacgttggctccttccaggktggccagacggtgttggccactcccttctaaaacacaggcgccctcctggtgacagtgaccygccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatyagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccckcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgaytgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaawtttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgcatttctgtctctggtttggttttgtccctcctggaagcatcactacactttggtggcagggaagctgagctatgtggggcacgtgtgttcacgcatgttgcctggaagcgttctccagaaaagcattgcctcttctctgacagctgagctttctcagcatgcarattgccagtaaagacgacagggaagctatctgtttctccctccattaaatcatctggaaagaaatttgaatacataaattacgaaactctgtactgcagttccgactgatttgtagacttttttcctataccttccactaacaacagtcaggcyaaggcaagtctgatctgcatgaccccaaggcagaggacttcagttcttcacatttcccatgtgctttttggtctttcacagctgacatgcccacctcggggggrtgctggtgagaacccagtgggcctcacgcagaatgtgggtcactggaggagctccaaagtcctagttactttctagctgctgctcagtgatctctgtctgcccctagggaccctacaatgtaaacattatttttgtcaggggaaatggcatgtatggcaaggtgtgttctagaatcagactaaggattcagacacatcaggcagagaagctggtcatttccttcaactttatcatgggaaattatgctccaatagcaaaatcgggccagtagaagaagagctgtccagcaatgtataggtagaagtaaaccgaagaccatggttacttcagacctgttgagcctcagaagtgtttgcacctaaaagcaaaggcctttctgaaaggggactctcagctggggtgcggtggctcacgcatgtaatcccagcactttgggaggctgaggtgggtggatcacatgaggtcaggagttcaagaccagcctggctaacatggtaaaaccccatctctactaaaaatacaaaaaattagtgggacatggtggcgggtgcctgtaatcccagctacttgggagggtgaggcaggagaatctcttgaactcaggaggcagaagctgcagtgagccaagattgtgccactgtactgcagcctgggtgacagagtaggactctgtctcaaaaagggtactcaagcttggcattgcttcagggttactgctcagtgttgtcaccgagtgcctggcactcaggggatcttcattaggtgactgatgatgaggaggtctcaattctgaggctggaaagcccaacagggcctcctccttccctggtcaggtagatgctgcccttccaggttgccacagtgcagtctgcacttggcctgcccagccagaaggagcagcaatatctaaggatgaaggtgctgggtcttcagaagcattagaacctttcccctccaggccatttcttaagactgcaagccctcaagagctatttctgcatttaccccccaagtccaggtatgagtccatactcactcagatgtgtgatttttgtagtgttctaatgttgctaaaaagaccttcacatccattctctcaccagatgttcacaatcaccctgcaaaggaaggattttaattactcttacagatgagcaaacatacaggcatgctcaagacccctcccccgcccccccacctccccaccagctaccaactcaggactcagcctctcagccttttctgctgtggttctcaatctggcttcagcactgccagaactaagcaggctctgtgcatactgacaagggatgctgggtgaagtacacagcccaggtgtgaatgagacttctggggttctccctggagaacttcaggggccacagcggggggaaatgatggggaagttcttgaagagggagctctgggcctcccaactggataatatctaaaaatttaaaaaatgttatggcatgctgccaggcagtctgaaatataacactggagcccagtcctgggggccccttgcttgccagtgtcctgggacagaattgcccatagcasagacagatctccacattagcaaccatgcagccagacctgtgcacaccgcccagcaccacctccccccatcccccaatatgtgggctttgatctgttttctagcaaatgatccaggtgtacttgcaaagggagtcccctaaaggctactccaaatgcaaaaagcgtgctggcggccttgactgcttcctttggttttyttgtgggtttttktttgtttttttttttktttttttttgagacacagttttgttcttattgaccaggctggagtgcaatagtgcaatctcggctcactgcaacctccgcctcctgggttcaagcgattcccctgcctcggcctcccaagtagctgggattataggcacccaccaccacacccggctaatgtttttgtaattgtagtagagactgggtttcacatgttggtcaggctggtcttgaactcctggcctcaagtgatccgcccacctcagcctcccaaagtgctgggattataggtgtgagccactgcgcctggcctggttcctttgttaggaagctgcaaatgcttttcttaatagtgaatgaatccaaacactaactgatgaattttttaaatgtagtcaagtgaaaaatggtagttgtaagcacaccaacgtaacaagaaatttcccagagctcacctaccttcactcacttcctccaaaaaaaaaaaaaaaagcgatgttaccaatgggactcccaaaggaaatctgcccctagaaaacactgaacaggtagaatcttgctgggagaagcttggcacaagacccggtgctgtgtcataaaagcaaaacaaaacatgaaacagaaaggagattctgcttttaaaaagggaagacaccatggagagaagctaagcccggctattaacctgcgccttcaaaccaaacactaccagtgtgactgtaaaatggtgcagcccctgtgcaaaacaaaatggcagttccttaaaaaattaaacacagaattagcattgaatccaggaattcacctctggakattgacctgaaagcaaggactcggatacatatttgcacgccagtgtttgtagcagcatgatttgcaagaaccaaaaggagcaagtaacgtaagtgttcatctacagctgaatggatgaaatgtggtccatacatacactggaatattattcagccttcaacagaatgaaatcctgtcccatgctacaacatggatgaacctggaggacatgaggctgaaataatacgccagatgtagaaggaccagcgccgcatgactccctcatatgagctacctacagtcagattcatagggatggaggstggagtggtgrgcaccaagtgctgggaggaagaaggaatagggagttaataggtacagagtttcagtttgggatgaggagaaagttctggagatggatggtggtgatggttgtacaacaaggaaatgtactgtatactactgaactgtatgcttgaaattattaaaatgagtagtaaaaggggcaaacacagagacagagaaatcatacagtagagcctcggtggcttcgaggctacccaggacctggacacacaagctcaaaggccaggaatggggtccctggagcagcggctgtctctgtgcttctgtaagcatctccaaaacaggtctgtggtccccacagtctgcgcaggatcacacagacccactgtgtagatttttggaagaaaacagatgactcggatttcattttattgtcatgaaaaccataactgaagctagttcatcccctgtgaaatgtccacctttcagagtgttctttctcctgacaataaaataaccctttgtgattttgttgggctaattcagagttttccaccctctttgtcttacaagcaatttttgaaaaagtttctcaatgcacagttgagtgctacatacaggattgaaacattcaattttctctagaggagcaatcccccggtcagttccctttggctggaaggaccrtggttgagttttcttcgaactgggctctgtgcttgggctttcccacctcttccagcatttsctggatgatgactctcaaggctcttcccagcaggctggccgggagcccgcgcgatagtggagggacatggatgagtgccrcgcagccctttccatgatgcagagacaggtaataggtataatcacagacgtatctgcaaccacaggaaatgccacattaattctcggaccagcctctaacctcagtgaaacatacgcagaagtggcaatgcaacacccacaaagcctgaggagggagcactgccacccaagggagacttgtgttgtttcacctcagaaagaacatggtgccaggatgagctggggagagctggctcttggcctcatggcctcatgaccggcaagtggccaaggcagaaaggggtcagatattccacagcaccngcatcccagtgaatccctctcattcatgtcttcgttgagtcacttactcattcattcactggggaaaggggaaaaaccacctactggggatcggagtttggagaaacaaaggtaaatcaatctttatctggggctacatcaacacagttaactcacaacttcggtcaccccaaaaatcaaaatcagaaaacattcacgaaatgttagtggctcttgaagtctgccttcccatctcttctcctagatcaacacaccaaagaccgtgtttccacaggcaggtctcacaaacgagacctcaggcaaggtgtgagcaactgtgctggcctgcacacagcaaagaggggcaatctgggggcggcaccgcatggccaagtggccagctggacgatacaggatggcttcttggaggtcggggggacgctgacggccattgcttctctcctacctgctcagagtcctgacacccacagagcatacctgcctgcatctcgggaaaagatcacgtcgacaccctccacagctacgcgcttgcagactgccttcatgcagacccctgactccagcacgtctgggctgccaggtaggcacacgccgccctcgggccagaagctgcggatgtcggcgtcccggtagccttggttcttsccagactgttccagaatgatcgccttggcggcggtgtccatgcccacatgcacgaygagctgtgtgaacgggtaacagcagagagaacccaggaaaaygaggccyaccctgctcaccaratgtgcagaaggggccactccttttgagagcccggstctgtgcaaaacatctcaaaccccaaatccactgggaaaccccaggatcccccaccagtgtctcctaattaatatggctggaaagaaaaacagctggattcttttagctgaataaaaactcatgctgcatttacatttaaatgctttttacttcaaattattcttacagggtaatgtattctctttttgtggggggagggttggagggaggagaggcaagctagtaagtggtgaggctaccacagcagagtcttygtgttttggtggaatcctgaatctttttattttatattttatttatgtatttatttatttttatgagacagagtctggctgtatcacccaggctggagtgcaatggcaccatctcagctccctgcaacctctgcctcccgggttcaagtgattatcctgcctcagcctcccgagtagcggggactacaggtgcaccacgcccagctaatttttgtatttgtagtagagatgggatttcaccatgttggccaggctggtctcaaactcctgacctcaagtgatccgcctgcctcggcctcccaaagtgctgggattataggtgggagccaccgtgcccgcctcctgcatctttttttaaatgaaactttaataaaggaagttagtggccatccagtgaaatcttcttagaatttattcaagctgattatttttcctttttgaaaaatagctgcccaagtatgttatcaaaacatctggggcattgtctgaatggcttgatagtgtatgttttattaacctcatca

SEQ ID NO: 13417 - DNA, 81706 bp, Homo sapiens
  misc_feature (1)...(81706): n = A,T,C or G, or insertion/deletion polymorphism (see Tables 1-2)
tattcgagctctactaaaccactctaggacatgccttctttgggtcatcaaaaatcaactctcctcgcctaggttttattcttgccaacttagcattcccacggcaattcactaaaaacgccttaaaaaatcattagctctcatttattcaacttgaacatcagcatggcctgaagctcgggaagaaacagactggcawagtgacgctgccagcaccaagtaaagttttacctcccagcgctccaggttcccagcaagacttccagccagggctgccttccactccatttcagcctggcaccctgactctcgctctaccagctgttggcacgccttgtgttaaccgagaatttgtgagaaaagcagaaccttcccactgcgtgttagttttgcttggcaacactcaacaatctcaaattggaaggccccaaggaaaattttttgttgttgttcttctgcccccaggatgattttttcttcttcttcctgaacctgtttggatttttttccacttaaaaaatctagcagcccccacctaactgatggatacttgtaggtaaatgactctatctgagcaatgatgcgctgactgggcctataaattaygacccattgtggttagttcaaataaaaggaggttccgataaaggaaaactgacactcggaattttctctctcaaaaaggatgatgtctagggatgcaaaattcaggaatataaagagagwccttgcaaatgtatcaggctcttctaaaatacaagggatkggtataaaattgtcctggtgaaatcaaggggaagcacacaggactaaggaaagagaggcaagaaatatatttcttctcctttgcagggaaaacactgcattgggaagaagcttgctctttccaaatacattccattaaattgacaaccayagccaccactgccaccacaacaaaaatcaggccaacctagatcaaattactaggaataggtctaatgttacttttatgaccatgaggtcctggccctcatcagaacctctgggttacccgtcctatcacttggtaatgaatttcatatatgtatgtgctgttaaagcaaaaaaaaaaaaaaaagtaaactcataaataattcatcacactgtctcctgccaactgatcatatattgttcatgtttcaccggccatattaaataaaaatttaaaagtgtttccgtttttcatttaaaaacctagtctataattggaggtgaccacacgaagtgtcttgaaggtagcaggcattaaaaaaatcattacttaaattgcacagttaaaaaatattcattagaaatggctaaattaaagaaaaaaatgttagggaatcttagggaaatgtttctcctaaatgttgtccctaaaactgcttcactctaaaaatctgttttgagcgacctgataaaagggaaagagagagtttcagctcaaactcaggaaagaaaggctgtaccagtttcttcagaatggaacattaaaacaggccactactgaaacagttcttgtgcctttgtggctaattattacataattgatcttaaaaaaatttttttaagtttaggaaaaaaaattagaagcctagtgaaagtaccaaaaacactgtaacttttttgtttaaaaatttatatcatgaatcgaaaatcagaggagatggccgttttggcctggtctccgtcctttccttctctattttgattgagccagtcccttgttaagccatcagaaaacagagcacacttagagctcttaaactgctttagacacaaagaaaaaatttaaaaggaaaaaaaaagcaataatcgtgtgacatctcagagatgatagcatatactgttgttttgcttgatgacgataacacaattctttttgaactaagtatctctctagactacaactgsgtcaaaattatagatattttttgtggccctggatgaattttctatttgccaaaactcaaaggattcaaaaccaggttgatgtctagttaaagatgatgctccaactgcttgagatgctagttcatttcaacagacattaagattgaaggagtgtcatagattgcttaggcaattagaaatttaaaaccgtttcaaagaaaagaaaaaacaacaacaacaaaaaagttatgccataggaagcatgaagcctcatttactaaagtggagaaatgtattttattytattgtccttatggcgttgattgccagttctgacacatattacaaatttcacattgtttttctgaatgctgaggtcagacctaccataagcttgtcccgttgtattaccaaatggctaattccctcccaggtattggagaaaaaagtcagaagggcagcatcctaagagaatgggtgcccagtatgacaaggagctgctaagataaaatgaactttctaactaaaaacagaaaagaaactataaaattgattttaaaatctgcaggacatttttttaaaataaaggataaattaactatgaatatattgagtggttatgaaactaatatatcttagcataacagagtagagacagctttaaacttttctatgatactcatatagttatattttatgatgstctaataggtatrgggtacataatgaagaagaagctgtttgtggattcattgtattttattttattttattttttactgctttgagtatgaagagtctgcccaaatatactacttataaatcataccaaaagtgcatcagtgaaaaccacagttccatttcttaggggaaaaaaaaaatcaagaatcaagttttagaatccaacgatcacattttccttaattacaaacgaagacatcatgtattatttttctgtatccacaagagatgagagaaatgtaatttttatcgcatgttaagttttcactgaatcacagtattattaagctttaaatcagaggattgtttccttcagctaagtctaacaatactagaaagtaaaagggggggacaacccccacctcatctggggctgcaatatttgctgaaaaaaatctacttcaaaacattaatcaaatttttcgcccactgggcaaccatatggtacagcagcatgtgaatctcacaaacttgctgatctcctgtaactgggtgcaattaattacgctggctgcatccatctcttggattttcgccttgtgaaaaaagtatttattgcaacagcttttacaaaacaagggaatgaaaatcacaattgattaatgagctgaatggaaatatttccgttagcagatttttttaaatgaataaggattaataccatggatgggaatgaacacacgtcgatctcgccttgtactttttggacccccaaaaaggtggcaaaagagtgggcagagacggtgctgtgagttctaacatgcataattcactagcaggctttaggtcgcaagtaataaagccttaaaactggtgaagtaataaagaggctggctttacaagatactatcctgggagacagaaagcttgttctttgatgtgaaaacacagatattaaatactcagtgggtgaggaacattacaggcctgacaaagaagagaaagggaagggctcttgaagtaagcaacctactttgtcctcagctatttaggygcaaaggttgctgcacatatgggccgattactgttttaagatccctccataaaaccaagcatccgagagtccgtcagaatggtaccactgtccttacctactggctaaaggcacaaacaatgcataattgcaaaatcttcccccagcaatgttcagccatcatgcacttgactttgcttaacagtcagacctcgttctggtgctgagccatcctayggggcttcatggagcttgtttcttgatacacatgagggtcgtaatccctcccttctaacttaattttttttttwrtttttatttttcagagacagggtctcactctgttacccagctggagtacagtggctcactataatgttgaacttctgggctcaagtgatcctcctgcctcagcctcccaagtagtcctccaaaggactacaggtgggtgccacccagcccggttaattttgttttctctttttttagtagagacagggtctcactgtgttgcccagggtagtctcgaactcctggcctcaagtgatcctcccacctcgcctcccaaagttctgggattatagatgtgagccaccttgcctggcctcaatccttcccttctgagggagtgacagatccaaggctgacagtctataaacaaagcagaagcagatgcactttgccccttttcagaagtgccctctgggtttaagtccaccagctagccaagcattaatgacatcatcattacatgcatgcctatttcagaaagatcagttccattttccctaaatagacagcagaggagaccgcttccaacattttgctagttgttaaatatgtatcttgagaaaacgaaactaatactaaacataatggaagaaatacgtaagtttgaaagatcaaatatcrtatgactcttgaaacagataaaggaaaaagctgttaggaccaagctttgtaagtcaactcttaagccaacccttttctttactgcatctattgcatttaaacttctaccaggaaattctgcaaaggacttggttaaagagaatttactattattttattaatgcctgcagagtgtgtgtggctagtatgatgatttctctgctcaagtttgttgattgattttgtagaaatgtccacaggagataaaatctgcaaacwcctcaaagatgagactgtgtccaagaaaagagtaatgatactttataaaacaagaagtaagtgacatttgaaacgatggttcatctcaaacaacacatttcctctgagctccatgtttatgttaacatgtaagtttrggaatgctgatgtaatagacaaagataactcttgccacttcaaagtagcaggcatgcctaggtgggcaagaggttcagaaagccagcacttaaggtgttgaaggggtaatttttaaaaatcttaagaaaatcattccatttgagaatcggagccaccttacaatcaaagaagccactgttttgaagaaaccactatcctgcaaaaagtagacggaagttaccaacaaaaagtacttggctcccgaagaagaggaaaatcagatgggaacgggttgtccaaccccttaaaccagtgaccctacaaagtacaccaccacccaccaccacctctcagatgatctctaaacccctcctacacgcaatggttgttggcttaaaagtttaaagagctaacaaaatgttttaacgagatacaaatctcagagatcattaatcaatatgttcaatgttatttgtgataattcatcatgacgtgatattaatgggttactgtacccttcagaggtgagattaatgcaaatgagctgccacaattaactttactgctcccacctcacaggaatggacagatgattataaatgacaactatatgtcaattacaatatccaataaagtgaagcttagagaacaatccatctccttttattgctcttccttgacgtagctgaatttagctcaacccactgttgtcactatgtaaccattgtttgggggagggaaaagagatttttcttctttttttttttcttttttaatttttcgatgtcttaagaagtgcttcaaaaacgtccatgtaaatacgttttctaaaggaggagagccacaggaaaccaggaataaatgccacattcatcctatgtgagttaaagaaaactgtatccrttttcaaattgtagcagtaaggccagcaaggaaacaacctacccagctgtgtataatatatttactcaattaaaaaaggaagacattagcacagcatcctgaaaagccttgagtttcactaaacaaaagttatttgaaaatgactccatcgaagtaaataggtcacagagtggaaagcaggtatgaggccgagggcgggatgaaaggtttgatgtcagtctgtacacctgcacttggaggtgtggagtggggagcaggtcagtaaatactacagtgctggccctcacagcagagaatttctgtgtctgcatcgttcctccttgcatggatggagtgatttttgacagcagtctctctggtgaaggtaggcacgttgtcatgttgcctcctcaacccagattctcctgccgggctggtgaacccagaagctgtaagaattagctagtatctcacagctaccccttcctgccccacttgagaggctatgtccacgccgccctcttccccagcagacactggctcatcgctgactgccataggtcagccaggccctggtctcagtcaggaccaactctgctgtasaattcaccctccagagcttcccgtgggatcaagctgaagcwgatcttcagctaagccacatccttcctggacattttccctgtccttttttttttttttttttttttgagatggagtgttgctcttgtcactcaggctggagtgcaacggcacgatctcggctcactrcaacctccacctccsaggttcaagcgattctcctggctcagcctcctgagtaactgggactacaggcgaacaccaccactcccggctaattttttgtatttttagtagacatggggtctcacatcayattggccagcctggcctcaatckcctgacctygtaatctgcgcayctaggcctcccaaagtgctgagattacaggcgtgagccactgcgcccggccacattttccctgttctaagccactcttctcayttcctttctgaaagcatcctgacccccatcaaatcagtggaacaagaagactaccttgacctgtgcttccaggtaacagaacgcaaggcaggtatcaatgagatggaaacaggaatgctcttaatgcagtgcaatttacaaaagaactgttctttgctgaccactagtaagagaccatccaacaggctcctttytgaagccacatcccgaaaagatcccctcctgatgtctctagaaacatgcaaaaataaaaytgcaacgtcagaaccataaaaggatcatagcagattgacggtagaagctatagatttgtgtgtccagaatgtttccccaggtgcctccttttgcaaaattggacctcattttwccattagggaacggggcctctcagactcygtggagaagcagagaattatctccagccttgactgcccaggctgcagagaaccgcatcatccggggacatgactgattcagggataggtgtctgcctaaaactaggccaatcctggttctccctgtggcttttgggccaagggtagtggggaaaacagcttcttgtcactgggggaacaagccaagatgggacagtgctcgyctgccagyggcagccccattyggagagaattttccctttgaagaatataacccataaaagatcatcaaaactaagggawtaartaaagaggggacctcgatgacatatttaagctctgaataaagctagactctaagcaggggttggcaaactataaccgctgggccaaacacggctgtgttcttatacagcacacaggctaaaaatgcttcacatttttaaatggytgggggcgggggggaaagaataatattttgtgacacatgaaaatgtatatgaaattcaaattccagtatccataaataaagtttctcgcagccatgcytgctcctttacatrtcgtttatgcctgttttygcactatgagggcagagttgagtagttggcaacaaacactacaaggccccaaaatatttattaaatatcccatcacagagaaactttgctgactcttgcacaaaacttcgcattttgtcagccagtaatgaccctttcctcttaagctagtttraatttggagctttttgtgtgtaagaggaaactcctgatctactaaaagaaaaagctattcttagtccttcccagatatccctgaacctccacccacccagtctgctgggatcctgatatagtttggatatttgtcccygcycaaatctcatgttgaaacatgtccgtaatgggaggtatttgaatcactggggcrgagccctcatggcttggcgctgtcttcaccayagtgagkgagatctctggagatctggtcattttaacccttttcccatttgmcccaagaatacttactggtgtgcagtgtttaccctgagatcgctttgccatgaaatatctcgcttttattatttttttcacatcactctagcatatcgactttggaaacgaaggatatcrttctatttatagccttctgtttttagtagtggtatttccatttacaaaatataatagttctccatcactgaaaatgtcaaatccgagaaaatgtagcattcctgcatgtgatgttaacatmattctcgaacagttgttggctgaagattcatttgatgaatccgatttttccaaaatacacaattctgatgattcagatgattctgatgttagttctgttcagaaatawttccaagaactgtttttatattttattatcactttgaaaatcggtcacatttgcttcagcttcaaagagcatgtttatgtaaaattaaatgagcgctggcagtgagctgcgctttttttttcctaaacaggaaaagggttaaaagtggggcacctcccacccccaccccacgctctgtcacttcccactgtcaccatgtcacctgctgctctctctttgccttctgccatgattgtaagtttcctgaggcctccccagaagcagaagccgctatgcttcctgtaccacttacaaaactgtgagccaattaaacctcttttcttataaattacccagtctcaagcatttctttacagcagtgcaagaacagcctaatacatatcctacaggtaacgtctcaatatccagatcaagtgactggttgtttctcttacctgtttcgcagaagttattgcattctttgttgaatatcacaaactgttaatatgttaatcttaaaacatgtgaaatatatataatatctatcattacaactacaattccaaatatttatatataacgtcagccatgccaatggacatgcaattctaggcccagcaatggacgataaagtaggttaaaagtgggggagaaaaactggttttaaaaaactgtacctgaagaacatatttaatttaaagggaaatcccacaacagctaaattgttcccccagttgggtagagcctgccatgattagctgtaactgcctggaacactctagactcagctgacgaaactccagttgcctggtgagaacagagtgattttgatgacttttgcagaggatcagaaagaggggaaacggattcatttgattcatytgtggtttcctgttttccataaggagatagttacaggattaaatttctcctcccttttccctatgcactcacacctgggtcccaggacagmaggaccaatcgtcaggaaaatacatccatactgcatcccctgatacttcatctcaggttgggcaggagggttagcagaagagttatttccctttgcgaagattaaagggtatctcacttttattttaacaatgtgaagacaactgttgttccttactattaccaatctactacactggattctaatagctctattacattttccatacattctcctggcatggggcataaatgggtgagacagctctggataaatcactgccagcagcagaggcattttctttagggaatgaaggcttccatatagcatttaactaactctctttttggaaacaccccatcacaaatgagtctttcaaactgaagaaattgaaattgatttcttagggtaataattaacctcagaaaataatgatgaaaagttgcttattaattattttttataatatactttgggaatatttcttttttccatgaaagatagagacaaaagtagacacattttacaatcatataaaatgtgattagactcatattttataggagaatgaaactcatttaatttgcaaaatacttaatatgagagggaggtgtccccctacacacacacactcttttcaagactcttaaatagccctttttaaaacaacacaatctctctgttctgttctttatttcttcacacataactgccttggagcttttaatatattattgctatttcaatcccccatggtttttctacttattcaaaaagaaggtatttttcatctgaatagccattgacagcgaactctggtgacatcctcagtcttccttgacaatgggaggaggagttgtcaccaagaaacttgttactatcccaagtaacgagctagcatccctcagataatacaatagagatggactagtgtttttcaaacaatttaaaacacacacacttatgtacacagaaaaacacatgtatacacgtacacgcacacacaaacacacacactttaaaacaccctctttttctttagtcacctgaagagtcgtaaagcataactgcaaactgataaaggtataaattaaatcatataatagatgttgttgcaaatcgtacatgtctgtcagatcaccgagatagaagtcaaaacatgaaaagaccaggaaatacccacaaaagaagatgtaattgatgagactattcaagatcttttattttttccttcttttgctagtggaaaatttttattctgcacttttctggcggagggtggtattttgttttctktaagatamaaacaaaagacagttgtgtaaaattaagttatgagaacaacatagaactgtttcttgaagcattccaaagataagtttttgctaattaattaacaaattcaagctggttaaataaaaccttcttccaacacctcctatttaattgcagtttggcaccaacaaatatatatcaaaattatagtatttcccctgacaggaagctccttccttccacacactattatggctctctgcagagtaagccagaattgctgacaaccttgaacactgctacaacaatattactatacttggcagagaagtacccttgcggcaagagaaaagctgtaattttgactgtcacttcacattacactagatattatttcactgtatacacatacacacactcacaaactcttaatagactacagttttcgcactgcctgcctttccaatataaatggcaatataataccagcaaaccgccaatgagatcctggagagaaacaaatgtttggcattatggaaacatcatcagaggatgcattttaagggatatttcattgctttgtcccccactcacaccgttcacaccccatcatcaacttcataagatcatcaccttggttatcaaaaagaaattcactttttttaaccccatggtgggccaagtcagcattaacaaattccatgttyaaaaatttccayggtgttagcaaaggttgtgctatgaytcgtaatattttggacattcttcaaatctgatgcctgttatgtaaaatttccagatttcaaaatgtatcctttttcctgcatttatctcgctttccttcacacccggggggartytgttaaactgcagtgaccactggchgagtcccaagccaagccaaaccgtgcaaacatgaaacggccccacaaatcatgcaaaccctacacgctgtccctgccagagagcagcgcctgtctttgcagagaactaaatgcaacatatgcttccttcttaccaagctcacactgaagcagattgggccaggttccccactgtgccctcccccaccccctgcccagctttgatttacaagatgctatgttaatattccctctatttgtcccaggcaaggaattctgtgatgtcggtatgagctccaaattgagaactccctggaatccggagcacaggtcagaaggatgaatacacagagggagaaaactgcaacttccctcaaggagagaatgctagaaatggcaatgggcaggaaagaaaggatcctkacatcattttatagagagtcgttcatcccttacacaaacctggccaaaaatctacagaatgctgaggaaacacggctattcaacaagaaaatcggagcttctctctctacttaatctctgccatccccctttttttcctcccctttcaaattgctacttcaaacgatttaaataagatttaaacttgttttactgaatcaaggaaaagcaacagcaaactctttgccctctgttaagagaatgtatccaaaacttcaccgggtctgctgaccacaccgaatttaacaaggttcgcaaatgaactagagtaagtttcccacagtgacacattaataataagttccttatcccatccatcccaagccatgaatatgtwatgttataaaatgagtccttttcacacaacggaatctcagacgtgaataaataaaaactatccatcacaagcctgtgaaaaattaatgagagttcggagatgcaaagaaaaatggggacaaggagagatggcccagttcataaaagcctccctaaaactttcagacaktaaatatcctagcccccgtccctcaccaaattgccaggtgtgggtggaaagcaacagattttatttttaatgggctaaaattttacartcttaaagcacaattcatgcaagcaactgagagatcacagctacaaacactggacttkctattttctccatgcgatcccaatttcagctgcagagccagagtttatttctttaattattcataattcataaccaacctacttccagaaggatttgaggttgctcacagcagttatgagaaaagggagaagagtggggctcgcgcagggctcaaacatcaggagactggaaaaactctgctttgtgcattkttccttgacatcgctgtggacacacagtgcctgattaaattgtatgtgtcgcttgggttataattattatcattgycaaaaccacttgctggatgctcactctctgcccagcattacactagtgctatgccctgcataaactctgattctcaccctctatgaccccatttgacaaacagggaaactgaggctgggaggagctaactaacctaccccaagtctaagagctggtgagagtaagagccaaaggaaggaggttagccagctccaaatcacctgtgcttcccacctggggccactcactaccactcatgagttaaggtgtatgaaaacggctttggtaacctccttcttgccatcatgaaactgcagcacgctaatactgtcagwctgtctcagaaacccctgccagccagaaggcttaactttgagatgaatgcaaagcagaatgaagcccaggaactytgggggtctgggctaaggctgatgctgggcagcagattagaggcagagcagagcccagaagtccagcctcccctcccagtgcactcctcgacaagaggctgcacttcctcgtcggaaggactccaggtcccactttgggaccagacatgctgcaaaaacaaagaaattcacccaaactggtttgccctttactggattttttctgagactgaaagtgttgccttaagggacaaataccaaaaggaagatttaaaaatggaccaatggggacaatctgcttaatctggcccaacctcctccctcctcccttctccaccatccattccatgtgggcagaacacgtgactcatgggattactgggagcctgccatgctgttctgttttcaactcactacttttgtctgygctattctttcattcaggataccgccccaacctctccacctggctaaatcactcatcctttgagatgcagaagccaaagagatcctcagcacatacctccagaaagccagttactgcaggggatgcgtacggaccagccaggtaatgtcaatttggaaagcgggccaggtataaattaataggggctggttggtgtgagctgacccggtgggcacaagccccatcatccaactggggcggccaccgtacagggtgagtcaagggctgcgcccgggaaatgtgggagcaaaggtgccagaccttccagttttttaagagaaaccaagaatccaggtttttatgcgaactttaaaaaaagrggatgtgggggtgggggcagcaaacacatgcctgcaggctgaattcaccacccccctccacgttttagatcttataattacatcttctctttaggatccttaaagcataaaggcaagagccaagtctcagtaaactctgcatgggccacagctcggaaaagaaaaaaacctgttatatcrtgggagctcagtgcttgctgaactgaactgattcacatcatgacttgggattcatgaaccagaagcacaggaaattaataaaaactgaaaacgagccaaagagaagggaaaggctctctyaccactgttgagaatgttatgtttaatccctgcaagcagtagagactcagtgtacttccatgaagtgctgcttgggcattcatgaggcattaagggagaaagaatttttaaaatctttgtcttctcaaaagggaataccacgatggggccatgtctagagcaaggtgtctaaggtgattctagggccctcgcccaagaaacgaaagcagcattgaacatgtccaggaaggatgtgaagcctgaagccaatgcagaagacaaagctagataacccctgtctctaagacatagggacttagaactcttaccctgatgagcaacattgaacattggatgtgttcaccagaatggaaggagacacactcctgccgaaatcatgaagggcaaactgacccagaaaagggacaggtcaaggaaggtattacctctgcatagttctaggtgtcctgcttaactcattcaggaatttcrggccagagggatatycaacaggaattctaamctgaagagtttagaaaccagtaggagaatcaggatgaattcagaaattactataatatgcattttcaagtgataaatcccatcaaaaacagaaaaagtgcttgaagaactggaaggaacagtgatcattcttgtcagatggaatcttaaaatccagtgggtttcaaaggatgagcaggagctggacatgaagggattggaggatggggactggaaatggggagttcattgcaatcagaaggaagagcaagaaaggaacaaaaagcaagcagtgtttggggagaccaggatgtgattccagtttggccaaaatatagggtatactgggagaatctattgaggttttgggagtgtatttgtttgtagtttgaaaacacctaagcaattttgaagagaagcagactctttaagtcagatgctgggttctccagtccaaatatgccaatataattgtgtctggtcaatgtctatcctgtccatccctcctgagtgccagatctaaatccaggtgccaatggatgacttccacttgggtgccccacaggcgtcatgaattcagtatgactgaaaaggactcctcctatcttcagcgatggttccactacacaatacactgkccaagccagaagtcccaaactagccttctgtccttccttctccattcaccacgcctgtcatccccttcagagctgttggccaaatcttgttgattttaccaagtatctatcaaaatgtttcctcttcctccctgtactcactgcaatcacttttgctcaagggctcatcatttcgtgcctgggtgactagagttgtttcccagcaggtctccccaccctcctttctcacatggctgccagaacggtcttctgaaaggcaaatctgaccattcgacaactctgctctaaattcctcctatggatccccatggcttggatttaataaatgtttattgagtgaatgagttctctgcatacatgttgttctctgcctggtaccgtggaggtcaggctcgcacagaagcatacttatggtcagagttagtcaataaaaaaagtgatctattctgagttccataccaccccaaaacactgatcagcttsgggaaacttagaaagttcaaccacctggggataaagtttggamaactaggctagggccaattcagggtmcaggtggaggctaggaagtttggcataggatatcattaaaggtcttctaaggatgaaggcaattggagctacactataggaaggcacagcaggcggagaacagacttgagaaggatttgggaggtgaagaaacagctaaaagactctatctctgacaaagatataatgcccagaattagaagagtggaaatgaaggaatgatgaatgaaagagattatcaagaagaaacaaacaaacaaataaacaaacaaaaatccctgtaatcagtaaccatctattattatgtcccagattttggaaatgagaccctaatgacaagcactcctaaaccttcaacatagctgctgttaaggatgttgtcttgtgggggtgaaaggcagaccaaaatgatactaccaccctactcctyaccgatgagtcctttctgattttaagcaaatggcatacagtgtggtgaattaaaaacagcattatcctgatyttattactagtatcattactattagcattattgctactgctgttataggtaaaaatgggaaygttgtgaacatttcccattgcctatccaaggtgcttggtactttacatgatatctcacttaatcatcagaaagtttggagttattctataggtaatgagggagatgctattattacctgctgtggtggaataaagatggctgcaaattctttgtcacttctaccagaagaaagtgaggtgtatgtctgctccccttgaatctgagtgggttttgtaactgcttagtccacagcagtcatgctgtgccaacccctaagccaggccataagaaactggcagcttcctgttactttcttttggaatcctctgggagccctgagccaccatgtaagaaatctgatggccctatatctgccatgcaggaaaggccatgtgtagggctctgggyaagagtccctcagctgagccaagcatcccagtcatcctcgtgaaagtgccagacccatgggtgaccatcctggaccagctgaagtgccagtccaattcatcctccagcatagcaccactgactgaccccagtcaacaccacaaggggcagaagagtcactccactgagcccyaacttasagaaatcacaagataaaacaaaatggttgttgttttaagcctctaagttttggggtaatgtattatgcggctatacataaattggaacatccacgttttacagatgagctacttgttactccaaaagtttggctgacttatctgtagtctcctggctgatgaggtgtgcagcctggattagaacctccatctgcctgacctggctgcacacaatgcttgttaagttatcccggaaaacrtaaggccatacaggtgtggcagactaattaaattcaccatgctctttgggctgtgtgactgctaccaaaatgtcctaccctacctcacatattcccttgttaggtagagaaggctggacgatgctacaactgcttctccgccaggcctcccaacgccctcgctgggcagagtcccatgtgactgttttcactgctagaaaaattaacttgcataatgaccaggaagtaaagataaactcaaggatgagagaaaacctcccacctcagaggctccacctcactggggtgaacaagcactgaccttctatcatcctataaggaaaacaagaagaagagatgyttacttgaattactacataggctccctgcctacatccacatcttgaaaattctgagctgtgaagctctygtggttggctcctgggaacttgagattcccagtgatattccaatgctgaaacagsccagcaaggtgatgcaggtaagcacgcttgtaggatgtaacaatgtgaaacctcagcacaytgtggttatgtttcaaagcacgaggtgacggaagcaagagcgagtttacatgggcttgtgatttcctttgacaagatacacgcactcattccttcaacctaagcaaaatttccaggactacaacagatttgaaactcaggtggacgaaaaaaaccatctgtgaatgggataacatacgaaatcatcaaaggtaattgttttaaaaacgtgactcaagatggcacagaacagcgtccacagatgtattcttggttacttaaaaacacaatttaaagtaattagcttaatgttgatgtaattctaragatcgataaataaacctaaaaatcttaatttgatattgaatcgccccaaattaaacaacatattttcaaaccactaaatattgattcatttgtaagatgaggcctttcaatgcaactatttgacctgaacgcaaacaggaaagggttgacacattttctctgtgaagggccagatagttaagtaccttcatcttcgggccacgtatcgtctctggcacacagccttctttggattttttgttcatttttgttttttttaacgggtcataaataaaaggctactggctggagttagcctttgggccataattggttcattcctaccttttcataatctcagttattgatcaggtgatttttcaaactgtgaagggtctacacgttcamcctcttccttgtaagttaatgagttagctaccaagttttgaggaagctagcagaaaacaggagacccaggatcagatayagaggacttcgttactcatggcasagcaaacagcatgagctttatttctgcactgattcccattgccctggcccctagtcmcacagggaggatgtggaacagcccggtagatgccgtgctcatrgtacgtttcagtcatggctgargagccccaagcttasaaaccccaacctttatcaagcaaatctgccaaaccgttgtcctggaaggaggcactgtctttattatactggaaagaaagccatcctgtcctctgctcctgagggagacactatctgtaccttgcaagtttctttgctagacaacgttccttggaaagatggcctgaaaccaaagctgccagcacttctgttcccaagacatgtgaaaacacaagagacccgaggatcactgtgtccaaccaatgacagctaggagaaaatgcaaaaactagcattaccttaatcacaggggtctttttctatgaaccaatcaagcagatttatgtatttttttcagtgccgtaaaaaaaatttgatgattttgaggcttaacatcaaataccagtgagatcamaagttagatatgacatcatacacatcatttctgctgaaaaagtayctttagttaaaaacagaaaccaatttgtaaatgtgaattaaatgcatactccacaaaaaaatacctggtgaaagtaaaaaaaaaaaaaaaaaaaaaaaaacttccttatgtatagatatgtttcctgacagatgtaaatgaaaactaatacggtgacatttttcaaattagccactggaaaactgtgtgtgtgtgttttcaaacagccygagcaattttcagttatgtcggcctcggaaagtatttatgaaaaggataataaataattaattctactggccagaagctgcaactcctttctgcttcgacaatatacattgaaatgctgtttaaattagaggagcaaattgattcaaaaggcttccattagtgagctggcaaacaggtttgaagttggctaataaattttagataaagatagagcttttgatgaggatggcaatgccggactgctgatctccgagtcaccagtttgttaaatcggtggctgaagtcttgatttcgctccctgtgtcataactcactgtgttaaacaatatgtcacagggcagcacgagcacagtcaaaccagaatggctgctgcaggagccatcagcatgactgtgtggcagctgctcacagagcagggactaacatgggaaccagrctagcttttgcgtccctttctgagtctccagtctatccgggtttgcagaacattaatcaaggttaattaggcccacctgtgacataaaaatttctacctatgctatgtcttgcagcataaagtcacgtctgacatatctattaagaaagattcttaatcaaaatcaagaaactacgcatgaagctcttaattccacttggatatacatactttagctggcttcaagctgctcctctgggttgtggaatattacayagctctgtaaaggaatgatttaaagctgtacatactagcctgaaagggcacacactgtacactacctggggatggtggagtatgtgtccacttatttcagaaaatgagaacaaaatcttatatatgtgtacatctatattaacatgaaggaggatgtacaagaagtacaaaatactaatcatggttgcctcagagggatagaattagatgaaggaatagaaaggstttttttaatgcctcctttagacagctctataattttaaaaaattattcaaataatgtataataatgttcttttataattaaaaaaatctaaaaccaagaaataaacaacatgaaggcttatgtgacttgcagaaaattataaaatggggaagtcatttatttgcttagcttatttctacctggccagtttggggaagcctgtggagaactgatcaatctgtctttctgtccatccactcttccacgtatttaaccaagaaaccagacctaggaaatggtgggtgaagagtaaacagctttagaatccaccaggcctggagagaaattctgcctctacccacttgcaacctatgcagctttggaccatgctctcgatgtcttccaaraataaaataattgtaagagctacagcaaatgcaggtagtgactctacaatttcatccacaaaggttagctcttttcctgtgcacaccaggatctcagtatggctaccctgagcagaataatctacacttggccaagatggcaacccaggatgataaaagcaaaacacattgcagagatctgattattaaggaattcaaatttacactttctcaaatttgtactacttaccaatggggaaaaatagaatgctactttttttttaaggaatactatattttcccttttatttgtagccacttttcaaatggagcctttgtgaagtacttccagccttggtcccaccatgggaaaggtggaattcatagaggaaaatcgtggagcaagccagacacggcggctcacgcctgtaatcctagcactttgggatgacaaggcaggcagatcgcttgagtcaaggggttcgagatgagcctgggcaacatggcaaaaccctgtctctactaaaagtacaaaaacttagccaggcgtgggggcacgcacctatagtcccagctactcaggaggctgaggtgggaggatcacttgagcctggaaagtcaaggctgcagtgacttgagattgcaccatggcactcctgggaggctgaagaaggagaatcacttgaacccggcaggcagagatgagcctgggcaatgagagtgagaccctgcctcacaatcaatcaatcaatcaatcaatcaatcaggtggaacagatactatccctcactacaagtggacaagtggatctgaagcagtgtagggagcaggatgaggacctcacaggcaggtctcttaaaagacagtgtcagatgtcctgcagctcatgtctcaggcttggtttccatgcctggatttcgctgccaaggactgagccttcctcaggggctcattcccctcgagtcctgggctgaccccagcaagagggaaggacagatacaatgcattccaatcagatggccttcctttaagaacactcatgaaagctactgacactttacactgactttcacattttaatagactacaaaataaaatatccaaattgtgcaaatgcagaaaatgaagcgaaaagtcagagtgattcatttttatttcttaattataaaacaagaaaacatgcaattaatatccgtgtgaccacattaagcactccacacataaatgaagcagaaagaacaactaaaaagtatttctcccctttcttagatacaaaaattacgtgtgtgtgggtacatgtgtgtatgtgtctatgtgtattagttcattttcacactgttgaaaaagacatacccaagacatggaagaaaaagagatttaattggacttacagttccacatggctgaggaggcctcagaatcatggcaggaggcaaaggcacttcttacatgctggtggcaagagaaaatgaggaagaagcaaaagcaaaaccctctgataaacccatcagatcttgtgagacttattcactatcatgagaatagcatgggaaagactggggcccatgattcagttacctcaccttgggtccctcccacaacacatgggaattctgggagatgcaattcaagttgagatttggatggggacacagccaaaccatatcactatgagagagagggggagagagggagacagagagagagagagagagagaatagaagaatagaacttgcatttatcaagcacttattacataggaggcgatgttggaagcgatgagtttagctaagttaacttggttcattccatacaacccaaggtagtggatactcattatttcttccatttgatgaggaatctgaggttgagaaaaataaaaaagctcacctacatccctacaggtagtcagcacagagccaagactagactcaagcaggctagttccagagagtcttatggtcaccctatgctatcctgccttcagagggaagggacaaataagaagaacaaaggcagacgtggagatgayagtaggggttgccaagctttctggaaaggagcagagagtattttaggctttatgggccatayagtctccatcccaactactcaactttgctggcatagtgcaaaagtagccacagatagcttataaatgaaggtgtgtaggrctgtgttccaataaaactacttcagatctctctggaayttcaataaaagtttttaaaatttagttatgaacactgaaatttgaatttcatacaatttttacatgtaataaaacattattctattggttttttcccccaaacaattacaaatgtaaaaaccattcttagctctcgggctgtacaaaaacatgacaggccacatctgaccttcaaaccacagtgtgtagacccttcatatcagagacagtttgatgcaggggaaattgtttcacctttagtgtgagacaggtctggtgttcagcccatgctctgcccctgtgaaagagctctgcaaccctgggcaagttcttcaacagctctacacctcaattcccacatctgtaaaatagggattaacacccacttcatcaatgtgttttgaggattaaatgaaactggatgtatattaggccaagcattgtactggatacaggatagacaatttattaaggagtctatttacttgacaaataacttactgagtcctgttctgtgctagaaactattttaggatgaagacacagctgtgaaaaaaaaaagctgatacaactttgtgccctcatggagctgacaaaaaaagatattcgtgttttttgttgtttttttttttttgacatggagtttcgctcttgttgcccaggctggagtgcaacrgcacaatctcagctgactgcaacctccgcctcccagactcaagcaattctcctgcctcagcctcccaagtagctgggattacaggcatgcaccaccaygcccggctaattttgtatttttagtagagacggggtttctccatgttggtcaggctggtctcgaactcctgacctcatgatccacctgcctcagcctcccaaagtgctgggattacaggcgtgtgccaccacgcctgcccgttccaagatatttctaaatatgaaagcaacccaacttttcatcatgattcttagtccatccaggctgctataacaacatacattcaacagaaattaatttcttggctgggtgaggtggcttatgcctgtaattccagcattttgggaggccaaggtgggcctcagggtcaggagttcaagaccagcctggcctacatgatgaaaccccgtttctaccaaaaatacaaaaattagctaggcatggtgccatgcacctgtaatcccagcaacttgggaggctgaagaaggagaatcacttgaacccggcaggcagaggttggagtgagctgagatcgtgccactgcactccaacctggacgacggagtgagatttctgtctgaaaaaaaaaaaaaaaagaaagaaagaaagaaagggaagggaagggaggggaggggaggaaaggnnnnnnnnnnnnnnnnnnnnnnnnnnnnnnnnnnnnnnnnnnnnngaggggaggggaaaaagaaaaagaaaggaaaggagaaaaagaaaaagaaaggaaagaaacaaagatactgactgatttcttacagttctagaggctgggaagtccaagatcatggcaccagcagatctggcgtctaatgagggctccatctctacttcctgtatgtgctttcttgctgtgtcctcacatggcagaaggcagcaaacaagttcccatgcgcccgttttgtgaatgtaggggttatcaacaaacattgcagccataccacatgtatagaccctgcccgttgaagaatgagtcaagaaattgggtgggtgttctgtcatcgatcaactcttgcttatcacccctctgcagtgctgcaagtaggaatctcatatacgtgatggaagtgatttgtgctttcagctgagagtagcactgtatccattccaaagyttcagttagcctcagtccctgatgatctgcaggaatttctccttctctcttaaaaaagaaggaacatgatatgccacttscaagattaggatattytgtttaaaaagaggggataatttaagcagggctggcggtgggrgcggggagacaatggaaaaggctgacatctcctgagcatggctcaagaaggcataattcttccgcatgtataagaataaaacctcttaactcatctcccaacacactgatgtggtggcccaaagtaggctttcaggacagtcaccaggagaaatgttatcttgtgggctataactcaccttctcccaagtgggtccctggggccctctgtggtgatgagcaaattcatgccaaatgtcacttcgtaatgaccaagactcaagaagtgatcaccgttacaatattcagatacacttagggcaggtggccagaaacaaaccatccagagataaatgaacattttgcgctccacagcaaaaaamaaaaaaaaaaaaaaaaaaaaagatttcacagccaaacacatatttctttgttgcattaagggaaaagtcgtgagatggcaagcaggctgtatttttaaaggatgaaatacagcaaggctgcttccacactggccagcctgagaagcacactggtgaatccatcccaaggcagagacttctagagcctgagagttggcttcattggaggcaggtgtactggggaaaactgatatcctttctacttactccaggtaagtggcagataaatctctgggaagttctggctcaggcattcttctcatcagtaattacaaacctaaaaattacgatctacatttgagtggaacaaaatggactggtggcacttctttctttyctttctctctctctctctctgttgacagccccatcacaaagtctctgcaaagctatgataacctcacggtaagtaacaaatcaactgcagccagcaagggttgattaagaggcgtttcatcactgcatggtgttaatgagcatttgctgttcttacctgtcctgcacttatatccccttctccccattcacctttgggcaacccctcttctctgtgcacttcaggggagccggaccccacatcctgaattaaggggtgagcacatggccctggatggaccaatcggagatggcctcatgactcaggtctgtccaatatgcatgaagccctgggcactgattggaactttgaggaaagagaatcactgttgtcctggtcttgctgagaggacacagtgtatttatttctttgagaggaagtctcgctctgaagtgcagaggtgcaatcttggctcactgcaacctccatctcctgggttcaagtgattctcctgcctcagcctctcgagtagctgagattacaggcacgcaccatgtttcccccagcttctggcttgctacactrtggaatggaagacggatgcccaagaagaccaatgtaaggaaagcagagccaagggatggagacagagcatgccctgaaaaaataaggcaagcccatgagagttgagcagggctaaaaactgttttgtctctccttgttgtttgatagtgtttcaaagccctcagggaatgctgcaaatagcttctcaggctatgagaatttcagctcctacttttatgatcaacagagtaagggcatctaagaatgactttttctcaggctgtcacctccccacagcccagatgggcctatatttaaagatccgagtcttagcagtccaggggctatctgtcatcacagaccatctgtgggaccttaggtagggcaggtctgtaagtctaaatatcccctcctcctgagttcctgtcctgtcccctttgcctgaccttctccaactgttctcattagattatacttcatgsaaaggggcatatatgccttatatgctggatggtaagctggggacaggggcctgtcatctctggtgtccacaggaagtcaactgaatggctgcatctgcccccattatcatctctgaaacctcagcataaggactagggtttgccatatagctggttctgaataaaatttactgaataaataaattaataaagagattgctccaaacagactgaaggtcccttgagagcaaatgtagacttctgtaaatctgatcttctaamaggaagatcagaatagcagaatactttrtatctaccagagattctctgtatctaacagaatgctctstatctaacagagatacactgtatctaacagagaccgaaatatatttgttgaatgaagacagatgccccattagcagtaaaaagtaattttaaatccacttacaaccaactggtactatttgtaattcaccctggataggaggatgtatatttccctctttccttcttttttttttttttttttttttttttttgacagagtttcattcactctttttgcccaggctggagcagagcgcaatggcatgctctcaactcactgcaacctccgcttcccaggttcaagcgattctttcttgctttcttaaagccctactcagatataatgaggccttggcctgtactaggtcttscaatttgcattattgatctaaaatttaacttacacagkcaatttcttaatgcaagttatcagaattggtggagaaaaatgtgaattacaactgtgattcgagaacccaccacattataastatatatatatatatatatatatatatatatatatatatatatacatagatagatagatagacagacacacacacacacatggcaaatgggcccacatacaacatgttttaraaattgtgatattgcaagtggagcctcaagctgagatctgagattgttcttccatagtctccctgattcccaaacacgtagttgcaatcagactttttttcctaaggttaaaaggacaaatgcttgcaggtatatatgcaaaaatacatacacagtcaatcacagatgaaatacaaaactaaaaaaaaatctgcagaagagaaatggaatttgagtggctttctttttagtcttttctttttatacagctatgataccttttacaaaatatttatttatttatttatttatttatttatttatttttagagacagggtcttgctctgtcgcctaggctagaatgcagtggtgcaatcatagcttaccatacattaaaagtatcctcttacctaattttatatgtatgtatgtatgtatgtatgtatgtatstatgtatgtatctatctatctaccttaccayacattaaaatcttacatttctacacgtgcaggactagaatgaacacacataaagcatgataccaatctgcttttttggccaccatataaacattctatgctaaaatgtcaagttgtttcattttacttaaaaaatgtgaatgtgaaatgatttaaacattcaaaaaaaaacttcgaatatcaataatttcacttaaagcttcacatcatatttgattaaaaccaaatatttatgaatcaataaaaatttcatactttcattattacttgtaatttatatttaaattttaatcaataacttttttttttttttttttttgagatggagtcttactctgtttcccaagctggagtgcagtggtgtgatctcgrctcactgcaacctccacctcccgggttcgagtgattctcctgcctcagcctccccaatagctgggattacaggcacgccaccacacccagctaatttttgtatgtttgstacagayggggtttcaccatgttgcccaggctaggttcaaactcctgacctcaagtgatccacctgcctcagcctcccaaagggcagagataactaatttttttttttagatggagtatagctttgtcacccaggctggagtgcagtggtgcaatctcggctcactgcaacctccacctcccaggttcaagtgattctcctgcctcagcctcccaagtaggtgrgattacaggcacctgccaccatgcccagctaatttcttttgtatttttagtggagacagggttttaccatgttggccaggctggtctcaaactcctggcctcaagtgatctgcccgccttggcctcccaaagtgctgggattacaggcctgagcctgtaatgtaaatgagccttacatttttgtgaatttatctggcttcgatctttcaggctgctgacctttggatggggtctttgtgggaacttgtttgttagtgatgttgttgttttctgtttgtttctcttttaacaatcaggcccctcttcccagtaacactgctgtagtttgctgggggtctactccagaccctgttcacctgggtccctcccacaccaggaggtgtcacctgtggaggctgcagcacagyaaggatggctgccygctccttcctctgggagtctctgtcctcaagaggcatcgagctgattccagcagaaacgctcctgtgtaagttctctggcaacscctgctgggaggtctcacccagtcagaaggcacgggatctaggattcatttaacgaagcacttagtttacatttctgtaaactgcataggattttatcctatgcagtttagatcatcataaaataactcaattgttaaatattttaagttttttaaaagtctataaataatataagcataaacatcactgtacataaatttgtggatatatctttaaatattcctttacaatatttttctagatatgaaattcctaggtaaaaaaaaagtttataaaacttttgatagagatctccaaattatatctcagaactatgaaaatcaattgttcttcccatccacagtatattagaatgcccacttctatacttctcaaccttgtgtattaatagtttaaacctaagttaattttacatttataaaaatggggtcgaacatggtggctcatgcctgtaatcccagcactttgsgaagccaaggtgggtggatcacttgagcccaggagttcaaaaccagcctggccaacatggtgaaactccatctctacaaaaattagctgggcatagtggcgtgtgcctgtagtcccagctagtcggcagactgaggcaggagaattgcttgaacccgggaggcagaggttgcaktcagccgagattgtgccactgcactccaacctgggtgacagagcaagactctgtctcaaaaataaatataaataaaaataaaatggaatacagtctctcttctaaattgtgtcttctctgctaataactttaaacatttttcaaatatcccttggtcttttgtatcactttttagagttttgccaattgtcccattatttgtttgttttatttgagcttggtgatttgaaagagctgyttacttattaagcagatgaactatatgaacagacagttttttaaaactctatttctamctcaaacacatacttacagaactaattcaaaatggtgcttcttttattaacgtggtgctaaattactttatgagttcttaaagattcttatttttggcacgtctgaggtaaggaatgagaagttctctgtttccatatgcgagcactagtaacactgtttgcaggccaaacacatgtttaaagcaggcagggaagtgaactctgtaaagtggagatttgtggagtgtgataatgaggcaagtcgttatgttctaactggtcttaactgttccataaatgtttcttttaccctgtaaactttaaggtcaagataatatgaggagtacttaaagtaaagaaaagccatgtgggccttggctagggaatatgcccttttttttttttttttttttttttggagggaggaatctggaatactctttaactgtygaacgaacacataaaagtacattttcttctctatcatttttgccaaactcagaataaaaacaactgggctgcatcattcaccttctaggctgttcctaggaattccatggaactgtcaaggcctccaaaagggtttgttttgttttttaaagcagagccctggcagacacaccataaacttagcacagattacccctcgtagcatccgagtggkaatctagttttccaaaggaaaagatcatcgctgaaggcattttagttttcacaccaatgcaatatgttaataccaaaaaagaacatgttggcattaaatcttccagtgaaactacattcagtgtatatagcctatttttaaatccctttttagtcccaccaaacggagagcaaacaatatacggtagaatttgctggtacgttaaataaacagtggaatttttttgttattaatgctatgatatgnnnnnnnnnnnnnnnnnnnnnnnnnnnnnnnnnnnnnnnnnnnnnntgatttttaaatcttccttcaaacttcattaggaaatgtgcaattaatggagccatgtctccgaaataaaatatttttaattatagggagaatattttaataaatgagcagctcagaagtcataattgtcacacaattaacagattttcctacatcatacttacatacagtatgagctgcatttaaatatagttgtttttctgggaaacaaagtttgtgagattttatatatatagtctctgatgttttttaggagaaataaaaaaatattggaaacatactcagttcctgtttctagaaagaaaagaaaatcctatgcaagagagtggctatttgtcccacgtcacataaatgagatagtaccagaatctaagtcttagaaggctaagagttttgaaagttatcaaatcacttttccattcaaagcagcagagcatgagtgataatcgtttcaaatccttccaaaagaataaagaatctgggatctaatttttcttttttttaagcctcccaatgcagaaggaatggagatggaaaaaaccgctgcggtagacatcagattccattccttggttttaattgcgtggttgcagtggggaatgaggagagtaaacagcagtgcctcccacggagctccctgcaggttctccttgtaggagtgagattttgctggtgatttatattgtttgagasatacccaaagagtcttgtgtcactcaatccccagctccatccctggctcggaggagcctgcaccgcctcacgggagcctgtaactgtcaaatggcattccccgaatccatcaatactgtttgctgccaaataaataccctgctgctctacaggttgcaaatatttcaatcattgtgcagatctgcacaaacttggaaagaaaactcatgcaatctcawggccttatttccccttcctacataagagaaacatacatgcctaaaccttcactttccaaatgtttactagaagattagaaaaacaacagatgacaggcaatgtgtcagcctagaagaatcacaaaaatccttctttaaacaatctagtagccagatgaagaccccacgccacgagcctgtatgtggttaagaagttcatggggcgaccccattccttctgattgctgcgaaatgtaaaagacacggcctcaagtccaaagcctaatgtgccattaagagtagactgccttggcctcacctgaagcaaatgcatctagacctgtctgactctttgactcacagtgcaggagattagggattccctgtatggttgttcagtctgtacactgaacaactcagttggtcaacatttacatagactacgaaatgatagagacttctacaggtatgcaatcacagatgacagcttgtgtgattctaaaggggggcgtctgaggcaatctactaccattcaccaatgttctgctctactctctgttcatgtttctgtacatcaaccattcattcagtcattcaacaagtattcactaaatgcaaatgaaatgtcagtctcatccaatccttcaaccaccttatwtggcagacactattcttcccattagtcccatttagcaaaggacagtttgctaatgaccctctcctggcctcagttaattgaggccaggagagggtcattacattgcctasgagggtcacaaagctctgtcctccaagtctgagtccagtacatttctctcctggactgagctacccagtttattggagcaaaaatttcctttctcaccaatgaatttaagagtcaagttctcaagagaagctggaaggtagggtcagagagattacagtgagaagtgaagcggtagaggccagtaggtttagaaaccagtgctgtgggctgacagggrgtgacaatttccagctttggttctcctcatttaggagagacatgaagtctcatggtgtggtagacaggccacacaagactggaagtctgaagtgtgctcacttcatggagtaaatgtgtagccttgaatgagttacttttttttttttttttttttttttgagatggagtcttgctctgtcgcccaggatggagtacaatggtgcagtctaggctcactgcaacctctgcctcccrggttcgagtgattctcctgcctcagcctcctgagcagctgggactacaggyacatgccaccatgcccgastaatttatgtatttttaatasagatggggtttcaccatgttggccaggctggtctcaaaccccttascttgtgatccacctacctcagcctctcaaagtgctgagattatgagattacaggcgcgagccactgtgcctggtcgtgatttactcctttctttgaactttaagttcttcatcaataaaatgagaataataagacctcataaagctactgggaggagtacatggatttataagaactagaaaaatgtctggctattgtggatgttcaataaatgatgggtattattattattgactgttcttgggatgtgttctacttgggtgtgtctctggcatctcaagtgtacgtattttcctaagtggggtgtgtgtgtgaaggaagaagatgcccttcttttgtgcctcgccttccccaaaagacatcaggagagtaaacatgccccctatagtgccaagagagaaaaatgtaaattcttttggataaattagcttttgcagctacctctctctttgctatgayttctgtttctcctctgcttaagcaacaaagagagaagtaaccgcaaacgctaatttatccagcggaatttacatttctctttctcggcaatatagtttcttagtgtcttccamgtttttaaatcctttaggtttattcattatgttcctttttcctgcttctaaaaggtagctgttcttgcccactgttttggaagtaagaaaacctaggagctgttctgtaagctcataaacatagtgtgccagaaactgactagaaggacagcagggggacgggggatctgaatgtgccaagacagttatacccttatgggttatggcaaacattaaatggtctagaaaatcagaggccttggaaaagacttgtaaaaataacaatgtgagaacttagcataaaggccaggaacatgaaaggggaagccatgggtggcacatgttggaaactgtgctggaaacacatcctgaactgctcttgcaaagtgaggcctcttaagcagttcctgcaatcctcctcccagccctccataccaggcagaccaagatgtgctcccagcctctgggcagacagtgggttttcaacaaccctgactggggctgaggtatgagaggtgcatatcagagccccaagagggctcttagaaagggaagttggccagatgtggtggttcacacctgtaatccgagcactttgggaagatgaggcaggcagatcgcttgaacttgcgagttcgagaccagcctgggcaacagagtgaaaccccatctctaccaaaaaatataaaaattagccaggcatggtggcagtggcatgcacccgggtgctcaggaggctgtggtcccagctacttgggaggctgaggtgggaggatcacttgagcctgggaggtagaggttgcagtgagctgagattgctccattgcatactagcctgggccacagagtgagggccctgtgtcaaacaaaaaaaaaaaaaaaaaaccaagaaagaaaagaaaaagaaaagtgatggaacagaggtggtgaacctctaagcaaaaagataacatggattttctggggtggggtggggtggggattaatgatcaagagaagaattcagctgggtgtggtggctcacacctgtaatcccaacattttgggaggccgaggtgggaggattgcttgagcccaggagttcgagactagccctggcaacataatgagacctgccctccaaccctgccaccaatctctacaaatagtttcaaaaaaaatttagccgagcttggtggtgaatacctgtagtcccacctaccaggcaggaggatcgcttgagcctgggaggttaagactgcagtgagccatgatcacgccactgcactctagcctgagtgacagaacaactcattgtctcaraaaaaaaaaagaagaattcttcacgaaagacattaaaaaagaccatcacacagagacctctcaaaagttatgctagctaagccactacaccagattttctgagtaagcagctatgcgatgagcttcccggttgcactcaatttgtaaggcaaaatgaaatgcctgttgagttgtaccaggggaatgcgaggctggaggtgggaagtgtatgccgaaagcatgtacgtaagcttaccaccttacatttttctttcccaagtcaccaggacatagctcctacaattaatctcttgggttttatttagtaaattccattttagttgaaagtcatgttgtttatgctgctctaagactctttaaaactaaattgaaggtttatgttagtaaagttaaatatcttatttctaatatcctaaatatatttacgatatctttggaacacccatttgaatcaaccattaaaccaatactgtttgaacaggtttgtgaaatcatggcattcatgggtcatgagaagacggtcaaagcacaaaagtgtgacacttctgcagatactggaacacagtgatgacttccatcatccagttctgccacttactaacccagtgatcttgagcagggtacctaactcctttgcacctcagtttcagctataaagcgaacatcataataatgtctattcacagggtttctgtaaaggctgaaagtcgaagcacatgcaaaacactttgtgcatggactggtaaaataagagttaatatgtattagatatggttataattattatcattactattattaataaattactggcttcagacatgctaagtgttatatgatggaaagagtacttataactttagaagcaggaccttaagtaaattacttaatccatctgaaccccaattccctctcttcagtgatatagggagaataccaaaaatctttcaaaaattaaaagacacaaggaagtagatgccaaattcatctttactttcttgcaaaacagagctggaaaatttgaacaattgttccgatctaaacagagggtatggtcccacatttataaagggcctacgtaaatagatgatattactgccactgtttgcgtttctatcagcccctatgctgaataatcaataatgaatgttgtttaaacaaatggtgtaattttgcaatcctgtgttgttcctaaaccgannnnnnnnnnnnnnnnnnnnctgtgttgttctaaaccgacctttactccttattgccatttgtaatgcatgcataattcaatgctgaagccgagggagaaataaggatgttggtctaagtggccctttttgggttgttttttgatgatttgctataatcctataaataatacaaagcttgtcactgtaaatatgtattgtgttatctagaggtatattcagtggctaaaacaataaaagctcrtctacgtctcctggcaatctcaaggcataattaatcgctggtaagatgtattctagaacgtgagagcccttaagtagaaggaaaaataaaggccattgtcaacacaaatgctaaaagaaatgcctaacgggcatagtcatttgccatctgggaaaagtgtttgctagtgtacttgtttggaaggcaagaaggatgattcaaaagggatttttgttcaggtggtgaagaagtgtgtgtgtctgtatgtatatacatacccacgtagtttttaataaattataaatcaagatgtttaccaagcyaacttgtcaattttaactcatttctgttatttgtttacacacacctccatctgacaaatatatacaaaacaatgtatgtgtatgcacatatacatacatatgattttttttaaataaagcataaatcaggaggtgctcagagctagcttctgtccattctaacccatctgctatttgttcacttgcacacactcactgtgcaataaaccctttcaatgtgggagacaagtgcaagatgcccctctttccccaaarggcacctctgtgtgctccctcagatcatagctgatgacatgtcaatgaaacggtgcttgctctcatcccagagatcaaaatgagggcttaacctgcaatttactttacaagtcccatgacacttgccagatctgaagacttcattctaatcttccctgttgaaaaaataatcaaatactccaacaaagatgtattgacaactcttaattaamcatgctaatggagggaagagatagcatggataaatgaaatccacacataacccaaaaccttccttccccattaatttccaacttcttgactaaaccttactgagataagtgggtggggagtagggagaggctgactaatcctttaacgatagaattacttgatgtctacatctgtactatgccaatcagctgttggacaaggtaacaagcaaggaagtggccaaggacaccatgtgttcccaaagcatcggggttcagcggtaatgtttttgaatcttctcgggtgtaagtaaatatatttcagacagcttttagaatgaagttagctagaagarttttgcagcaatagaagctgatttgatgtagaccttcaggtttcttatctatttattggtgctgctcagttggatgggaaagagaggagaagctgagagacgcctggcacctgtacagagtgaaacaggcaatgctgtgtaacgagcagttgacagcaatgaataagggttgcagaaatggcaaaagagggcaccaaattaaccaaagcctagggaagatgacgaagccagagtattcattaagggaccagatgaactagcatttattgagcaccttctgtttgccagggcatataagaacatactgtgatgaggcaccatgaaatacgacctttgaacagaaactgggtaaaaaacaaaagtaggcttcctcctcctcctaacagcatctagtgcagccacattagatgggaagagccagaactaggcaagttattccactccctgatcctcagctgcctcggttgccatctctgcacctgcagggtgaacacaccccaatagcggtaacgtaagcatacccttagaatgatcctgtgtgggagatgcacctgaatgtgtggtccgggctggggaatccaggagtgaccaacccagagatttgtcccttatatataacagacmtctgtgccccatgcctgtcccgtggaacacaggccaaacagrggattgaggtcctgagtttggagttaaatgaagaytgccaggtagaggttgttagggsgagggtgttaagtgaaggtgtgatataaaccacatgacatttgcaggtggttatggttttcctgcccagcccaccgccaccactggactgtagggaggtggatatcctgtccagcctactgccactggaccatttctgtatgtaaggtgggcagttgtactatccagcccgccatcactggactctctcccctatatgtaacctcctaataaaaccccatgtctatctgttggctctgagtgtcttcttcagctcttgaacctggtgcctttcctattgaggttaataggggttcagcatgacagcacctccacctcccatggcacagcatatgtacccrataagcagtccttacaataccaatagtttctatctgttgggcactgccaattagccaggcatgtcaaatggaagatctcacttaatcttgcmaaaaaaaaaatgttgttcgttgttgttccttctattacagaggaaaaaacaaaggcagatggaggttacattatttgcctaaagttacacagctagaaaggagcagagttaagaatcaaaccccggccatccagctccagaaccgagcttgtgaccctggcatgggtatttccggagctctcgctaatgtgccagatagacgttgtgctaaagaaatgatctgtgtgtgttttctcatttaatatccatacagccccctaaattggagattactactgttacacaaatgaggaaactgatcttggagagggccagtcagctgccaaggtcacagagccagggagtgggggtggcttgcccaaggccaggtctgtccctccaggtgaaggtaatgattaagwacacaggtctggagtgggtttgaatcactgtgtgttcagccgctcactggggacctggcctcagccctctgaytactgcagggctttattactttctgagttctctttgctatctcactcgccctttcctcccatttctccttctggtgccccttctccycttccaggcccccagcccccagcccccaccccacagccatctctgtattaaatgtttgtggaatgttcaccgttcaaaagccacgttctagtttgaggctttcaattcttgggaagaaaggggccatataaatacaaaaaatcaagtccgaaatgttgttgaaatgatcattttggtccacctaagtttatacaaaaacattttccatgctctgatctccccacttgcactsttgggtagcccaagttccagatgaacggccttctcacctgcatgctgaaaccagccgaggctgctgccacattaaaaactcagcccaggctgctcctgaaaatgtttctgccctcagagccacgtactaaaaattaaggggattaagggaactctagatttacatttaaaataaaggagaaactcattggagaggctaatgcggcgtgcactggaggtagctactatcactaagcattaagataaacaatacgagtggcattctggyccacgcctggcaaagtgcaggagtccctggaggaaaaggaatgagagtgcatcagcgacctcgtgaggcagtgcagctttgcattaatgcctgcagctctggaggcggacttcctgggttcacattcacaacacctccaccgccaccactccatgagcttgggaaagacatttaaccattccatgccttgtcatctataaaacggggcatgacgccagacacggtggctcacgcctgtaatctcagcactttgggaggtcgaggtgggaggatcacaaggtcaggagatcaagaccagtctggcctggtgaaactccatctctactaaaagtacaaaaaaattagctgggcatggtggcacgtgcctgtagtcccagctgctccggaggctgaggcaggagaatcacctgagcccaggaggtgaagcttgcagtgagccaagatcgtgccagcctggtgatggagcaagactctgcctcaaaaaaaaaaaaaaaaaaaaaggccggggggcataagtacttcctcagagggttgtcctgaggactgaatgatgtcatttaattcacattgatatggtttgaatctgtgtccccaccaaatttcgtgtcaaatttatttatttattttttgaaatggggtctcgctctgttacacaggctggagtacagtggtgcgatctcacctcactgcaacctccacctcccgggttcaagcaattctcctgcctcagcctcctgagtagctgtgactacaggtatgtgcygccacgcctggctacatttttgtattttagtagagatgagktttcaccgtattgtgcaggatggtctcaaacgactgagctcaagcaatccacctgcctcggcctcccaaagtgctgggattacagagtgtgccaccgcacccagccttcatgtccaaatgtaatccctaacgytggaggtggggcctggtggaaggtgattagatcatgcrgacagatttctcatgcatggtttagcacgtatgctgtgtggtgagttggctctcctgagatctggttgttgaaaagtgttttgcacctgcccccttgctccctctcttgctcctgtttgcaccaygtgagatgctttccttcccctttgccttccaccatgattgtaagtttcctgaggcctccccagaagccaagcagatgctagcakyatgcttcctgtacagcctgtggaactgtgagccaattaaaggtgtcttttaaataaattacccagtctcaggtatttctttatagcagtgcaagaatgaactaatacacacatagaggatrgagcactctgcccagctcatgccaacactccatcaatgttagtacttagcatcagcattatgttgcatagctgatgattcatatacacattactccctgcaatcaatgcccaagccttgcaagatatgtgcttcaatccccactttacagagggctatggatcgccaaggctccacctgcagttgggttctacataagtgtcctctttcctcacatcttcagtaaagtatgagacctccatcaatgcctgcttgggtgaggagcacaggtgggtgaaaggtaagggaacaagtggaactccatatccaaggtaggcacagtgtggaccagaagagcatccctaggacagtgaggtgatccacggactgacytgccccaaggccagagacgcaggagtggaaagtcacatggaaccatgagcttttataaggggcagggggcaggtgttgggaaattgcagaactagtgtttgagcagatgcaacagatccgaaggaaatagagattgcagttgaaatctgggtccaactggccctatcagctgcattcatgtgttacctccctggtcagctgtaccctccttcaggattaggactgcatccttaccaatgctgagtcctctgggatccccagaggcatcttttgcacccatggcaaaaaaaagaaaggtgggcagcagcaatgagaaccatgtccactaggtgcaagtaataacgggtgcattgttcgctaaggacttaaaagtattaataaaagtgaccaaagtttaactgctttttatcatcaccatgcttggygattccaaacaatgtcagtgaaaacagattcctcctgctggcaggggggcggccacacccatcacaccccctcttggcaccgccatgattttacacactgcactcaacaaatattctctgaagggctgaaaaaaagggggctggggaagggcagaaatcctgttgatttctgagcagcaaacacgtaaacataactgacattaagatatacaaaatacatctttcaaggaaagatgtgccattctttcttgtgtgaaataaaaacacctccccatgcaagattccaactgcacagactgatactgctatggtctgactggaaacaggacatcttgcattcttgtggctccgaaaatcactctggggtccaaggatttatttcctctctcgggagtcagggacagataataaatacccctcatcagctgatcaattgctcgcacttccaggcaagcacccakcactccccaccaaacacaccgccccacgccacctgaacraggttaaaagaayggactcatgactgatggtcggggggaactggcttcagaagaggaagttgaaaatattaagaaatcaacacgggcatttaaaagcaaagccttttccatgccacagaagacgttttgctattcatcttgttccctgactctgcttcaccaacttgatggaagatggtttaactgacataaaaaccagctatacatgaacagcrgtgattgatggaaccattccaaacatcagccaaaaatggcactgaaagatgccttgggcttcctgttaactgttttatgaggggaccaacaggtttcccccctcttctttaaagaatatattagcagtacaagtactttcaaaaacagggtagtgttataccaagagagaaacagaaggggaaaaaaaaggtaggaggtcttttgcatgttagtatatgtatgaagggagttaggacctggcaaactgggttatatgaggctttttccrtacacagctctttggtttcacggtacatgatttaaataggttgtatttaattccatgtaataacaaactgtgccattaagtagttctcctgtacaaatgcaatgtttcaatggcaacagaaagaaaatccagcctttaaaaaatgcacagatgctccaaatgagccatgataaagaaaggggtggggagcgggatgatctgcaaaaaagaatgagggaaggcagatttgtaccacttgtgctaaagcgtggagccttaccattcagggagaatgagacgtttgcaaaatggcatcctagtctttgaatgcttcttaatatggaacggacgagaacagaggtggcaagagggttagaattccccctctttgttctcctttctggaatggagaggaccttttcctgcctttctttgctcttattttgaagaggttaattatgacctggaagcgcccaggcacttgggtctcagctattgtcgaggaagaatattgtctgcgctgtaccgcaagaactaacttaggaaacattcaaatttggaactgctttcagaagcctcaggaccgattccatgtggtggcattctatgggatgacaaatccccactccgttcccactacttgtctttgaagacatgcacattagtgaggcagaaaattcactcgactttaaaataaaataagctggttatttggcccatctagaatacattcgtatctcaacatttcaaatcaaaaggcccacttattcctgtcctcatcctggctctgaagccaagctcaaggtgctctcaattacatggtagatttctggcccaagttaatatgtatcaggacttctcaagcgtttgtacctttgacctagaaattctacttctggcaaatcaatcccatagaaataattttaaatgggaaaaatgctttagaaccaaagatgttcgtggccatggaaatgacgactgaaaagagttagtgacaacctaaaaatacagttagaaggagaatgatgaactaaaccgtggttcctctcattggtttactaacatgtccccattcaaagcactgttcaggaccgtctagaacaacctggaggcatgcttttaaaatgttaagagagaaaagaaactattatccatatgggataattaacaatgtgttaaaaatatacatatctctggaatatttgaattgcaggaggagaattaatttagagataacaagcaaatccatcacgagtacatatgccacaattgtaacaaaacaaaataaaacaaaatggcctgggcatttgaaactactgtaagaatatgtgccaaaatgctaagagtagatatatattggaggattttctttttcaatctttttttcaactttggagtattttcccttttttatgaatatgtccctattgtgtatgagaaatagctaattttaagaagaaacagaactccaagggggaaagaaaacacttttttttgctcctatgagaattcactggataagggctgtacatttcgggcccgcctacttcattccacaggaattagtaactgcaggtgcaagtgttgctactgctmgaaggctaagccctgataaggcctggggaggcccagagactaacaaatgggtttcttccaggactttgctgctgattgatcactgcacttaatcctttccagagatagttactcaaaaggaccaggaaaggtaaatttaccaacgcaggccaacgtgactaaaaatagaaccataaaaatcttggggagatgcaatgtggcaagaccatggtcttcattaaggcagggctgaaggtggaatcctattccagatacttcacagcttagatcttttgccaagcctctcacagtctcaaattccccatcatcagcaggagtcataacagattgcaaggaggtttaaatgaggcaatacatgaaatatgccataaacggcaatttatcagcatctatgatccctaacattaaacactgaccacttccttatgtgccagacacaaagctgagcacttcacatgtactgcttcacatactccgagaattattttatttaacccccatcgggaagagactattatcatctccttatcacccacagggatgctgaggttacgaggtatcaagggacctacccaccattgcacaggcagaamacaggagagccaagactgacacccccagcaggaggtgttccagccaccttggacaccttccaccacaggctragccgcagtgaagggctttcagaggggcagtccacactggacatcaaacggtagagtggagattgggtcaaggacaggagcttcattatcttaaatgaattaatgcgggaagagaaaaccaactaccacatgttctcatttgtaagtggaaactgagcattgagtacacatgcacataaagaagggaacaataggccaggtgcggtggctcacgcctgtgatctcagcaccttgggaggccgaggcaggcagatcactcgaggtcaggagttcgtgaccagcctggccaacatggagaaacactgcctctacgcaaaatacaaaacttagccgggcatggtggtgcacacctgtagtcccagctactccggaggctgaggcacaagaatcgcttgaacccaggaggtggaggttgcagtgagccaagatggtgccactgcattccagcctggaagacagagtgagactctgtctcaaaaaaagaaggaaacaatagacactggggcctactggagggtagagggtggaaggagggagaggaccgaaaaagcacctattgggtaccatgcttctgacctgggtgacaaaagaatctgtataccaaacccccatgacatgtcatttacctatttaacagccctgcacgagtaccccagaaactaaagttttttaaaaaatgaaaattaataaaaattaaaagaaatcacagatgtttgcatatcacatcagttactgcagatatttcaaaatatcatttacactcaacactactcaaaagtataggtgttagtagatacactattacctcttgtgatttaatgtactatagaagaaacgtgtattactatagaacaataaaaatgttgatatttgtatttcaaaaacaaaacaaaggaataagggcttccaaactttaaaatgcaagagagcatcatgggatgacagtggaagaatggacctgggtgagaggaggctaggatggggagagggaagggaaggctcacatgtctctttttttgtttttggttttttttgagacagtctccctctgttgcccaggctggagtgcagtggtgcgatctcagttcactgcaacctccacctcccaggttcaagcaattctcatgcctcagcctcccaagtagctggaattacaggcgcacaccaccatacccagctaattttgttatttttagtagagatagggtttcaccatgttggcyaggctggtctcgaactcctgacctcaagtgatctgcctgcctcggcctcccaaagtgctaggattacaggcgtgagccactrtgcccggctggctttcatatctcttattctttctgcttccgctctctcctgtcccctattagccatgggttccagagaggagagaaggctcgggagagcaggggactcaggaggtcaccctgctaccctcacctttttaataaccctcctcaaaccctggttccacgtctccctcactcaaggatttatgtctcattttcaatggaatgttacatttggtcagaccacgaagaaaactcctcattataaactaggaaatgtgtggagagagaattatttacccaaggcagtgctcaatcagtgttgcccgaatatttatttagcccacacacggagaagttgtgttaatgtttgccaaagaatgtagctttataaagtaactgggtcaaaaaagacagcatatcattttacaaataactttaaaattgcttaagttaaatagctgggctctctcaggtttgtcttttcaaaaacgctgcagaaacaatatccagaattatgtctaataaaatacaggtattacaaagtggctgtttagcccattaaagaaaatggagagtgaaatctgaattatttctacccgaggcagaagcagacaaagttaccaaaattatgttaggccgacgtcgcaattcttcaagtctgcagggcggcaaggctaacagctcctgcaccaagactctattaggagagctgtatttttcagtcaacaatgacaggcattccatttctcagcctcaaatctagtgtagctatggggaattcacccaaaacatttgcttttgctttatcagtggcatttgtctgcctcaaaagccttgtgagggagagggctactacgtgacgctgccaggcaatgctgttggaggcagctgatttgatggacaagaaggggagcagtgaccacctgggtcactctgactccgccctctctgagccaagtgaatctgagcaatgatgtcataataatcatcaatagcaacagtggctgcgcgtgaggggcgtggtggttcacgcctgtaatcccaacactttgggaagcygaggtgggcagatcatttgagctgaggagttcaagaccagcctggacaacatgctgaaaccccatctctactaaaactacaaagaattagccaggcatggtagcacatgcctgtagtcccagccactcaggagcctaaggcaggagaattgcttgaacttccccagcttcaagaggaagagtctgcagtgagccgagatggcgccactgcactccagcctgggtgacaagagtaaaactccctctcaaaacaaacaaacaaaccaaaaaaacaaatagcaacagcaaccayaatcatcatcaccatcaaggctggaacaaggatgaggcaggcaggctctgatagyaacaggaggaagcagaccaaggagggagagaaaggaaggcagagaaggggaaaaaaaaacacaaatgataataatagatgctgacatttacggagcacttactatgtgctgggaaccatgctgacggcacaccgaatccactgaacaggtgggtaagtatcatgggtcaatatcattctcattttaatgttgacagtcacaagactttcatctgtacaatgggggtactgctggctcccaaggccagtgttggtggaatacagtgaatagaggtgagtaccgtgtgacaggaggctgcatcagtaagcaggggcagccagccaggtgaggaacatgcccactgagatggaggtcaggacgttgagagatccccaaattgcaagttgtcatcctgagacaagcgataccttgctggacactaattcattcttggagtctctccctctcrgccctttggcttcatgttctggagagaatgaccagagagacccatttactcaacgcttctcaatgagacagggatcttctaaagggcactgtcttatatagatccttgcacctgcaatacctgcctggcccagcctggccctcgcaggttcttgtgaaatatttgcttatgagtaagcaaatgcataacacgagacggctgctctggaatgacagttgcgaacacaggaggctgctgagacttccagagactgtagataaagaacaaagaccctgtgaagttcctccgggaaaccagatgtggcagtgtgctagggctgccctagcgtatcagcacaagctcaacagaaactgactctcacagttcaggagaccagaagtctgaaaccaaggtgttggcaggggtgactccttgtggaaaccgtgccaggtttctctcctcgtttctgggggctgcccatgaccrtggcatctcttggcttgtagacgcatcactccaatctctgcctctgacttcacagagccttctcctctgtgtcctctcctcctttttctgttttgtcttttggtgttattttttttttaagagatggggtcttgctatattgcccaggctggcaatgaactcctgggctcaagtgatgccccytccgcagcctcccgagtagctgggattgcaggcacacccaccactgtgccccctgctttcctcttctcatgaggataaccgtcattggatttagggcccactctaaagcctgaatgatttaaccttgagattcttagctaattacatctgcaaagaccctgtttccatataacgttacatctgtgattctgtgtgggtgtggattttggggagacgctattccacccactacccttacactgcaactcacccacactgacagcttcccttgcctgtgtctgtccaactggcttagaaccggagcatggcatcgtcaccatggactttgagaatgtataaagacaggtgcctggtcccattccctgtgagtcttgaggaaaaaagaaaagtgagcttcaaaaactagaagagccagcctggtgtggtggctcacatctataatcccggcattttgggaggttgagactggcggatcacctgaggtcaggagttcgagaccagcctggccaacaagtgaaaccctatctctactaaaaaatacaaaaactagccagacgtggtggcatgtgactgtagacccacctactcaggagactgagacaggagaattgcttgaacccaggaggcggaggttgcagtgagccaagatcgcgctgctgcactccagcctgtatgacaaagcgagaccctgtctcaaaaaaagaaaaaaagctagaagaaccaaatcactaatgcctaagcaagaacagaggggatagaggggcctgggaagcaaggcctgtaagatcccttgacaataacacaccagtcccatgagcaggaacacaaaacattatccctggacccagttctccatcagggtctcrgcatgaatgaggctcttccttcctcacggggatgggaggaccaccctgctttctttgcccttcccaggaggaagggaacagcaccttccccatctctgccagcatctgtccatcaagagctggtcaacagcttagactcaggggatgccacagtccacattacagtgtcactgggccagggctgggagaagccgtgggagaaatgcagaatggggaggctgaggcaaagtcaggatgaaccaaaatgtrggtgagcaccagacacagtggccacctgaggaggaaacacacaacagctgagaatccacgggggatgcgtggccaggttagagcatcctggaatcaggcaggtacgaggagtccacgaagtggagaggtgatgcaaatctgcaggccttggggacaagagcacatcaaacccttgggggccgatgccttcagtattcctaattcctccatgttagaaaggtattttgggccaggtactgtaatcccagcactttgggaggccaaggtgggcagatcacctgaggtccggagttcgagaccagcctgaccaaaatggagaagccccatctctactaaaaatacaaaattagccgggtgtggtggcacatgtctgtaatcccagctactcgggaggctgcggcaggagaatcgcttgaacctgggaggtagagatcayggcragccaagatcacaccactgcactccagcctgggcaacaagagcgaaactccatctcaacaacaacaaaaaaagtaatttagcacatatactgcatattacaaaatacctttgcggggtttggggcaacatcctataacaatgacatttctatttcttcagtgaaaatatgattattcagcctggccaacatggtagagaaaccgcatctctacaaagacacaaaaattggctgggtatggtggcacatgcctggagtcccagctacttgggaggctacagcaggaagatcgcctgagcccgggaggtcgaggcttctctgagctgtgaacacactactgcactccagcctgggtgatgaagtgagaccttgcctcaaaaaaacaaacaaaacaaaatgaacattcacactagaaasgagaaacagggacgctaaagctgaagtcaaatttcaccaccaaataaatttgctataaatatacaataaatttgtttttgcttttcagatctctttgggttttggaataacaaaaaagggactgtacatggatatttccaagctggaaccgaggcactttctagacgaaggcagccttatccccaggaggtaaggtgtggaagtgagttgagggttgaggccagcaagactcagaccacagcctcctgctccaaacagccacatcacttaatctattttgtaaaccaggcttccctcaagggatctggtttaatgagagaatttgggagctacaaaaaagactgaaaattgttgttggacatcagatgctggcaaactttttttgtaaagggctaaatagtaaacaacttaggctttgtgagccaagaggcaaaaccgaggctattacagaggtatttacataacaggagagaaaaacaaatttctgcaaattttttattgatgaaattcaaaactttatgacactgaaatcagaattccatatcattttcctccttcaagaaataatattctcctctttattcttttttgcagatgattgaaaatgtaaraactrttctgagcctgcaggccatagccaaagaggtaccggctgtattttgtccatgggcaggagcttgtgactgctggtctaggtcattccaggtcaaccaggggcctctcccagagtgagaaccactggtgattccccagagtgggaccaagtgaaagcacttggctggatcagagggataggagcctggctgctcctaaaacaagacactacttgcctttgatgttcaagtcatttaagaaygcaattgcttcctactcaatttttcaaaaccaaaataacaaatacgatatgagccataacttagcaaaattacgtgttttaaacagtctctttcaaaaaacaatagattaaaaagtgcaatatttttaccccctcttaaattggaatcatggtatagcaggcaggatacaaacttctcatttccrttacacattttcagtgccatcattaatctgaatgayatcaacaaaatgcccaatgcacataaatcartcagactttgaatcattcctgcagcctctgaacatttaccatggagctcaataagccaggcaagaacacagatttttttttttttttttttttttgagacggagtctcactctgtcacccaggctggagtgcaatggcgtgatctcggctcactgcaacctccgcctcctgggttcaagtgattctcctgcctcagcctcctgagtagctgggattacaggcatgcaccaccacaccggctaayttttgtatttttagtagagatagsgtttcaccatattgatcaaggtggtcttcaactcctgacctcgtgatcctcccatctcggcctcccaaagtgctgggattacaggtgtgagccaccgggcccagccgtaggaacacagatattatcatcatgggacaagtcatccattcycagattccatgaccctctctggtgtccactgtggatwtcagcacatgtttaactatgaaactctagtcacgctttttgatatacaggttcatggttactagtgtcttatcctgcttgagccaagaatatgcactaacacattagacaaaccttgaattaaaatgggcaacccaccatccaaatggggaaagatgattacagacaagttcgtacgagtaaactacttgaaggcaattcctgtgcttaaaatggccacgtgaaaggtgtccctgacatggaaaggacaaaccatgaaatgacccttgaagctcttaakgtgtctgtcaaaaaagcaaagccaactgtcaaactgaaaagccaaaatcatcacaaaaacacctattcttcagaggcctcaaatctcaaactatctcccaccatcctttgtaagtatgtataaggaggccaggaaactagcatttgctgagactttattctcagctttgtatgctttgcataaatgatgtcatagaacacattgacagtgagaaaactaacgtattaacattttaattaccttgccctatcacgagattagaaagattcagatatgagacatccaaagtctgtgatctgaacaccagagtcagaggctggcaacctatggcccacgggctgaatctggcccactgcctgttcctataaataaagttttattggaacacatccgtccatttatatattatctgtggctgctttcctgctgtaacaggagagttgagaagttgcaacagagaccataaagcccacaaagctaaaaatattgactatccagccctttagagaaaaaggccatgcccaggctcctgtgggtacctgctatgctacagcccctctgctgggggaaaccagcccactcacaggttcccagtgaggcaggatctctgggcagttccttagtaattggtggctctgtgacttccttcccccaatcaccttgaccatctagtctggacaatatgagcgcccatgacgtgaggacagccttgtaaacagggtggcctggctggaaagccttgtccaaaaggcacaacagtgactacactgaacccatcccatgcatccttttgagagttagaaggaggcaattgcaagccggctgcaaaagamaaaagacaccagagacttagaaaccagtgaagccacgctgaagatgcagacagagagctagagacaaggtcaggggcctctgttgcactccagacccggtccggaggcttttccatgcttaggggcaaggattgtcagggttctgctgtccctttctttaacctcctttatgattccccaagagcatcctgagtgcacctccactccctgccaccaggggtcagatgagccggcctggcaggcttgtttccctccaccagacaacagcaaggaccaagaytggcaaagtgacacatcctctccaaaagaagaacatgcagaacaaatcaaagaacacaaaccacgactgacaaacacagccacactcgattttaaagtactgagctgtttgaagaaaggaagcatggcaaggccccttcctactaataacagtaacaacaataatactaaatattttataataattttaaattcttaattatttatgatatttccctccattaacatcacgaacatcattacgtgtgtgtgtgtatttttctcattttaaaaccagcagatgagagtaaaggatttctttttcctytcccccacctctttacaggacctactgttaagttttcaagaccacccagaaagaaatttgaagttgggtttatatccttaatccctcagttagaaaaaaaagaaaagtgaagaaactgcatctccaagatcctgctatatcaacttcagttttttgaagttaaatttgatttttaaatcccttggctgatgagacctgtgtgggttttttttttgttgtttttttgttttgttttsttttgttttatcattgtacctctattttaaaaatagagacttgtggttctttttccaaaagcagtccaacagaaagtgaatggtggtcaatgcataataaaatgagagttaccttttgacttggaagaattattagcattttgatttgatgggttcttagctcttcaaattcaaaaataccttattcaagtctaggagttttscaaatacttyggttctaaagattaccctttttcgatgctttgaaaactaaaagggcatatcagaatagaaatctggctgttgaataacttgtaagctctgcagagacgtacaaaaacatggccactttagccagcrgtrtggcgaaagtctggggcccacactacacacacacatatgaacttctcatgaccctcaagtatattcayatgatatatcacaaataccataaagcagcattgtaatwacagggaggaattgattttaaaaggcctacatcaaaatkaatagtcataaaagtataataacctagactggaaaatttagggattagagcattttgaacattatacctcaaatttataaaggctgtatattarcattcacaaaggtttttaaagatggaatagctatgtacacagtgaatttattctaaaatccagactcaaaaaaaaaaawgaatatgaactcctccccaccgtgttctggactaaaatcaataagttccctttaggtaattaaaatgctggtcccacgacctgccatcctattcccaggcttagaatgttaggaacactgtttctgctttgagaatggaagagagcaggttaccctgatgcctctggggccaaacacaggggatacattttcccagtagaagaaatcagccctgatcctcaagaagaagaacatattggcatattttagtgagackgaggcatactgcatcttggggtaaaaactgaatcatcaggccaggcacggtggctcacgcctgtaatcctagcactttgggaggccaagacaggcggatcaccaggtcaggagatctagaccatcctggctaacacggtgaaaccccatcyctactaaaactacaaaaaaattagmcaggtgtagtggcaggcgcctgtagtcccagctactcgggaggctgaggcagaagaatggcatgaacccgggaggcggagcttgcaatgagccgagatcgcgatagtgcactccagcctgggcaaaagagcaagamtccatctcaaaaaaaaaaaaaaaaaatttaatcatcaaaggaaaatgtttcaaattctagggtaagctgacatggtacacatatacagcgaaatacacccagggaggctgaaagtccaataggccaccacagcacgttaaaaatgtcctgttttacctatagtcaacaataataataaattatatatttaaaaatttgttaaaagggtaggtctcatgttaagtgtttttaccacaataaaatatttgtttaatgtcctctacrtggctattatgattggaaaaggcataccttgaacagagatgaataaatctgcatatctgtgaaatgtcagttcagcatgttgatcgycagtaatcttttcagaacatttcagatatatgaaaatagcaccaatgtctgagtttgaacctgaactggtttcagctaaagtgatcatcttcagccaaaataatgggtatttctttcttggccttccttctacagacttctaaaagacagtggaagcactgaatatccttttagaaacaaacaattacaaattagctgggcatggtggcgcacgcctgtagtcycagcaacttgggaggctgaggcaggagaattgcttgaacccrggaggcagagattgcagttagccgaaatagcaccactgcactccagcccggtgacagagcgagactccatcttaaaaaaaaagaaaagaaaagaaaagaaagaaaaagaaaaacagctacagatattcattcctktttaatttcttgataaataatagaccagtaagaatcacataagaagcagtctacatttttcaaagagtttttacagatcccatttgatcttcaaaagggcctccattaggaaaaactaaattcaagtttaaaactatccattttatttctcccataaaaatatattcagcccctggagataatctccaaattcctcagattttaaaagttaatttttcttatcttgacccaaaatctgtagaaacaaggatttttcaccaacagtgagctcccttttcataaaatccttatctaccaagatttacctctgcaaacctctacagtccctggttgtgagcccctgatggaagaagctagcataaagaagttcacaactastggggagggaacgacctgacaagttgcaagcaagaaaggagtgaaaaactgagttaattgtacaagaatttgtgtatttataaatgcaggataaataagatcaygtagaaactctctttagacttccatccttactgctgtaattgaacgaacagacgaatgtgtttgaccgcaattgccctaatactatttttcccataaatacctgaaattcttcaattgtaagttttcctactctggcaattttaaggaaagtgattcttgaggctgtgggtgaaataccacattcatttttttwaaaaaaataaggtatacttacttgtactttctmccattttatatatattctctgtttaaattgtgtagcccctaatagactgcaaagmcaatgataaaaaggaacttgccttattcacaggtacatccttggaacttagtaaagggcttaacctccatagcaggcagtcaagacttactgaatgattamataaaaacactgaattccrtattgtgcaggaaaaaaaaatcaagattagacctcagaaaaaattgacatgtctagtagaacttactatctgggcaaacttgaagagaagtgcaatgggaaggcctcctcaaaaaagacattgaaatcaagatgggacccgttcctaccctggatttctctgaatcagctactccttaagttcgtattttgttccactcagccaatggcaattccaggagagaggcaattgayaayaattatgttttctgccttctcttgggttatgaatttatcatgatgcaaaagtcgagctactccgatgccacgttaacaatgawaaacaccataaagacaaaaagaaactgaatttaagcatttggattctgcagaggagtttattgaacagattaaytaaggaaaggcaaagctacacaattatggaaaacaggtagcaacactcaggctgactattttcgatggccacctgagagcggatttccaatgccctcatttctgtaggtacattatcctgtgttttattgttagtcacagctgcaagttgattaatttgcattcagaaattctaagtggcaaatgtgcaatgcatagtaatatacatttttttatggacactgtgaaaatgccgaagccacatctcataagtaactcttgctcaaccagtgagtaaaatccataaaagagtttgcaaaaggctttgaaagagtttggtttgaaaggaaaactgcaagagcaaatccctctcctccaccccagcccttaaaaaacaaaactaaactaagtctgaagcaaaaccaaacaaagagaacagttgggtgatgtcaagctgccagaatcataaatgttgtcagttcacgtcccagtcttcctgctctcttggcattgccaataaaatccagaaacaccagggatgactcagtaccacagtcagtgcgtaaataagggataaagataccygttaaatccattgcctcaaagcaatcatgggagkttcttaagaatactgaacctcctctccgttttctgcactaaagagataaggagtggcatggagaatctaaatgtgtggaaaatatataycattggtgtgagaacacatattgtgataggtgttcccctccatcagccccctagtcyatactcctagctgctttatcttccagatcatgcctcccctgctcaaagtgaatttgccttccctttcacactgaccttagaagtggatctgagaccatgcttcctagcaggagaaaacaacttttccatttgaaaacctttgcgaattacccacaactctgacaacaggtgctcagcagttgatagtattctttttggaaagttttatcaaccacttaagttaacttgaagacgcctaacagcaggatatggtcaagcaaacatgttcatcaattaattcaaatgcaattttrgtttacttttatatgatttcccatgcttaaaactactaattgctttcccaggctggctgcatgaacatggcccaatcaaaggatgcaacagtcaaatgcttgtgtacatcatgttacctgtccatttccatcagagacatcatggacacagctgaaatactaggcctggccttttgtaagttcattagagcatcacaaacataactgcagmtattctcactgtttgtgactctgtgattcaaatgttttcacaaaccttccctggcactgcgtattagayggattgaaagatgctgaaacgtaasgccgggcayggtagctcacgcctgtaatcccaacactttgggaggccgaggtgggaggattgctagagcccaggagatcgagaccagcctaggcaacatggtaaaaccccatctcyacaaaaaatataaaaattagctgggtgtggtggcatgcacctrtagtcccagctactagggaggctgttgcagaaggatcgcttgagccccagaggtcgaggctgcagtgagccatggtcatgccactgcactccagcctgggtgacagagtgagatcctgtttagaaaaaaaaagaaagaaagatgttgaactatacacaagaaatgaaaagaaatagctgagatatggctcttggggagaaagaacaaagcatcaactaatagaattcagaaagaaaaggaggtactcatcaaggcactctgctaaggtttgactaatgggattccacatggtctgcatgtttatggcttaaatgagstaccaacactgaaactgtccacttaattagcccccaaaacaagaagtacagactgtgagtctgagacctacagagactccaaaaacagaaactaccatcgcctcaagctaatcactctaagtcctagaaatacatctgaggttgcaaacagtccatttcattcattattwtatatatatatatatatmtctatayagatatagatawatatatatayagatatacatatagagagagagagataaaacagaaaaaatctaaatgtctaaaggaccagatataagttaatcataaaacgatgacaacaaaaacaaaggcttcttgagttaaaaagaatggaaaatatttaactagagttaaaaagaaaagcaatttgatcaagagtcaggaattgtaggttctagtcctggctctttttattctttttatttattcctgttttttttttcatttcttgtatatacttcaaaaaggcaaaatatttataaagtccttctgagtatsaacactatgattygtaacctcatctttgcaatggaaaattcactagtatattaaattcaaccaatgggagaggttaggtagatgtatgatcacatgctggaagaagctacagagagggttatacaaacgggacatgctggtattatgaggtcaaataacaagtatcttagcacaaaccagccctggcataattcaggataacaaacaacacaaggtgcaaaaatagaagtaagtacacatcaagtggacatggagcttcctgttagatttgaccttccrcataatcaccacaaaggatttaaaacaattaagttgaagtttacggacacttggcacaaaaagccacgagagcctcacccaggyagagtatttccacacctccaggaaggagagagtggtaaatgaagggtcttcyagcagactctgaaatgaagaaggatgaaacttcaatgayayatctgtcaactaatgatgttcaccagaaagtttcaattttaaaagttctacaaggtgaatttttaagtcatctgaaatgtttcagtgaagagaatatgattcctaggccagatacagtggctcacacctgtaatcccagcactttgggaggccaaggtgggaggatcgcttgagcccgggagtttgagacctgcctgggcaatgtggtgaaaccctgtctctacaaaaaatacaaaagttagttgggcatrgtggcaagcacctgtggtcccagctgctcaggaggctgaggtgggaggatctcttgaacccaggaggtcaaggctgcagtgagctgagatcacaccactgcattccagcctgggtaacagagtgagaccatctccaaaaaaaaaaaaaaaaaaagagagaatatgattcctattgactcatgtaaatgtctactgaggagaaaaattgtttatgcagctgatgccatctccccctgggtgcctgccttcccatccagtgaagaaacgatttcaggggtaagagaacaccctggactctgggaaaatcttcttgtgtcctgttgcctgccttctctctctatgcaaaggctggaagagatgggccccaggggaggaaagagacatcaaggcatttgtgacaaagccaaccagcttcctctccccatagccctgggcaggtgctgtttgatgaccataactctatttgccagagagagggtccatagaccatgttggtgtggtgccctggtgacatcttgtggtgaaatggaatataaataagcctaaaattctacccatggctgcactggggttcaatagaaccagatctcccggtatgtttctttttgtttgttttttgagacagagtttcgctctgtcacccaggctggagtgcaytgacacgactcgactcactgcaacctccgcctcccgagttcaagcgattctcctgcctcagcctcccaagtagctgggattacaggtttgcgccaccgcacctggctaatttttgtatttttagtagagacagggtttcaccatgttrgccaggctggtctcaaactccaggcctcaagtgatccacccgcctaggcctcccaaagtgctgggattacaggtgtgagccaccrcatccggcccttgtatgtttctacctgaacaacttctcctgcggtccttcaaagggtggatactgaagtccagtggacacatacatttaaccacaaatcgaaacaaatgcttcccagtatacagtatgcaagaaaagagcagcattgattggaagaatgagagrtattttcagagatgaaaacattctttattccctcggtccccatgtgttccaatggaaaggaactacatcctatgggcggagagtctcaggtaacacatgattacctcccaagactccttaaataaagccttggctcagaagataaaactccattaaatttatgtgaaaagtcattcttattcaactacgaattccttaaccttaaagcgtacaattcgcaagaggtaaacttagggtgtttgtctacctggggataaaaaagagtaatgaacaggaaagagattccaacagataaaatgatttcgtggtaatattgcgagcccgcgtggctgtgattgcaagcacagatgaagagattagagcagtgaggatcagaacgggaagctgaaccactggcattgtgaactaaagaagtaaaagagaagcacatgccaatggtaacagaaatccctcttgtttttttgcttattttttcacatgcctgctgtgtcaaaagaaacacctctttgtgtccaaagtaatttctttttcaactttgaaaggcaaggggtgcatttactggaagcgctatgaatctatctggatgaaatccttasgctgggagcagccctcagcaggtagggaaggctgggggaaaygtacttcctgcgtacgacacacttatcatgcacctgtaatagtgtgcccatcagcaggaaccacagcatagccatgccggcgtctattacctatccagtgtgacaataaatgaggccaggtgcacacctctgttacctattattctccacaagaatggcagcaaagcagtgagacctragctatacaagaaaataatacaggaagaaagaaataaaggaagaaaggaagaagaaggaaaggaaaagaaaagaaaaggagaggaggaggaggagaaggagagaaggaaggaaggaagggagggagggagggagggagggaagacaggacaggacaggacaggacaggacaagaaaggaaaggaaagaagggtcttctttctaatattttctaggcagcatcagaaaaaaaaaatcattaaagtttttctgccagagtatacatccctgaaaatgctgagatttaatacacaggatctgagctgtaagattaatggagattcaaaatgttaggtacccttttccttgatggctgggaggcatcaggcttggtgcaatctgcaagctgaatttaacctaaactcaaactggagagggcagaattagagcaagttaccccaaagggctcagctttgagggcttaaggctattcatctctagcggttcattccactcatttctcgaggatactcagatgttgctgaagaataaacaactgaacagtatatgctttcattcaccaagtgagccaacatgccaagttttcgttgttttgttttgtttttttaagatgcagargtaccagtaaaaggaatagcagtattagaataaaaatacaattagtactagaactatttttaaagtcctgagtgaaaacagacaatgcactatttagatgtagaatagaagggagtcaaattataaaaacasagaacagaatataattcaaagagaggtgctgcttggaaataaggaaaaaatactaaaacatgggatgccatgttttttccatgttaacctaatatttcatgcattaaggtggaataattacattgaagcacagttttcttaattagcycaggtatatttcctggggaaggaataacttattgcaataactggtgttgggacaatgaactactcatctggagaaaatcagctggatccttacccaattcctcatggcaaaacaaatcctcaatgaatttaatgatttcaaagtcaaacataggcacgttcaaccagtaagacatatgagtcaatataatgttaccatggagaaggatttttaaagsgtaacaattaaaagcagagatcatagaagacaggctgatagatttggttgcaatagaattaaaattaaaagacaaaagtaaaacaaaaattaaaaacttaaagacaaaaaaagcagaggtcatgaraaaacatagtcatacacctcataccaacatttcagtcaataacgaactatgtacacaatgccgatcccatcagattataataccatattttcactgtaccttttctatgtttaggtgtgtttagatgcacaaatatgtcccattgtattacaactgcttacactattcattacagtaatatactatacaggttcatagccctggaggaagaggctataccatatagcctggatgtgtagtaggctatccatctaggctcgtgtaaatacactctatgatcttcatgcaatgacagaattccgacaatacatttttcagaatgtatctcccttgttaagcgatgtgactgtacctgtgatatacataaccacaggttaatgtcttgaacatttaaatagttcctgaacacataaaaattcttaccattcacaaacgtaaagacaccaagatagaaatcagtcacagaacatkaatagatcatttgcaaaagaaagaaattgttaacacatcaataaaaaataatgtttagcttcactaataatcaagaaaatgcacagtaaaattagattctacctttctcttactactcagctttagaaaaacgttacttattcctagtgaagatactggaaaatagtagcctcaatatttcaagaaagcaatttggcaattaatctcaaagccttatcttattcttggaaccagcacttccaagcgcaccaaggaatcactcactggtgtgtactacaaaaacattcattgcaattccacttacaatagagaaaagctgtgaataacctgtatgtccaacaacaggggattggttaagtaaatcatgactcacccatccattaggacattgggcagctattaaaaataatgctgttgaaggatttagtgacacagaaatactaytacatgaaaaaaggcagtttcttgaacacttccattttctttttttggctggcttttttttttttaatttttaaagagataatatatacgtgtgttatcaggaattacatattggaaatgaccaccaaaaaaatgacttgttccacttaacaaagaaggaaaaacaggccggacgtggtggctcacacctgtaatcccagcactttgggaggccgaggcaggcggatcacgaggtcaggagatagagaccatcctggctaacrtggtgaaaccccatctctactaaaattacaaaaaattagctgggcttggtggcgggtgcctgtagtcccagctacttgggaggctgaggcaggaraatggtgtgaacccaggagacggagcttgcaatgagctgagatcaccccactgcattcctgcctgggcaacagagcaagactccagtctcaaaaaaaagaaggaaagataaagttgatgccacctttggtctcttcctttctactgacaaatcatgtgtacttcagcagtcacttactccatctgggcctctgtttcctyatctataaaacaggaataatgacaacttccccaccttagacatatggattctatgaatatagtcttgacatgtaaatggctattttgttgtgctgctgttttggaaactccgccattacgccagccatgtgaaaatcatttctcagctccatttgacaaaggtggccactcagctgggctccaacactcttccccactctctctgccactgaactcaaacaccctctcctttgggaaacccaggctggaaactgaaaggatggctccatcctcttgcttcccaagactctgcaccgcccagggacgctgarcactttgcatgtttcctgccacatcattcagcagcccctgccttccaccgtccaatgtgcctatgcatccttctctttgcctacaccaccttccacttggtaggagctcaagcatcccccatcaacctcttgcagacccatcaacacatccctggcattcttctctgacctattagtgcttcaaggttgaaaagcataaaagggcatggtccacacaagtgcagggtttctcagcctcagcactattgacttttggggccagacaattctctgttgtaggatgcgcctgtgcattgtaggaagttctacagcatcccttgctcttacccactagatgctaatagcagcctattctcctccaagatatgacaacccaaatatctccagacaagtgtcccttgatgggcagagtcacccttggtacagcaccactgtacacagtgagaaaggcaatatatttatttctgctactgacagtcacagcctacaagcagcaggtacccaaatcacataaatgatcaccgcaaggacacttcttgggcaggaaagtccatgccagagcttcaaccagaatctcctgagactgaaaggggaatgacagggagtgcgtccctccctgcattcctctggctcccctctgagccttgagcaaaaggaaggggacagccccctgaaccctgagcctatttgcatctcctctgagagcatgttctggaggcgctccacagcgagcgggaagatcttttgtgagattacttatctggagcgcgtgtcacttcttcagcaccataaaactgaaatacttgaaatagatgtyactacatttgtcatgaactgacatggccaattaatattacaaattcaccatggagaaacgcttccagctcccaaggtataaactgctgaacatcacaatttcctcttgtaacaatgggccagcctcgccagggctataaatacgaagaagtacaggctgattaaatggtaaaaagtgctgttcacagggagtctctttccagggctgacactagcgctgtgcctaaagttaacaggtaccccgatgtctcggctgcaaaatatgtatttttttctctctttcttcaggaaaaagttgactgttgcatactgtcatttttttctcctcccagtgagcaaatggcacactcattacaggacatgaaaggctgtgggcacaggttgtcccaagttctgttgccactcagctagttggacttctcctttttttttttttttttctattaagtcgtgtcacagccaaactctcacccctaatgaggcacagctgggcccttggccctgaagaaatacgcrttggaaatgaactggaaaacacttggcctccctcaaacttcccaggagacagcttagcccctcgtgccccctgggagttggcttcttttccagcggccatcttcacaatcaagcaggaaaatgycattgttccaaagtacacaataggttctggtggttttcaaacatcctccatataccagtgcaaatggaggggcatctgaggcgaattccacaggatgttttaggagcccacaggccttgactttcttttctcggcagaagttttaagttccagtccccaggcttcattctttatattcttggtttggaagacagaggcagcagtaagaaaatagattatgtataaggaagacaaatagggcccaatgaattacccaaaccaaacaaacaaagtctgctttggaaataaggttttggagggaggtgagacctgtatgcatgagtgtataaaatcagagagaaatgtgtcaaaaacaaattacaaaccttccaaatacgggattacacatgaatggatggtaataatcacacatcactccaaggcaatctgtgtattacatcttgcatttcatcaaacaaggcttagctcttgggtcattaattagcaacctcggttccagataccaaaatatgaggaaggctatagtactcgggtcctgcttcaatattgtgattygtttttcttatctacktctctttttcttcccttattttgctcacaatgccttctgaggaaagacaagacctttcttataaaaggaaaaatatccatgtctctacccacagagtccaccattaatggaaataggagattgctttcttcaaagtacacaattaaagtaacgtactaactcctttacacataacacaagaaagctagaggaagttttatgtatttatattacactttttccttcttcctcttttctcaatataggaatctttctgttttatgaaagctaagccactccatacaacgaacagtttactccaatacaaatagaaattatagaaaatataaaaatcctactaaaccttttaatctctaactttccaagcaggtgaattaatacagaggacattagagatttattttctttaagctccaacagtaaagagtgtttcaaagtcattctcaaagctgtagagatttttaaaatccagatgaaccgagcttaactctgtgatgtgatatataataaaatctactccaagattcacctacttaaagatatatgatacatttggataagagaaaatgaaattttaaaatctaaatacatatgaatcaaatggttaaaaaattaaatagaagtttcttgcttagagtaataaatgcaagcttctcagtggatatccttaatcctgattttagaatgagtccaaaaagaaattgccagagtgaataccaggtaacagaagaaatgatgrgcatgtttctctgtagaacaacctcccttccctagccgctaactatggtggtacttactcatcacattctagctcagaactgccattctggtcctttcattcttgttagtcataccagcatttgtaaactgctttccacattaaaagaaaagtaaatggttcacttgtccctaaactttttgtcttacacaagacaacattaagcatatttcaaataaaaatgttcaattttcgctagctatgttaaaggttaatacccaagctaaaaccactgggttttaaaagatggttaaactgaacagaaagctttgattttcaagttatgatcagaaaataaccatgggagactgtcgagaaattaaaaatatagtcagaaagcctttaagtattacttagcaaaacagctatgacccaaaatagcatctgttatatgtttgttattcacttcagtaatgactgaaagtgaataaataaaacttgctyggaaaaataaggttttgaaggaagataaaaactgtacatttaagtgtatgaaatcagaaagacataaggtaatagaagtatccatcacataactggcctttaaaccatgtaaaactcattgatacccacatgggaggccaaagaaacgcaatttccaactcaagaaactatcamacaaaatcccaacatgttctagacaccactggataagaaatttgagggagtaccccgaataaacaaacattcacaatcattcacaatcattcagcattacctcccattctacagggggataatccattttaaattaattctgaattcatcaaaatacagttcacagaataattatactggtaatgattcaggagacactttaaaagagtattatagctttattgtgatatatatagttcaaatacattttgcccatttaaaacgtacaatgtttggtaagtttcagtacaatcgcagatatatgcaaaccgtcaccacagtcgagagaagtcaagataaaacaagagaacaggaagagaaagaaaaacaaagagaaggagagaaggaaaagagaagagatttggaggtacatattccagggtgagttcttggggtctttattgttttaggacttctcagtattcgtcgtggtaacagagctttatctgcctggttgccaaataatgtcttcccaaataatatgagagagaaagcaaaagagaactgttcattcgcaaaactgagactcaccgagttaaaaaattaagttgtacagatcagaaatgtaatcataggagacaagctctgagagtttttcaatcactgtggggttgcatcaatttaaagtcatgttacattaaagagaaaaatgtctgggagagtctcttcctgtcactttagattagatttgttgttgttatcyggctgtgcattttgtcggcttcattttacattttaaagatattgcttaatgtccataaataaaaaactcataacctacgactttttctccattgtccagagattagtagatggcgcaaattaacaagaagagyaaaacactcaatgttcatctagattcatattaacatattaactaacttccttggagtaatctaacataggccaacttcaaatccagtgattttttttttttaactctgctccacttaatttaagagttacacaaaatcaatttgtggtctatctcccttcacctagtctctatcatgtaggagggaaytggaaaattccatctggtgtgtttcaatgtttcctcaagcgcaacttcctttatctcaccaagatcttgttaaattgcacatgactttagtcctggacgccaaggacttctaaacatcaagttgcataaaagtgacatttcaccaatttaagtgataagttttcaaattgtgaagcatctaattgcaacgataaatccaccttgctttcctctatggccagacatctgtatctttaacaaacaaaagtggcagtttaaaaacaattagactcaaaaactctaatgaataaaaatcactgtccctacagatagcacgtaaacttacaygcgcaccgaagcgtgcttccacactgcacggcgcacactggccagggacattctgaaccagaaagggccctggccccaaagtcgtgctttccctactttgctttctagaatggagaccacgctacacatcataaatctagagaacacgttaaaaccttgatgtgcctgtcattaatgtagctgctttatcgtgacattttttttttccttagaagaaggagaatagttttcctgtgggttggcggtaaattttaaaaagcattttctgtgacctcatatagtcaaatcatgactcctgtcaaccaacagcctcctggcatcctcacacacccttagtcctatagagttacatcatacacacatttacatgaattgtcaaagacattaagaaaggcaagcaaaggccaggcatggtggctcaggcttgtaatcccagcactttgggaggctggaggaggactgcttaaacccaggagtttgagcccagcctgggaaacatggcaaaatcccatttctacaaatatatatatataaacacacatgcacatacataaatrtaagtataaatcagccaggtatggtgacacacatctgcagtacaagctactcgggaggctgaggcaggaggatcgcttcagtctgggagttacaggctgcagtgagctgtgattgcaccactgcattctagcctgggtgacaagagtgagagcctgtcttaaaaagaaaaaagaaaagaaaagaaaggcaagcacagggagggagagggaaagtaaaaaaattgagggggtgagatacgttggcctctgctttttgtggaaaaggaggctgctgcataaatacaaggaagaaaccagcatatgagtgtccaaactgagttgccaagggcatgaagtctggaaggatctttgagggtcatttgacttcactccacttccagcttatatgctgacttcagaacttgacctgtgcagaagatgagtctccacggcctgcacagcacacagaattatttatccctatacccccatatattacacccccttccccggtaagtgaagaaactgtctgctgaaagaatgcatgaatcttgcctttaacgtctcaggcatgtgttaaacactttccgagacacctggcacctagtaactttcaatagatttctcttctgagccctctgttaagtttctcggtctctattaaggtcggaagcccagcatctgggagaagagagtggttcagctctcatctcatcggcaggatcacatgtctcaacacagccaggatttaggaacagcaatattccatcttaggcagttcaccacttcatacgattatttggcaccctcgatttttgttctgctgctcacatcacacaaaggctatttctactttatatcttyagcattttccccacaccagagttgtacctatatacatgctgtttccaccagcaggaaagtaggagtgcaatcagctatcctcgctttggccagtggtgctaggaactgataactccacatatcctgcaaggcaggcaggagaagttaggaagaatcagggaggaagggaacasacttttatgactgtggatgcagggcaatgggctctcacgttgtggtagacaaaatgatgcccatttcccaaccaaagatgtccaggtcctaatccctgaaacccgtgaatatggtagactgcgtggcaaaggagaattcaggttacyggtgaaattaaggttgttaattacctcgcattaaaatagggagaggggctgggtgtggtggctcacacctgtaatcccggcagtttaggaggccaaggcaggcagatcacttgaggtcaggagtttgagaccagcctsgccaacatggtgaaaccccatctctactaaaaattagctggcatggtggcatgtgcctgtggtcccaggtactcaggaggctgaggcaggagaatcgcttgaaccctggargcggaagttgcagtgagccaagatcaagccactgcactccagtctgggcaacaaagcaaagctctgtctcacaaataaaataaaaataaatagggagaggaccctggttatctaggtgggccaaatgaaatcacaaagatccctaaaggtagaaaaaaaaaagcaggagaagagtcctggtaaaatgtgaccacaaaagaaagacagagagatgcaatcttgctggctttgaaaaatgaagaggccatagmagaggaatgtgtcagcctctacgtcatgggaaaaggccaaggaacgaccttcccccagagcctccagaaagaaatgccaacaactacattttagcccaaggagaaccctgtaggacttctatcttacagaactgaaagacaatacatttgtgttgtttaggtgctacactggtgataatgtgttacagcggccagcagaaactaatacacttggaaacaatggctgtaacgcatccatcagtccactggttttctaacctgcaagtgttcaaagtgttgatttactttaaaataattaagccaggctctggggattataaagaccaaaaaattgtatctattatcattattactccccccattgtttttatgtatatatttattattttacttttcagctgttcttattkaattgacaagaatcagaaacaaattgagatggaatggtccacacagggcccatgctgagacaggcagtgtggctgacggatgagaccattggttagcsatgtgtttgtgtctctgttgtgccccttattcactgtcctgccmgragccagttagtggctcatctgtgaaatgggaataagaacagtcccaatatctcacagatcattgtattaatctgttttctttctctttttttttttttgagatggaatcacccaggctagagtgcagtggcatgatctcggctcactgaaacctccaccttccaggttcaagcgattctcctgcctcagggtcccaaatagctgggattacaggcacacaccaccatacccggctgttttgtatttttagtagaggcagggtttcaccatgttggccaggatggtctcaaactcttgacctcaagtgatccatctgcctcggcctcctaaagtgctgggattacaggcatgagccaccgtgcccaacctgtattagtccgtttttgcactgctatgaagatactacccgagactgggtaatgtataaaggaaagaggtttattgactcacagttccgcatggctagggaggcctcaggaaacttacaatcayggcagaaggcaaagcagaagcaagcaccttcttcgcaaagcagcaggaaagagaatgaaggccaggggaaacttccatttataaaactatcagatctcacgagaactcacgtgctatcacgagaacagcatgagggaaactgccaccacgggccaatcacctcctaccaggtccctacctgrcacgtagggattatggagattacagttcaaaatgagatttgggtggggacacagccaaaccataccaatcatcatgaggattaacaaagaggaaacactgtgcataaaacaccacgtgagcacaacacctgatacatagcaggtgcttgatatggggaagaaaatgacccatgggacttaagtgattttacaaacagcacacagtcaaagagcaaagccagaaatatcatgcaatcttccatcctctaacactctttccccagcaatatcctacatctactaccaaaccccgccatgtctcaaaccactgaactttggcccatattggctaaacagcaaagacaatcctcttaatttaacccattctcatggtagtctctgtaaagctgcttgaatatgattaagtatcaaatactgtcatatcagtagaactaaaatataccaagtagtatccctagtttccagcccagctccaaatttttaaacgacaaacctttttttttttttggtaatatttattcattgactattgatatttaactgttttcacaatgataaagtagctcattaagaaacaaataaagacataaaatcaaagtatgaagccaactgagggtcaaactgaatggagcgttgctgggcattaaggttacaaagaaagaaaggccttgccttgcttttagcaggcttagcaactttttcagggacctgggacacgaatattcaaaaaagaaagtgctaggcagtgtggctaaatggcatgattagaagggacagcatattcagagggaggtgcaatccctgagggctgaggtccaggaagagacttcgggaggagatcagacttggaggatgacaggggtgggagtgcagacagcgaccacagagctgacagcagcagacwtcgattgtgcacagaatgccagccactgttgcttggtggtttatcatctaaactctcacaaaagccctaagrggtaggaacaattacaaaccaaccaccttttacagatgagataattgaagttcagagaggttcagtacttggctagtgatcgcacaggtaggaattagcttgaactaggacccctcggtctgatcttgaaagcactcaagaggagytgcggtgactttgggtgacaaagcactgacagggagatagggatcctgagacgtgagggtccagggggtcagtctgcaatgtggagctgatgtggacccagtcatgagcccagccctaggcagcagggcatgggcagcaggggaggcaaggtaagtctgatgggccaggtgcccctgccccagtggctgggaggcgcagactctggaacacaggttacacctctcatttcagtgcttagaagagcagaggcagctgtacaggggaggcgcgggycacagcgtgacatgctcacaccccggacaggtctggagacagcctcctgaaaccgccctgggggccccagaagccctcaggtctccagggcttgtcactcaggcaccgaatacacttagcctaattggatattattccttcttcatgaagccaagcaggttgtcacctagttccctgggtaagacatttgcagcttcattttgcaattacatctccctggtatttgtcatggcacagaagtgaaatttctgtctctggtccccaatgtcatcttttccttctgtttaaaatctaggtgctatgccagttctttttttaatctgtaagttcttttccaccctctcccccacaaaaatcctgcaatatctgaccaattattttctcagtcacattaaaaatagatgccattcgcattgccactatggcagttgtgagcgctgctcataagtatcctgatcttcaattctttagggcacacagtaggactgcacttatctttcgaattggggcatgaccattgccttgctttcaccaatggattgtggggagaagcaagatttctgagtggaagtgcttaagccagacactaatcccccatgctcccttatattagggaaagaacagaggcacatgtaagagatggtgctgaggtcagcctggatccctgaaagattttttttttttttttttttttgagatacagtctcgctctgtcacccaggctagagtacagtggcatgatctcagctctctgcagcctctgcctccacggttcaagcaatccttgtgcctcagtctcccgagtagctgggattacaggtgcacgtcaccatacctgactaatctgtgttattagtagacatggagtttcaccatattggccaggctggtctcgaacttctgacctaaagtgatccgcccacctcccaagttgctgggattacaggtgtgaggcatcgggcccagccagatccatgaatgactttaaagcacagccccttacctcccatctgtggtcagatatcacgaatgggaaatgaattcaccatgctaagccactgagatccgggcgtgtttgttacagcagcacactccagtgcagctggcctgagaaaagccattttaagcagttcaagttccatcctgtgttccatgtctttctcaagaggttggcttttactttgccttccagcattaccagactgttcatgagttatcaagggcagaccaggcaggcctcccaaggggcaatatctatcctaaatcttgcgtcctttttggttcctctctatgctgcataccctctttcgtggacctaattcagatttgtagaacaagaaaatgtttctcaccaccttgtcatgaaggggacctaggtgaactcacccacatttcagctacaaaattcaaatgcagacacagcccatctatcagtcctcatgggactttgcagaatccaatataaactacagaggtagtcaaagaaggggttgttcctccatttccccctggcaaatcaccaccattcctggggcctggatgctttagggatcacagtaggattacacttccctgtccttttgaatttggggatggccattgacttgctttcgccaatgcaaattgtttcctctgaggttacatctattcctaccagcctagaytgatcagcctctgccctcagagaagaaatcaatccccccttttccatggagtgagctttccttctgtgacagcactagactgccaaagaagcagagagctgaaatgctcccagcagctctacagctgaggccaggtgctagcctctggaatgaggctggactgggcagggcagttcccggccctgcattccaaacaggatgctcacctgcttgctgctcccacatgcctttcccaartacaccaaataataacaaaagaagatgttcaaataaatagagctcccatgattatgtaccatggtagcaaataaatagagctaccaggatgttaacatgcattatctccagtgtccaaaacaaactcagctcagagagggtaggggcagttaatgacagagcctggatttgaacctcgttctttccacaccatattctggtccctcccactggtgcaaccttcctcccttcatgcatgttctttgagttcttctccctgctgggaagatcttctccaatcctagctgtgctgcaaagccaggttcccactgcaaagccactccgttattcattctcaccctgaactcttccttctggaaccacttctctacggtgttggtaacagagttagcacacwgattctaagcacacagtccagcakcctcttttttctatatttccaagacatcaatgtagtcttgacaatgcagcagcagcagcagcagcaggagcaacagcaactgccaaggtctgcaagtggcttcaagatgccggggactttattaagcagttcccaggtgtgatcgctctctcttgcactcatacactcagctcaaaggtcacctcagcaatgaagtcttccccaagaacctgacaagatcagtgctcagcacacagtaggcccacagcatgtatttgatgtacaagtgaacaaaaggaagaatgaatgaaaagagctcttcaaasccatgcctctggactccttgtgacgtgtgagtcccctgccacagccataagaagtctccagcggttctaccatcgccttcttgagaagtaacacccaccctagactcgtgggaaattggcagcgtgggaattaaactcacaatgtctgttctcttccactgagctgcactagggccagaacccaaaataaattcctttcagccctctagcctctcagtaggaatatctgaagtatctttaatcaaactttagaggctgaaattgcccacaattctaaaaatgcctccagttactatggatttatcagtgaagagaatgaaataaagaaaatttgtttcatagttaaagccaaggccactttatcccagatgtacttaaatcacttagctcttaacagaatctttaactataaatatactaaatttggtagtaggatagattaactacaaaaggaaattaacactgccttagagaatgtagataacatattaaaccacagataggctactttggagaattataactgggtagacctaacatttttaaatggatattagagatgatgaaatgccacttggccaccctctgaaatgcaattgaatttacattgattaaggaaaaacaggggaaatctaatattatataatgccttacattaaaaactttaaacaagccccaaagtggctccttaggaaacaggttttgggtgactaagcagtgtgtcattagccctctggtgagaaaacgcaggatttagttccttatgagagacagagaaagagagagagacagagaaagagagagagastgtgtgtctgtgtgtgtgcacgcgcgtgtgtgtgtcaggtttcaactgtgggtaaattagcacttgccttccaaagagaccagcagcaactacaaaagtttgcagggctttgtcattagcctgtttgcattctccaaagcaaactgacagtctcatgatgcagggcattaaaaatcctcagtggtatcgactgccwgaagccgatgcttccctgttaaatacagcatggctcaattaagagctcttcaatatacaatttaatttttctttcatcttgatccacagcctggctcaaaatgaggaatgctagaatagatgtactttgaatattgaagcaagtctttataaataaacctatcacccttgtaatgatttctgtcataacatgacaaaatagatgaagctcggcgtctggaacttcagctcacacgtcatttttccaacatcaccaggacccacaatttttttttttctttttggcttttctcgtacttttttccagttatctctgaataacattctgctgtttaagaaaagtttatcctttcttcttttcattccctgtgtggcaattcttcagaaagaacgaagaaaattactattctgctacttacatgtaagagaaagaaggtaacttataaatgaattatgaaggtcttacccttggaaagacatacatatttcatcataaatgtgatccattacacttattctacatacagtatttatatttgtacatgattattcaaggtttcttttttttttttttaatctccgcaagcccatactttcaaaagcaaatccaacattctcctttaacctgtaaggctcagactagaggatacaaaaggtactcccaattgactccacatgtatactctctctctggatggaaggtattagatttacaaagaatagcaagaatcatgggatttctcaaaggtgcacatattatacagaacaatgttcaaatacctgcatgagcttgctatgagtcaaggaggaagacgtttcactttggrcctaagacaatttcttatattgaaacatattcataaaaaacagacttgacaacagttaatgccttggatagaattgtgtagctctgacatgcatttctgacagttggcttgagctagatgaagaaggaacagggctctctctcccgaagtggataaagtatcagtggagcagcctaatacccattccctttctgatcaaatcattccagttggtcttttcgggctgcagagctccttgctgagatctcaggtaacgtcacagtcacatcacgacaacaaatgtaaacttatttaaaatttactggttttacccattgtatttgattttcatgttataatttataacctattttaaaaattcaaacagcatttcttatttttcaacttgatcactccctatttagcatgaaatagacattacacataaatatgcatatgtatatacattcaaatacaagcattcccaataggaattgacaaaaccacccacattttaaacacactccttccattcccattcttctttccccagatgctgcacttaatataatttggaaagawctaaaaaaaataaataaataaataaaaagctgtaagacaatttttaattgtcagagatggagcacttagaatttatagtaattaactagtcattatttcaaataagaacattaattggtatgttcagaaaatctgcagcactgcaaaatttaaaataaacattacaaagatatcatttacaactaatctatatttaccattgaagtgagcttcaaactatatttctttctattatgcttttattggctacagcacacagtaaatggagtgtgttatgcacagcttcctaaacagctaaatttataaaacccaattacataaattaattaggaatgaacgcatgcatttatgcctttgtttgcaactgcaacatattaaacatgacaaaattaataaagacaccctaaaagaaaaaatagtgccacgtattcatattccataacaggtttttatgagatttaatttgatttgtctagtcctaagggtcgtgactcttaataaatacgcagtttctcaccgtttcatatacatatgtaacggtatgtttttatgactcctaaaggaccaagaacatataaattcaagagtatttatttcaagattcagagacagaatggcaaagaattactcaaatgttatttctgccttcgttatctcctacattgttatcaaagacagctttttggtaattagaatgattcgccatcccctagctttattatagaaaacgtccagtaaaacaagcttactctgagctccacgaaggaataaaacattggcatatgatcaagctagccagaagagcactgctgaggccagatggagaggctcatgcctgtaataccagcattttgggaagccaaggcgggcrgatgacctgaggtcaggagtccgagaccagcctggccaacatggcgaaaccctgtctctactaaaaatacaaaaattagctgggcgtggtggcaaatacctgcaatcccaggtactcaggaggctgagctaggaggattgcttgagcccaggaggttgatgctgcagtgaaccaagatcacgccactgtactccagcctgagcaaaagagactctaactcagaaacaggaaaataaaataaaataaaataaaaaagcatggttgataacagaccctttttttttttttt

SEQ ID NO: 13418 - DNA, 21322 bp, Homo sapiens
  misc_feature (1)...(21322): n = A,T,C or G, or insertion/deletion polymorphism (see Tables 1-2)
ccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttyagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccayygttactgactbrctascttbnaattcacccccmgagtygggtgcaccagattgccctgasgatggaggttctgdgctrcgaggcacaggacctctactgagggtggccactgcagcacctgccactgcygtcacctctccctcctcagctccagggcagtgtccctccctggcttgcyttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttyttgccctccacccccataagattgtgaagggtttactgctccttccatctgcctgaccccttcactatgactacacagaatctcctgatagtaaagggggctggagrcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgmaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttrataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcrggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagggcccctcagggtgtggggccctgtagacctgcatagatcaaactcccatgaagccaatcctgagtcccaggcaagctgggacttttggtcatcctagcaatagtcatgtgagtgcaccatcttggaagtagatcctccagtacagtcaagctttcagatgactgcagtcccagcagatacatgactccaatctcatcatccactccaaaactaacctacagaaactataaggtaataaatgttttcttcacagttgctaagttggaggtcatttttcattcagctaaagttaacttatatgacagccatattctttttacaatggaaaagtcagacaggcatacaatgctcattttcagcttattcacattgtcactattttgtggggttacctggtgggcacaggacagtgaccaagtttgcaggtcctccagctcctgctggatcttttagcttctccaaatcctagaaaagttgtgtgtttagctctttcagaaaacacctgaccttctcatgcatgttactccaccatcgaagttagaagcttggagataacatgagactgatgcaggttttagtccatttcatgggctcttctcttttcaggcttccagtgtatacttgctttctccacttcmcctcacctttccttccacagaaaggtcagggtatggagctcatatgagggtttagaggaatttggctcaagggccagggccagcttcctccagtgtttcgggtcacaacctagatacacctttatcagcgcctgggaatgttcaaggtcctaattttcattcaggcctgttggctgggtcacagaatgatcaagccactccatgattttctagcatgacacagcaagaaactgggggagactggaggactctacaaaaactttcattttatgtatttcctggtagctctgttttctgatagaacctaactgagataccatttttgccagttcttctatggataagtattatttttttaatttttttaatattttattttttgtagagacagtatcctgctatgttgcctcgacttgatttgcattttttttttttactttaagttctgggatacatgtgcagaacatgcatgtttgttacgtaggtatacatgtgccacggtggttgggtgcacccatcaacccatcatctaggttttaagcccctcatgtcccccaggctggagtgcagtggcatgatcatagctcactgcagcctcaatctcccaggctcaagccaggctactgcctcagcctcccgagtagctgggactacaggcatgcaccaccacacccagctaatttttaaattttttgtagagacaggatctcgctatgttgctcaggctggtctcgaactcctgggctcaagctatcctcctgtctcagcctcccaaagtgctgggatgacaggcgtctgccactgtgcctagccagtactatttctttttaattagtttgtaagagttctttgtacgttaacaatcttaattgaatgtctgtcgtatatgctgtgaaattacttaatttgtcattaaccttttatcttttttaaacaatgttttgctatatgaaagctttacatttttatgttataaatttatcagcattttcatttatggctttgggttttatgacatgcttagagtagctttttctgcaccaagattataaaaatatccacacatagaattttctatcataaaagtatgacagaaaatgtcatattttgtatataattttattttttgtttagtcctggatccatctagaatttctattttgcatagcatggcaaagggctcacacccaacrtcatattaaataaggtctttttccctgatatgaaatgccacatatatatgttattataatgcatagttagataccatgtggtgaataaaatatcttagaattattcaagcctaagaggatagaactactgcaaggatgggttttggtatcaacacagatgtttatacatagagagaaaatgatgtctgtgtgcttagctgtcaaataaggagactgggggagggttaaatgtaatcartgatatcataaggagtggtggaattctgtttggaacttcagagacctaaggagaagactgaccagcttcttctgaagacttctgccctctaaagactaaggcctaattccactggtttctttgaattccgtggtcctaagtccattttcaggtaagtggtttcccgctggatgtgggtctctttaagccrtatcaaacagtaggtgagtgtatcagttataaatgtcttaagtaataggaggcccaaattataatggctcaaataaaagtatatttttctcataccatgcagtccagaagtaagcagatacaggtgttagtttagtggcttgaaattatcagagcaacttcaggcaacatttcttaagcaatattcaaggcagcataaagggaaaatggtagcaccatctcttttatcaagacagcaaaaagccttcccaaaagctatccatcagatttcccttatgtttcattatccagagctatgtcacatagccatgcctaacttcaaggatggctaagaaagggaggattcagctttttcagcttatctagttggatgtagtaaatgaaaaatgggtgggaacaatatctgccaaaagtcgccattcattcaaaaaatatttattgagcacctggataccctatgtgctaggtactgtttagcagtgaacaaaacagacaaaaatccctgcactcatagagcttacattatattcaggagatacatataataaagtaaagtaaaatatattctactaggttctgatgaggttctggagaaaaatcaagcaggtaagacaattaggaagtttgtaggagggtggtacaattttaacaatgggatctaaggaaaatcctcattgagaaggtgatatttgagtacctgacagaggtgaggaaataaattctgagaatacctgggggaaaagcattccctggaaagggaaaagcaagttaaaaagccccaaggtaggaacatgcctagcttgttcaaaatgaaatgaggctaagttggagtgatgatcaagaggagactcataggatatgtggtcagcagtaactaggacataatctgacctacaacctaccaagatctctttggccactcactggagaagaggcttaagggaggcaaggacggaagcagaaagacagagatgatggtgggtagcagtggaggtggtgtgaagtggcaggattctggatacgttttgtaagtaaaggtgactagacttttctgatggataaagtgtatgagagaaaaagaagagtcattactatatatgtaaatctaagcaaacatttactttttaaagcaayttaaagtttgttacttgaatatataaaatatatcatggagttaaaaatatatagaaatttattatatttggtatctaaagtagtcaaattcatagaaacaaaaatgaggagctgtttagagtttcagttttccaagttgaaaaagttctagagatctgttgcacaacaatgtgaatgtacctttttcagcctgaacaggtgaaagagtttctactaattgagttggggaagattgaaaaggtatcaggtgtaggaaggaatgtcmggtatctgacctgatagagcatagtcaggttttgttttgttttcttggaggggatatattttgctttggaaactgaccattttcaggagtcacctgtgtaagtcagtcaattgtccttatgttcgtgatggtgagaagatttttggaatatgagctaaaccatcattgtctaacttttcagacaaagtttctgtggaaagacctacggacaaagacatctctccttggcagagtgagctaggattaccagctcttcagccgcagctgaaggcgggagtccatggaaccccagaagctgctgayaattggatttctgctatgctctctaacttgcctcttgttggagacagtagcttcctctcctttgcctttgtctgccttgggaatacaagaaaaaacaggatcgaaaccacgctcagggggtgtgtttgctgttaggatgaatgtttctttcttcataggacttaagattcatgtttcagttcaggtcaggtaaaatgaatttcatgtttaaaaagaatgttcataggaaagcaaactattctggtttggttcaatttagttcaacaagcattaacctacctactacgtaccaagcccttttctgaactacatggattaggaattgaacagcctctgttatgaaggagctcacagataggcagacaaagccatagatgccaaccttccatggagtatgatcaatgctcccaggggacaaggggataatttaaattgttttgggggaggggtcaggaaagacttgacaaaggaggtgaaattgaaaataaacctgatggtccactgatccacaatctaggttccaacatgcacacacatgctattcaagtgtcttgctggttagtggtgaatcctctcaactccatgctgcagacactttcgttttcccctccttctttcttcagggtcaaagcactgtaccttcctcccccagttgctaatgaaaagacccaacatccccagccttacattgatcagcaaactccccctagaggtccttcttccagtggccctggcccctttctcctctgctcttagggctggtggccttctcctttctcttcctgggatactccctctcctcagcctcctgcaggactcccagatatactctaggcaacaacacyttagtaaagactttcttgttatcaagtcatgcttctctttcaaaaagtacccaatatactcaagatatccgaaacaacaattattgttcctatttgacttacaaggaggcaaaaattatatccatctcaggatactttaaaaacaaaatgtttgccctttgaacatcttacagccagcacagcaaagtagtttagaatatgggctctggacaactgtaagaacatgatatctgggacaactatttgaactcgaatttggattcaaacgccagccctatcatttacttgacctctcctcaatgaatgtctatgctctttctgcaggtaatcacaggtcctggctgaacaacttcagggattacttatggcaacttatcaagagtgccttacctccagcagccattgttgcttttcttctcacctcagcactaatggggatcctctgctgcttcacgtaagcttctgtgggaagaagagacagggaggagagagggaatgtgaaggggggtgggaacagaaacaggttgctcaccagcctgcatatctgtaattaagggaaagttttaagaaattcaattctgggaggaaaactgtgaaaggtcatgcaacccccttttaaaatgtctactttctcttttacttcctccaacttgctccatttgttaccagtgactgacaggtcacatttaatgactagtgtttccaatggtcatttcttttatcaactttattaactcctaatttttcttccctgtggctcaagaactatacatagaaaataaataattagctgtgctctcaatttcctgraaatttatcataatatttatctacataaatcatatgaagccaaaagaatcctgaggaaaacaaaatagttgagctaaattttgttaattcagtcagtatttaccaacaaatgactacttgcttgtctctgtgcttgttgctagaaaggcagagaaagaagacaattaaaaattacaaattggtaggtcattgctattgtgggagacagagtccaagtggggagacctatgaaagtgatcaacaaaggtgttaaagagatgaggtcaggaaatagttggccagtttgcaagaggaactaaaagggaatagagaatagaaatggggggtcctgcagagctcaaaaatctaatraaagtggctgaggataaagatcagattaagggtgtggcatcacctatggctcctgtaacctcaaaatgatcacaggatcaagaactgtgtctaggaagcaaccttggatgtggttactggcacatggaactgattgkagacaaatagattagaagtcagctaagcttttgagagaagcttattgccagagaaaccataagccagaactaaatgagccatctgttgtaaacaatagttaggcctccacctttccatgaaaaagaaggacaccagcttcgaaggtcccaacatttgcttcagatgcagccatagagaataatggatcagtagagcctcccagagaatggacaatgggccacagagtcaccctttgaaagcaggatttgggcctaatccatgcctacctaccaggactccaggattgccacagagcagtgactgctgtgtgtctctcattcttcctatttccaaatgggaatgtttatggtgcttatcctcttcctgttccatcattattctggggtgtggagatcaggagcatataactcgttttagttcataggtcacttaaccaagcagagccaccctcagacttgagagaactaagcatcacccagatactctggactttgagctggacacagtgatgagtgtgacttagtactgaggaaagggtttgccacaagtcaggtattctgaaactagacagggagaccggmatttggcattcagagtataattaatgatcaatgcctgtggaagatagggggtggaagggagaaatcaaactgccttgcaagcccaacaaagactcagtcggccccatcagggttgtcccacatggctgaaatggctggacctctctaaccccacctcagtcattcactggatgtgggctgcccccagaaagtacatggaagctctctgcagctgaggcagactctgaatgagctgacaggtagaggctttctgctgacaacactctcagcagctagggaaataaggcctttctcaagcggaaatatgggtggaatatttccatatgcatgacagggtggctgtgttccacgtatgaaaggaaaagtgaaacagatactgggtgatcagaaagacagactgtaacagagactggctatatgttcagcaatcctgttccttcttccccaagcacagagtaacattatattcttaaccttccttccagttaggctgggaccacagtactgagatttggccagttaaatacgagcaaaaggaatgtatgacatttccaggcctagccataaaatgtcttgcacatgtgtccatgctgcctctctctttcacatatgcagggcttcaactgaaggactctaagatggtgaarccacatgatggaaggagctgggatccctgaatcaccttgtggaggagaacttaacttacatcagaatgaggcatgagtgaaggatcaattttattgtgttaagctactaagatctcaggattgtttgttatagcagctgaatatccctgactagtatacctagcaaccaaccaagggagctggaactcaaatcaagatatgtctggttccacatctttgaagtcattgttactcaaactgtggtcagcaggtcagctgcatcaaaagcatctgaagtattggttaattaatattcagagggacttctgtgaagataaagcaggcaatatgccaagaaaaagaattccttctttgaagtagatggcttaacctgaatagaaaagccaataagcccttgctgggaacaagcaagctaactagtgaaagaaacatttctggacccagttgggcaccaagtagaagcctaacaggtaaattggaatgaataagcatataggcaagccatatttttaagaagcagtttgttgaggcaagaaggtaaagtctgaaacttctttatgctcagacctacatctgctgctctcacttgactggaaagaagtaaaggctacaagagctcacacatacctcagcatcatgaagagaatttgttagtccaaagtatagctctggacttgtgcacatctcctgtaaataactggtccagtaagagtttacctcattcaacaggaaacagcaccagatctatgcagagttactatatggaaaacacaagaaacgtataagcaagaaatggcagatgaggaatactcactagaaaaatatctcagggcagataaaaaccatgtactaacatattgccataaattcaaaacatttgatacaaaatataaaataatagctaaggtcgggcatggtggcacatgcctgtaatcccagcattttcagaggctgaggcaggaggattgcttaaggccaggagtttgagaccagcctaggaacatagcaagacctcatctcaataataataatagtaaatgctatatgcagaaatacaacagggcagataaggtataccaaaacaaaagaagaagatgaaaattagttggaaaatcccaagaaaaatgtaaaagacaaaaagtaaaactatcaccaaaatgaggaagcatgaagaaaaagagacattggtgcaaaatatgaaagaaaatatggaaaataggattatataggcaagcagtattaagtaaacagtttggtgaaagtaagattagagaagaaatggtagatgcaggaggcrcagaatgatttcttcgatgaagagaaccaaaataatccaacagaagaaaaagttataattttttctttttcttttttcttttttttttattgttactatactttaagttttagggtacatgtgcacaacgtgcaggtttgttacatatgtatacatgtgccatgttggtgtgctgcacccattaactggtcatttagcattaggtatatctcctaatgctatccctcccccctccctccaccccacaacagtccccagagtgtgatgttccccttcctgtgtccatgtgttctcattgttcaattcccagctatgagtgagaacatgtggtgtttggttttttgtccttgcgatagtttgctgagaatgatggtttccagcttcatccatgtccctacaaaggacatgaactcatccttttttatggctgcatagtattccrtggtgtatatgtgccacattttcttaatccagtctatcattgatggacatttgggttggttccaagtctttgctattgtgaatagtgccgcaataaacatacgtgtgcatgtgtctttatagcagcatgatttataatcatttgggtatatacccagtaatgggatggctgggtcaaatggtatttctagttctagatccctgaggaatcgccacaccgatttccacaatggttgaactagtttacagtcccaccaacagtgtaaaagtgttcctatttctccacatcctctccagcacctgttgtttcctgactttttttttttttttttgaggtgaagtctcagtctgtcacccaggctggagtgcagtggcaccatctcggctcactgcaacctctgcttcccgggttgaatcgattctcctgcctcagcctcctgagtagctgggattacaggcacgcgtcaccaygcccagccagctgatttttgtattttttgtagagacggggtttcaccatgttggtcaggctggtcttgaactcctgatctcgtgatccacccgcctcggcctcccaaagtgctgggattacaggcgtgagtcaccgcgcccagccaagttataattttttaagtgttgcagaaattaaagaagactggagtctgtggtcataaaggacacatcaagtcccaggaaaaattgggacttgctactgggcacatagtagactctcagtaatacttgttgatttttaattaagacatttcacagtgaggattgcacacagcctctctgtgcctcattcttcctcctctatactcacctgtgtataccattagctgcagctgtaatgaaggcttaagctagctgcttattacctgaggcacatggaagcttggctaatctcccagcattccagaagcagaggtggaaatcaggaggactgacaggctctaacaagtccacaaagatatgtgtacaaggaatttttagtatggtttacgatagtgaagaaatggaaacttaaatgtccatcagtctggggctagctaaagaaagtattgcacattcatacactgagtactaaggataattacacagaaacatattcatgaaatatcattgagtggaaaaagcagattataacagaagatatatagtttagtctaatttcttattaaaaactaattgtatagggggaaagcctctaagaacctaacccaagtattagacattggttatctccttgtggtagtgaataggttgttttattactattggcggtggtgttaacttttgtttttcctgtctaattgcactttctgatctttcttttttttctttttctttttttttttttttttttttgagacggagtctcgctctgtcgcccaggctggagtgcagtggcgtgatctcggctcactgcaagctccgcctccgggttcacgccattctcctgcctcagcctcccgagtagctgggactacaggcgcccgccaccacgccaggctaattttttgtatttttagtagagacggggtttcaccctgttagccagaatggtctcgatctcctgacctcgtgatctgcctgcctcggcctcccaaagtgctggaattacaggtgtgagccaccgcgcccggcccactttctgatctttctacaatgagctgtattgtttgatcagttcatttttaaaaagatactttaaaaacaaaagaagaaaaactacctaaccatacttataccactacctccaagccccactgtactggaaacacattcttattctgctttttcatcaaagtattttgtttgtatggaattatttggttcatattaagagaaaaactggtgtcaaatccaatctttgaaaaggttatataattatatagcaactctgtgcagagcattcaccattttatcttcctttcccagcattcttgtagttgatccagtccactgaagaactagaagattcaacagggcaagtgtggtctctccagttggactccaaaagagtggggcatttgctatctgcttaaaatgaggaagtatctatcagttgaaattaaatcgtcttccaacttgaatcatcctttgcyttcattttctccttcaaaagttgcaattttaaaatgtgaatatccttattactgttttggttataatagtaatacatatttattgcaaaaaaaatttgagaaatacagagaaaagagtaagtttccataattctagcaaccagaaataaacatcattaacatcttgatgtacctcccttcaatttttttctatatatgtattacaagttttccaaagtctgttctgtgaaacaatagttctgttttaataaaagtcacaaaacagtgagggccctgtggtcagttatgtttgggaaatgctggattaaacaaatttaaagctatctttctttgctcaaggacttctaagaacttttaacaggctaatactaatctccacaagggagtataatatatagcatttcccaaactaatttaaacatgagcttttttttttaatgtagtggagatgacataagtcatttaatgacctctccatataataattatttaaggtatttctatttattgactattataaatgtaatacaggtaatattattaaaaattattggctgggtgcggtggctcatgcctgtaatcccaacattttgggaggccgaggcgggtggatcacctgaggtcaggagttcgagaccagcctggccaacatggtgaaaccccatctctactaaaaatgcaaaaattagctggccatggtggtgagcccctgtgatcccagctacccaggaggctgaggtgggagacttgctagaatccgggaggtggaggctgcagtgagctgagatagtgccattgcactccagcctgggtgatagagcaagaccccgtcacaaaaaaatatatattaatttgcttttcctttttgctgttctgagtttgaaatcattcattcaacagacacttgttgatcacctactgtgagccagacactgaacaggtaacaaacagacggggtcttgctctgtcacccaggctggagtgcaatggtgctatctaaccccagctcttgtggagccaccatgctaatgtgaagattcagagaaaccagattaagcgaggggcagagtagatattgtgagccattgaaaggatttaggctcttcctgggggccatagtgggggccaacagaaggtttagatcggaggagggatgtgaagggagagcagatgggatttgattaggatttggatgagatgagagagagagtgaggcttcaagcatgcctccgaggtttttggcccaagcagatgaaagaatggggttgtcatttattgagctagagaaaactgcaggaggttaggaatttactacagagaaaatgcaaagagaaagaaaaactgaagtgaaattytaattgatgctgaggtgagatccagtgggctgccacatggcctgtcatgtggcctgctgtggcaagccaaggtgaactcagaaaagacttggagttttgcttaagtccaatgtttcctttttgactgtctttctggatgatgcgtccactgttgagaatggggtgttgaagtccccgtgttgctgtcaatttctcccttgtcttctgtaaatatttgctttatatatttagctgctccaatgttgggtacatacatatatatatttacagttgttatgtcttcttgatggattgaccccatgaaaggaaaataaatcgcccccaaatgaccaagcgaaagggaaaagtcaagctgggaagtgcattgggcaaacctgcctcctattctattcctaaataagataactacaaagatttttttttaaagctacataccttcctcacaatttgcccatgaagaaattccttgtaaacaaaggacaggcagaactcaaagtcatccctctgctcacatgagacaaatgcatatctgattgcttcctttgccctattgtttcacaaagtcagactaaagcataagtgactcttcctgctctcacatgtaaattgtgtattcagtgaaaggctaatcagcaactcaaaagaatgcaaccatttttctcttatctaactatgacctggaagccccctccccacttcaagttgtcccacctttctggaccaaaccattgcatatcttacatatattgattgatgtctcatgtctccctaaaatgtataaaaccaagccttgggcacatggcatcaggacctcctaaggctgtgtcatgggcatgtccttaaccttggcaaaataaactttctaaattcactgagacctgtctgagatatttgaggtacacatttggtgaccacaaagagactctgagtggaggtggccctgacctttgacaaatctcctatcagtacttggtaccaactcgagctatctttatggctcaaaccaatagaacaatttgctgaggcctgggagctcccctccctccagagaatccctcatctcccaaaatttggttgagatctaaagtttattttgctgtacaactccttttctggagttttgcttgcttccaacaaggaaggcaagttttcctgcttccatgacaatgaaaggcaaataactgcattctggaatttgagctcacttccaacagggaaggtgagtttgagttttttcctacttctgggatggtagagagcagtcttcagcctgagacccactcctaggtaagtagctgaattggagttttctcttggctaaagttatgattcacagtcggctggtcttaatttctccttaccattagaggactcagtaatcatattgttggggttcttttgttgtttgttccagtctttctcccatcagatttggccaattctacctgacttggtcaaatttgaatgagaattccaaatagtgagtaacaaggtatctctgaattggctaaaattcctcgcagctgcaaaagagaaaaaaatgaccaaacatgcagttggtttgtgtgtttgctccctgtcttaaaaaaataactgttctttcgtttacttttcttccaccctattcctccttctcccctcgccatctttggtaccaagaagaatataaagaaggcatctaatgactctaaccctttaaagaactcaggacaaaggcaccgttcactcctttggggctgttctgttttctttgtggagkttcaagagtcatgggcagattcttcttaggtgtaaagctctgctctcctgtattgcattacctgacctctttggcttctgggggtgaagtggctacattgtctggggtatacaccctggggttcgttgtcatgcaccaggaaaatttaggacatggacacacacaagtctaggagcagaggtttaatgagcagaagagaagagaaagagaagcagctttctctatagagaaaggggtctcccggtggaaaggaccagcgggtggtggatgcgccaaattttagtcaggtttgaggaggtggtgtctgatttacatagggctgacagattggttcgatcaggtatgacgtttacatagtgcgggggaaggctggtggccccagctgaatattattatgcaaatggactttccagttgattggagccatcttgcctctctatgtctgcagctgaactttacaggctgctctttgttagaaaatcatttgrggmtgcttttcattaaaaasaaaaactttactgaggatccccatacccttactgtctgcctaagtgatttcttcttaagtcctgtatcaggggtaccagagattaccttgtcctgtgagaggatttgaccttggcatgtgtaatagcagacaagagctacagttaaaggtggccgaggacagtttacagaaagtggtcttggctgggcttttttcctcctaggaggttgtttaggatctcaattctaattcagaggtgcattttaaagagtcttctccattgcctttcctgcccaaattaatctccattggcttgtctgcatatttgcatgaggaactgcactgtcactttcatagataaatgagagactgagtttcctcaaccccaaagagaaagggcattttgctcmtcccagtcaaaaggtgctcctgggtgactggaggccaagtgggagtgtctgggggttgcctccatgtgatgtgcagtagccctacagggaattgccaacaaaattagttttaaaagcctcgtccagggagcacatataggagctgctcaccccaagctttgagccctcccagaggtgctagacctctggagagagaaactgagacacaaaagagggccgaaacaattcagtggtgatgcattgtggagtcctgtccgcaaccagcacactttgacccaccacactaaaccctaggccacagctcagttcctccttttaagaaaaaaacaatgtgggaaacacatcatctaagaataaggaaagacaaggagaacaagcccccttggaagcccatttggtttcatggctcctgtactcgcaagtggctgtgtaaatggaagggccggatttcytacgactccagctgctcacgcgttaggtctgttmttgtgcacgttttaaactgacaggcagattacatcaaggaaaattccgagcctgaaggtcaatctgcaactataaagctcctgagttctctatctctctgctttcttttctgcctgctttaagtctgttgttacttttctactgagataaaatccactgtttgcacctaaccgtttctttttgttattgtttttgcaaaccaatgagttgttattaatatcgcatggctagagttctgaagtaaatgctctaggatatttgtttatatgagtgtgtatgtgtgtgtgtttacgtgtatgtagatgtatttggttatatgttttctgccacaaggtaccaaatttggcttaaagagtactcataaattaaataataagcccaaatgcttttcaagctcacatgacttaagtagagtttttactaagctagctttaaaattattggtagagtaatattacaaatatcttcagaaatgtcagtatacatttttgtttgcatttattgatcaagagatttcatacttatccctgccaaatattataaggtgtcaaaatttgtcataaagcttattttattttattttttgagcggagtctgcctctgtcgcccaggctggagtgcagtggtgcgatctgggctcactgcaagttccgcctccggggttcacgccattctactgcctcagcctcccaagtagctgggactacagatgcccagctgatttttttgtacttttagtagagacggggtttcaccgtgttagccaggatggtctcgatctcctgacctcgtgatccgcccatctcggcctcccaaaatggtgggattacaggcctgagccaccgtgcccagctgtcataaaggttattaaacaataaacccagcccaaaacagaatgatctttgcttgtgtaatctttcacaaaaaagacattattattggtttaatgaagacagctaaatcctgaattatttggtaaaataaccatgtattcaatcttaagattctaactcagataaatgcctgaaattcacaagctataaaatggttgacaggaaaataactttggtgactgttgcagttttcataaataatctaggtaaactattaaaataaaataattaggtaaatgtgatgggataaatacttgtagataaacttgccatcatttagaatctaaagttaaataataggtatttcattaaatgggtgttttctaatgaaaaaatatgtattgtaggaaaacattttttctaaaaaatgtgtgtgttcttgttaaagggtgagtaatttttgtctaattcaaaggttatttaaaggttatgtataaaacaaggtaaaaagaaccgggaaataagagatatgtaaagaaaggtatagaaatgaagtatttttggtaagaaagcttaaaaataattttatatgataaagaatcttatatggtaattttttgtcccagaataaaatgattgtttatttaagaaagagggaaggtcaggacaaaccagaaagtccaagcatatcatgaatggtctggccacagctcagttcctccttttaagaaaaaaaaaatatgggatcaaatcttatatgatcggtgggtctcagcagctcgggtggcgggaggagtggcagcggccaggcagcccagtttcgcgaaggctctcggcgcgccgcagcccgcaggcacccggcacacaccctccctgccaccaggatgcccaagaggaaggtcagctccaccaaaggggccgccaaggaagagcccaa

SEQ ID NO: 13419 - DNA, 27403 bp, Homo sapiens
actcctttaatgtccatctactaaactcatctgtgtgcttgcttgcttgctttttttttttttttttttgagacagagtctcactctgtcattcaggctggagtgcactggcaccatcatgactcactgcagccatcatggctcacagcagccttaacctcccaggctcaagctatcctcccayctcagcctcccaagtagctgaraccacaggaacgcaccaccatgcctggctaatttttaaaaatttttatagaaatggggtctcggccaggcgcagtggctcaygcctataatcccagcactttgggaggccgaggcaggcgcatcacgaggtcaggagttccagaccagcctaaccaacatggtgaaaccccgtctctactaaaaatacaaaaaaattaaaaaaattagcagggggtggtggtgcgtgcctgtaatcccagctacttaggaggctgaggcaggagaatggcttgaacccgggaggcggaggttgcagtgagatgagattgcaccattgcactccagcctgggtgacagagcaagactccacctcaaaaaaaaaagaactgaggtctccctttgttgcccaggctggtgtcaaactcctggcaccgaggrtccacctgcttctccttccaaaagcattgggattacagacatgagccaccatgcccggcctgtgtgcttttcagaatatcatagtcaacactgaattgtgtgtgatactgagaaagaggtgaagtatcataactgaaaatgcaaatgatgcagaaataacatctgctgcaaacttgtatcaatggcaggagaaacttcagtgccatttgtagatgatgacactatggccctgagctcccacatggagccagtgaatttcagtggtctcacttccatcccattsctactttccctctttacgttcgaaaatgtgtttattatacatgtatctgttattctaaaaaatttccttcaaatagaataagaaatcaaactcaaaacagctgcaggagatggaggtgtatctggtgtttctctccatctcccttctcccagaggaggacctcakgacctgtagctctctccagcttctcccaggagaaaggaggatattaaaggagtggttgcaagagggcttcccagcaccaacattaaacaagggaaatgcagtcccatgycaaggctgtaatcatacacagcaggagcaacctggtgaagaccaagcaggcagggtctggcaaagtagctargccatcaggcagagtgcagatccacccccaggatacagaagagaccctgtcacaagaycccacattcacattaagacagctaagatgcagacttctgctgcctttgaaccaaaccaaaccaaaccaaacccactcccagctgagcacacccactattagaagcatccccacactcactgtgagccccactgacctccagggatttgggctgtgggtgtctgtggaacccragtggaacctctgctccagcagctggggctttgtttcacttaatcaaatctttaaatgttatagagatgagacaattattatatttgctttctcacccttttctaccctcagttccactcaccccaccctgaaaactagtttttattcaagataaaacttacattctttgttttctatccataccatttcttcagaatccattttggtcaaaaataatttaaactccactggttgcaccagayacatttcaatataacktcccaattttaaaactttactatcaacaaatkcaattttctttagaaaaggagatttttaaaattctacttagwctgggcacagtggctcatacctataatccaagrggatttaggaggccaaaacaagtaaattccttgggcccaggagtttgacaccagcctgggcaaaatagtgagactccatgtctaaaataaaaaatttttttttagttagacaagcaagatggcacattcctgtggtcccagctactcagsaggctgagattagaaggatcgtttgggaagctgaggctgtagtaagccatgatcacagtattgcacttcaayctaggtgacagagaaaaactctatcttgaaaaaaaaagtgtattaattaataaaataccatatcaatatacgaaataatgacamtttagaagggttagtgattgcttgggtggtaactgaaactgactttggaaatctcactctcaagtcacacacgtgcttttcttttgctttcagttcctccttactccaccctggttttctacctcattgaggcttccagtccctaaactctatttttctaaagacttatttttcaactctctctcaktttcagtctttcatgttatcaaactgcaacacacacttatcacccactgaccatggtttcattggagctttccaacctcctcatcatttttgctaacttgaatcattctccaacctggaactggagaacatttacagaaataagctaatagtttagttgtctcccctcactgaataccaccttccccccagaaagccctcttatcactatattatggacagagaacctcagaggagctactccatttgcccaagtcctcctctaggaargggtagaactggaatttgaaccccactacatgcactggcccttgcctcccacctcctcggctcctgtccaggtttgacagcaagtctggaggaaatacaggaacaaagcacttaactgcactgggcattgccatcrccacctgattgccttaacctggctcctctctctttccattcctagtcctagaaacttttaaaggatcctctgagtgtctgacaatcaccagggcccatagagctcagaaaatgccctcccatgacwccrcttctgcaaatcctccaaagctgcttctttggaataagctacaaggttaacaaacwattgttttttcagaaataggattataaaatgtgagaacacaatgcactattttgaaacattgaaaataccatatctggccyggcacggtggctcactcttgtaatcccagcactttgggaggctgaggcaggtggatcacttgaggtcaggagttcgagaacagcctggccaatatggtgaaaccccgtctctactaaaaatacaaaaattagccrggcgtggtggcacgcacttgtagtcccaactactcgggaggctgagacaggagaattgcttgaacccaggaggcagaggttgcagtgagtgawgatcatsccattgcactccagcmtgggcattacagcaaaatgctgtcaaaaaaaaaaaaaggagagagagagaaaagagaaagaaagagagagagaaagaaagaaagagaaagagaragaragaragaaagaaagaaagaaagaaagaaagaaagaaagaaagaaagaaagaaaagakaaagaaagaaagakaaagaaagaaagaaaataccatatctaagggatatacatctctgctgctaattcaagttggtttwtagaatatgtgtttctgggccaggcgtggtggcttacgtctgtaatcccaacattttgggaggctaaagctcgcagatcacttgaggtcaggaggtcgagaccagcctggccaacacagtgaaaccccatctctactaaacatacaaaaataagccaggcatggtggtacacacctgtaatcccagctacttgggatgctgaggcaggagaatcacttgaacccaggaggcrgaggttgcagtaagccaagatcgtgccactgcactccagcctaggccacagagcaacactctgtctcaaaaaaaaaaaaagaaaagaaaagaaaagaaaagaaaaagaatatgtatttctagggtaattacagtttctggttcactcatcactctgtatttatttccattctacaataaattctggcaaacaagaggcttctccattgtcattaatttctcaggggatatcttagaaatatcctacaagtagaaacagactttggttttgaaatttgtcaggaataactgtcagaactgtaagagtccaagcagtgcatgtggcaccttacaattatcttcatattcttctrgaaaaccacagcaattaaataactttcacagagtccaaagagacatgccacagaggtcaaggcacctgtcatctgacttcaggctcctggatctccaaacctcttcctgygcaaactccacagccaaaagaacacaggtaccccaygtggcacaagcagccttcttctaaaagatttcagaaaattaaataagcactagcatcatacctgtaggctaactacatgcccttcatgcaaatacaatctaactttatttttttgaggcagcatctccatctgtcaccttggctggagtgatgtggctcactgcagcctcagcttcctgggctcaagctatcctctctcttcagcttaccaaatygttgggactacaggtgcacaccaccacatccagctaatttttaattttttatasagacagggtcttgctaattgcccaggctggtcttgaacttctggrctcaagcaatcctcccatcttggcctcccaaatttctcggattacaggcataaaccactcactcaaaccacaatctaattttttgctctacaggcttccattctactcagttactttctacttagcactttagatgtttttatcctcatttttacawctatcccttgatattttctatgtatgtttcaaaggccacaaagaggttaatgtaaccattckcccaggctcccctgataaagctgaactttaaatttaggttttctgaaggccaagtccaaggaaatcttctacataggaaaaaaacaatcaacccaagaagaaaggtgtaaaacatcagccaggaaggacgtccagcctttcccatgccattgtccctgttgttcttgggggaacctccctccgcattagcagaatatgatcagctattctagcttcccaggaagtgtgcatgaggcctttctaattahtgtacttgttaaaaacataaacycattaaatggtactacttattctgaatttgtgttaattactyaaactatagytcattaataaagacagtttattatagacctaatccttatttttcaactgctgtcaatcccacatttcaaatcagaaagtgggatttgtagycaccattgcatctgtctactttgctactttcagttcaccatccacgtctaccctcattttaactggacttacaataggtaaagatgagaaaggagattcaatgctgaattacacaaaagtttagaaaaatggtttaaacattgcagctttgttctatattctaggaatctcgttccattatgaatatccaaaccacctcccctcaggccataatgccttgcacctaacaggtgcttaaatatgtatatttgtgcaacaaaacccaaaatgaacccaatttttgttttttctttttctttttyttttyttytttttttttttttttttttgagacagagtctcactctgtcacccaggctggaatacagtggcaagatctcagctcactgcagcctcctcctccctggttcaaacaattcttatgcctcagctgggactacaggygcacaccaccactcctgrctaatttttgtatttttrgtagagaaaacgcttcaccattttggccaggctggtcttgaactcctgacctcaggtgatctkcccgcctcggcctcccaaagtgctgggattacaggcgtgagccactgcgcctgactccaattttctaaatctraaaaattgctctgaaattagttaacctgggaggcctatcttatttgaggagctctcaaccaaggagaaacctcaagtcactctacacttgaycctgagatctcatatggctccctagtgtattctagaacagttgcttctcaaattctgatgtgaacaagagttgccttggaatcctgcctactgcagattacagtgctgcaggtctggagtggggctgagacttcgcgtcttaacaagctgctctcagttgatgctgatcctcatggtaccttggttcccagaccccattttaagcagcaaggctgcagaaaayagatgccctaggttaaatatgggggagtcctctccatggccaggcctggtaccagcgcccacaccaattctggatagctctttcccatctgttatcttcttttcacacgtggaaaaaaccttgcgccatggatctgaggatgcagcacacaatcctctgtagggaagctccaaattagacccctagtggaggaaaatttagatcaacagggacaggacccacctcagtgtggagttaggtttaaccacaaagtcttagacatttattattcatttcactttactttgaggaaggactcgttattggttgctctgtacatgttaaaagtcaaggatggggccaggtatggtggctcacgcctgtaatcccarcactttgggaagccaaggcaggtrgatcacaaagtcaggagttcgagaccagcctggccaacrtggtgaaaccctgtcactactaaaaatacaaaaattagccaggcatggtggcaggtgcctgtaatcccagctactygggaggctgagggaggagaatcgcttgaacacgggaggcagaggttgcagtgagctgagatcgcgccattgcactccagcctgggcaacagagcaagactctgcctcaagaaaaaaacctcaaggatgggtaacgatcaatgactttgcacagaatcaagggcccataatggcacactgtttctttgtttaaaatatcaggacccagaggagaaagagagctcatgtaccatttggcatgggmtacacagtgatccatagtaccttctaatgtggatgcagaacttttaacatataagactttgacatgatgttggaatcatggtctgttaaaatatgaagctaaattggtgttccaggcattgtatgggttgcatacatattggcatgcacacacatacacacaatgcacacactattaaacttctggcaarcaatgacttttgacccaagcagagagaatttggaaactgaaaggaggcaagagagggtgagtcacagttaacatcaatcaaaggtccagtgtcaagccaggctcaacagcaaagtctacatatttggctccaggacaaaacatgatacttgatctcaacttcttttctgttgacctcaaataaagttttcagtttccgaacattggaatactccctctgagtctaccagtctatgttggacagacaagaacacctgtttagttctaattttttctttctttctttctttyttttttttttttttttgagaygaagtttcactcttgttgcccaggctggagtgcaatggcgatcttggctcactgcaacctccaccttccaggtacaaacaattctcctgactcagcctcccgagtagctgggactacaggcacacgccaccaccatgcccgcctaatttttgtatttttagtagagatggggtttcgccatgttgaccagtctggtctcaaactcctgacctcagatgatccacccacctcggcctcccaaagtgctgggattacaggcgtgagtcaccacacccagcctagttctaatttttacatagaagaagacttcttaaaataattacgggtttttatttcattcaaaagcactaagaggccaggagcggtggctcacgcctataattccagaacttttggaggctgaggcgggcrggtcacttgaggccaggagtttgagaccagcccagccaacatggcaaaaccccgtctctactaaaaatacaaaaattagccaggcgtggtggtgcacacctgtaatcccagttacttaggaggctaaggcaggaggatctcttgaacccaggaggcggaggttgcagtgagccaagatcatgccactgcactccagcctgggtgagagagagagagagagagagagagagaaagagaaaggaaggaaggaaggaaggaaggaaggaaggaaggaaggaaggaaggaaggaactaagagaactcaatagcactctgtcagagcatcattatccaaggaaacaatcaaagtgactacataagatatgtgaacgtgacttacgcacctttgtttttctcctactagagttagttttatgtaaaaacttaaatgatcaaagatattaggtatcctgcattcacaattacttacaaaaactgtgcctgggaaaggagcccagtgatcacttgttcactgtgtgtgtctgggaaaaagtacatagataatatataagtactatataaataawtttttttttttttttgagatggaatatcgctctgtcacccaggctggagtgcagtggcgcgatcttggctcactgcaagttctgcctccctggttcatgccattctcctgcctcagcctcctgagtagctgggactacaagtgcctgccaccacgcccagctaattttttgtatttttagtagagacggggtttcaccgtgttagccaggatggtctccatctcctgacctcatgatccacccrccttggcctcccaaagtgctgggattacaagtgtgagccaccacacccagccaataaatgctttcttaaagcaatttacagaattctattttayagtaaaaatgaattttcagcagtacagtgttcacagtgagattggattttattaaattatatatgatagaaaaaatgttacttatakgtataaagtaaaataaacgtgattggcatttttaaacaaaatttttaaaataaaggtatacaatatgcccagattacataattcaaaaagtgcatgccactcaacaatgctggcacttaaaagactattttggaaaatgtaaggttatacctgtgtgacaacgatctgtgggcatggctttatcctccgactcttcagctgtgaaagatgttgtcacttgtgtattggcacaaatccatcctgggttagtcgttgactactccaacacccacttcaggctttatagccaagggcaactttaaataaacatttaaacatccyaagtggtcaattcaatgacacccctcacaggtccaatgtatgacaatgctgttgaatgtgcctcttcatttcagcacactgccttcaggcaggtaagtgttttattagatctttttccagaactgcaaccactcctgctctctcatcaccctttaacacaatcctcacgtcctcctctcgccrcaagcacatgggagaatgggaggaattacagaaaacaggaaggcaagctcactgcctcacaaaagattccttggtggaagactttcccagttcccttcygcagaaacaatgaaggtctgaggacatggggttatcatcaatctcttcattacagtcactcatctcagagaccagcattgcaactggagggcagctgctcccattcgagagtcacctggggcgaccaggaccccagaactctgctagagtctcacagtgctcacaatggcacttagccttggctgccatcagccttccaggctccttatgcagttcagaaacatgtgtttggaagtaagaaaggcactagggccrggcgtggtggctcacacttgtaatcccaacactttgggaggctgaggcaggtggatcacgaggtcaggagttcaagaccagcctggccaatgtggtgaaaccctgtctgtactaaaaatgcaaaaattagccgggtgtggtgccgggcacttgtagtcccagctactcaagagactgaggcaggagaatcacctgaacccaggaggcagaggttgcagtaaaccaagatcgtgccactgccctccagtctgggcaacagggcaagacttcgaaagaaagaaaagaaagaaagaaagaaagaaagaaagaaagaaagaaagaaagaaagaaagaaagaaagaaagaaagaaagaaagaaagaaagaaagaaagaaagaargaaagaargaaagaaagaaagaaagaaagaaagaaggaaagaaggaaggaaggaaggaaggaaggaaggaaggaaggaaggaaggaaagcaagcaagcaagcgagagagagagaaagaaagaaacaaacaaagaaacaaagaagaaagaaagaaagagaagaaagtgagaaagagaagaaagagagaaaggaaggaaggatggaaggaaggaaggagagagagaragaaagaaagaagaaggaaagaaagaaagaaagaaaggaaagaaggagggaaggcaggcaggcaggcactgacacctggtttcaggtgactttaaaaggracctattctgagagactccgtttcacaggagcttctttcagtgtggccagggccctctaggatctcaytgccctttcctccgtctcctcccagcctccctgcacttgctgtcctccagccattccttgccatttcttttcaaaggcacgcycctrcctcagggcctttgcacttactgtcttcccccacaaatagccctgttgctcactcccctcatatcstctggtctctgctcagatgctgccctatcagagagaatctcctgacacaaccactctcccctttccttttctttcagggaatgggccactcctggcaycctgcacattttagcatttgtttcctgtctctccccactagaatgcawgctgcagaggaattgtatccrtagcacctggtaagtgctcaatgaccactttttcaaggaccacatttccataatattaaaatgtattatgagagggaagagcagtraattttcctgttatctgcactggccacgtgttgcctgagcatgtgcctytatgtgtgtaattgagtctctctgtgcctcactttccttrtctgttaaatgggagttacaatattatcacctccacaaagttatggaaattaaatcacaggtggggattgtgcctggcaggcagcaagcactcggtaagtgttagctatctgatattaactattattttgctatggatatgggtgtggaccatgtaaaaatgcaaggcttcaaaagtagacaacaacctrcttcaaaagtagacaacaacctacttcaaaagtaggtataaacacttggggttcatacctaatgtgccacgagatgggctttggaccttccagatctgagccacctttgggagggtcgcgtgaagggaagctaggcactcctgctcagcatgattggcaaggtccttatgccagcactagtgcccagaaagtgcaggcagttccagctgttgccacaactgctgcctagacaattggcctatcagggcagtgttgggggaccagggrttgcaagagaaccagcttttaaaaacagcattgaagataaaatggcaaataaagactaaaagttttcagaatccttgtctcagaaggttctaggctgatctgaaggttctgaaacacagacatgagtcttgtcttgcttgaacttatcctgtttttcactttccttgacaactagaagttattttatttaccatataaatacttttccaatgctgtctaaaaccatgcttgtaattaatatatctggaaacaacaattaataaatgatgtgtgtattactttaaaataaaaataaaggtttctatgtaatttccgtaattaaggagattaatatcttacttaacagacttacatccagaactgctctcagaactgttgtcctgtcttaaatgaaaacaaaggtcaggaaatgcacacactgaataaagagtagaaatgatttattttaaaaatcatacattttgtaaaasagatccaaactcaattaatttcttttctaaattctccctgagtccacaaccagtctgtttcacatcaaaggagcctgttcrtctttgaaaatggataaaagagaatttaattgtttgaatttgagctcaaatcacaagtctggctttaatactaatttcatttggtgtcacccaagtcctacccagccttgactcggccctgctcctccagtcttacccctctacccacacatctagaaggctsacatgcacgacttcaatgatacaaccttgcagaaagctggagtgggaatgccatttctccattggccttctcgttcttctctgtcatcccacctccarctgctaacgccccaggccycactgcccactcccagcctcctttccacgttgagagcccagggagggcatctaacctactccccaatctgcaaatctaatctccacccccagaagcacccracgtctctcctactcgacctcacaggtgcgccccatgcacagtcctgcccagcacaagcacatggcctcactcccacrtctccttatttccctgacacagcctcaccctccactcaggctcaggattaaatgaggaaatatagggaaagatatgaacactattctcaaatctttccctccctccatataactatagacaaccagaaccaaggatcggcarttgttacatggaggaaggaaaaagatttgaactaatgaaaagaacaataataatagcagctaatagcrgcatattttttttcttttttgagacaagatctcactatgttgcccaggctgaactcaaagaactcctgggctcaagagatcctcctgacttagcctcagaagtagctggaactgcaggtgggcaccaccgcacatggctaatagcagatttttgtgagtgcccactatgtggtaggcactgtctatatattctcatatacacatatgactaatatgcatatacttgtgtgtgtctacataagcacaaacacttcgcatatatctcaataatgggggtggggctcagctaaccagttgaaggctttaagagcaaaaattgaggttttagagggaaggaattctgccgcgactttagcatcaattcttgcacatttcctgcctgtcctgyacatttcagacttgccagtccccacaatcacacaggccaattccttgaaatgaatcttttctatatcttacatacaaatgcatatgtttctctagagaaccctgatacatacaggggaaatctgaaaatggattatctgcggcagcaggaggaagaaaaagagaggcacaagtggccctgtgatggttaatattatgtgtcggcttgactggcctgcagcacctgaaccctgccaggcaccaggaggcttcagggagaacacgagcttgctcagataatgaggtcaagtcctctaagcccctctgccctgcaccaggtaaaagatcagaacaggacagtgggaagggcccggagaagcatctgcacctgactccccaggggcaaggtgggctggaggtaggtgacaaggtttggctcccaaacrggcactggccaaaaacaaatggaccagcagggccaagtgacatggcagaagaccaggtgggkgactcggtcamcactttcaaacatccccaaagttatagtaagcatcaagagaccacttactagagtctcactgttaagagtaaaaagagattgtgtatgcaaacaattagaaaaatcagaaataactaatgtttaaacaaaacctaacaccgtaatacttcaagacctttgggctcatagtctgcctgacwcataggaagtggacaggatggctcagagcactgtcaaggacctcacttgacctcctgcaagtcagttcttctcaggacaaagtggacttttccacaagtttgcctttagcaatattataataaactgcacttcaactgtcttgaacaaactcacagctccacaccaatgcagtcttaaaaatgagactggccagtggctcacacctgtcatctcagcactttgcgaggccgaggtgggtggatcacctgaggttgggagttcgagaccagcctgaccaaaatggagaaaccccatctctactaaaaatacaaaattagcyrggcatggtggtgcatgcctgtaatcccagctactcaggaggctgaggcaggagaatcgcttgagcccyrgaagcggaggttgcggtgagccaagatcaagccattgcactccagcctgggcaacaagagtaaaactctgtctcaaaaaaaaaaaagagacaggcatcccacatcaatgcttccaaggtgtgtacccttttgatctggcaattctgcctagaaggtcatctgaggaagtggccaggagagcacaaacacacacatttacagatgctcatcacagtgtcactttgagracttaaacagaaactctgtgagttataagatcattgaagagctgtgactttaacctctccaccttacttcctccctagattcctctaggaacagaaaaatacagattcctcaagaactattagaatacatacataaaacttactgacacggaagatgcccacttcatatgcggtgtgcgtcatggccccattgtagagccttctttcattttaaacagcattactggccrggcacggtggctcatgcctgtaatcccagaactttgggaggccaaggcaggtaaatcacctgaggtcaggagttcaagaccagcctgaccaacatggtgaaaccctgtctctactaaaaatataaaaagttggcggggcgcggcggctcacacctgtaatcccagcacattgggaggccgaggcagcggatcacgaggtcaggagattgagaccatcctggctaacatggtgaaaccccgtatttactaaaatacaaaaaattagcgggtgtggtggtgggcgcctgtagtcccagctactcgggaggctgaggcaggagaatggcatgaayccggraagcagagcctgcagtgagccaagatcccgccactgcactccagcctgggggacagagcaagactctgtctcaaaaaaaacaaaacaacaacaamaaaaaagttagccgggcrttgtggtgcatgcctgtaatcccagctactcgggaggctgaggcaggagaattgcttgaatctgggaggcagaggttgcagaaagyggagatcgcaacattggactccagcctggtcaagaagagcaaaactccatctcaaataataataataataataataaaataataaataaamagcattactgtggctggccacacaggagcctcctagaagagtctacagcattgtgaggtgttcattatctttgggcagaaggaatacatgtgatctttattttcttctttcttcttacattactctacattttctgaacttttgcaaatcatataaataacttagaaatcacaataaacaaagctattgttgtgcatctgcaggtgtctcctaaatgttataagccctaagattacccataagggtaattgagagtactgagaggcttcaatatcatcaaattcataattacatcaaacaatatatttatgaatagaygtatttccaaaacaggccccctcaccttttctagagctaagattttgatccataaagacttacttctccattgccttcaattagaccaacctgcagaaaataataataataataagtacaatatctagaagaactgcaaggcaaatgttagcaaaatcatccttgtcaaatgtttctataaaatatcagaagcagatacatgactgacatgcaaactccaccaacaaccagaagaacgcctaagtctttggagcaatgctgaaactgtggttacttccagttaccaaaatgccacactctcctagaaaatggttatgacttggagaatccattaaaaatcaagaaagttttcataacagaggaacattttcaaaaaaatagaatgttaaatgaaaagtagcatatgtttataatacagaatatgaacacatagtcaagcatcctaagaaggaatcttacaggaattgtcagccttatctggcttctccagaaatgcaagaccttccattctgtccctattctaagggaaatgtcagttcccaggggcagggctcttccacggatccacaacctaagaggaagcctcagaggcacaggctctgggagtaccaggtggcagcttcaacccagaagcgcactcgagtgcagtgcrcttgaactctccaggtcaactgtggaaggccccttagctcaggcagtgggatgggtgataggaatgggtttattgacttcatagagtataaaataaacaattcaaatacacccaaatgcactctttcataaaagaaackgaagtaacaaattctgaccccatgatgagaccccagataaacgttaggggtcaccaggggtgaagggaactggcaacaagtcaggtggccaagactcaaagcctgccaagaccactgggcacttttttggacttcctgaaaactccacrtkcctataaaatacgagaaaaacaagagcttcccatgagctcttgactatcccaggatcacacccagtttgggctagaaagacccccatragggatccaccacagygaaaccagttgaactgccctttcctgagcctctctgtgctccaggcactgccccatccctcccacgagacctgaygggaagcgggttaaggtggtttcatgttgaccatgtgtccacaggcttcgcagaccaagagcaagtcggcacaccaggacaggcaytygcatgggtgcccagaagtttcaagatctgaccttggagagaccaggtccgggaggctgccgggaagtctccatcacaccggcctcagccgagtcacaggaacgcaggctctgccatgcccagaagcctgagatgcaacttcaaggacaacgggagccagaacgcttgryctcacacggaaggtgactcctaaccaccaccacacttgacgtagcaccagcacacggagattaggtgagagtgggctctggtgcaaagataacagtgctggggacctgtaagccagtcactgaccaaaggtggatgtggcctgctggataagggcagggggaaaggctggagggaaaggccacaaggttaagagcaggtagtaagaccaggtgactgaggcctggtgtgtgaggctagaaggacagagcacccagttaaggcagggtggttaaagcaaagtgggcaaggccaggagaataagactgggtgagtaggactagggggctgataaggccaagtagaaactctaggtaagtaaggcaaagtggtatggccaaaagctagtgccaggtgagtaaggcctaattgctaaggccaggagatcaaaaccaggtggataataccagrtgggtaagcacaatgggtaagaccatgaggttaagaccaggtgagtaacaccagaaggttaatagaaacaggctggtaaggcaaggaggttaaggccaggtaagtaagaacaggtaggtaagactagggggtaagaccgggggacaaggtcaggaagctatggccagattggtaaaaccagaaggttaaggccactagttgggtaaggaacagtgggtacaaccagaagtggaaagctaaatctgaaggccagatgtaaaggtcaggtgtgtaaagtacgatgaagaccaggtaagtaaactaggaggataatgcaagttggtaaagccatgagaataaagccagcagggaaagcccgatctgtgtagtgtgagtcagagcacacactttagagccagaaggttgggctcagatttcagtttcaccctttcctagatgaagactggagcaagtggagtagcttctcagaggttctttgtccatcacatagtgataaggccaggtgcagtggcccatacctgtaatctcagtgctttgggaggccaaggtgagcagatcatttgagcccagaagtttgagaccagcctgcgcaacatggcaaaaccccatctctaacaacaacaacaacaaactcatagtgataagagggtttgttagggaaatatgttattcagtgaggagaggcagttaaaccactagcttagttctgtaaatgctgagtcatttccagattggagaatgatttaagcaaagatggtgaggaggttagaaagctcttaggaaacggttgtcaacggtaaactcaygtcccagtttgaaacatgaaacactgtgaaactatgagagggcagaaaaataagacttcggaaaaatggaggtgagggtctagaagcctcaatgaagtagtaaaacagggtctggaaggcggggctggtagcaaaagaaaagaaggtgtgtgattccagatgcggattcccaaggtcaaagtttcagttgccactcaagcaatctaacccttctaactgtcatcattttgtatcttgatattgtatattatcaactaatacaactttttaatttaaaaagttttcttaaaggaaactgatattaaggattcacttttaaaattataaagtttgccaggtacagtggctcacacctgtaatcctagcactttagcactttgggagacagaggcagcargatggcttcagaccaagattcaagaacagcctgggccccctagcaagacctccatctctacaaaaaataaacattagcctggtgtggtggtgtgtacctgtagccagctacttggaaggctgaggcaggatctcttgggcccaggagtttaaggctgcagtgagctatgattgcaccactgcactccagcctgagcaacagagtaagaccctgtctcaaaaaataatacataaaatagttatattgaagtgtatccagagaaaccagtgggaatttaaattacttttggttgaaatggattctgaggaaattatacggacagaaaactgagataatgtaagttgtatcttgaataaaaactctgattttggctgggcatggtcacttacacctgtaatctcagagctttgggaggctgaggcaggaggatcacttgagcccaggggttcaagaccagcctgggcaacatagggagaccctcatgtctaaaaaaatttttaaataaataaactggttttggggtggggtgggtggagctggggacggaggagtaaaaaacataattgtcccatcactatagcatttaaagatttgactaagcaaaacaaaagccccagcttctggagcagaggtgctggcactggttccacaggcacccacagcacaaatccctggaggtcagtggggtgcacagctagtgtgggaacacttcaaatagtcggtgtgctcagccaggagtggaattggtttgctttggtctgttttagcagtgcagaagcttgattgatttgatttcttcatcctttacattttggattatatttcacatctttcccaataagtaacacacacaacccagtattggttatcatatcattctgaaaagcatcacaaggggctaagtagctggacatcaaaggagttttaacccactcttctctttcttctgtcctccagaatttgtttgtttgcttgtttgttttttggagatggagtctcgctctgtcacccagtgcagtggtgctatcttgactcactgtaacctccgtctcccgggttcaagcaattctcctgcctcaacctcctgagtagctgggactacaggcatgcaaaaccactcccggctaattttttgtattttagtagagacagagtttcaccatgttgcccaggctggtcttgaaatcctgagttcaggcaatctgcccacctcggcctcccaaagtgctaggattacacctgtaatcagtgaccgcacccagcccttttctttttttcttttgagacagagtctaactctgtcacccaggctggagtacagtggcgcaatcttagttcactgcaacctctgcctcccgggttcaagcgattcttatgcctcagcttctcaagtagctgggattactggcccgcgtccccaagcccrgctaatttttgtatttgtagtagagatgcggtttcaccatgttggccaggctgggcttgaactcctggcctcaagtgatccacctgcctcagcctcctaaagttctgggattacaggcatgagccaccrtgcccggcctctgtcctccagaatttttattttgctgcataaatgtaatgatattagggatctgttaggtattccatacatctacttatctgaataacttttgaatcatttcttaacttgtttctatggtatccatcaggttatatgtggacagatgatctggtaagtactggtaatgatgcagaagaagtgctctgcaccagtcatccattgatgtctgttttccaagacacagaattacgatcattacggatcattatttcccatcatgtgtttatctttcaaaaggaaatggtttttgattttcagttgttttggaattcagcctttcctatggatgtgactgatttttgctctctatattttacccttcaattagcaactttaaaacaggcctgttgggccgcatgtggtggctcacgcctgtaatcccagcactttgggaggctgaggcaggcagatcacctgaggtcgggagttmgagaccagtctgaccaacatggagaaaccccgtctctaataaaaatacaaaattagccgggcatggtggcacatgcctgtaatcccagctatttgggaggctaaggcagggaaatagcttgaacctggcgggtggaggttgcagtgagccaagatggtgccactgcactccagcctgggcaacaagagtgaaactccgtctcaaaaacaaaacaaacaaacaaaaaccaaaaaaccacaacaggcctgtttagtcaagctaaaatttctgatccataaagagtcctagttgggacattgtgttatttttatttatttacttatttttgagatggagtctcgctctgtcgccaggctggagtgcagtggcgtgattttagctcgctgcaacctccccctttggggttcaagtgattctcctgcctcattctcctgagtagctgggactacaggcacccgccaccatacccagctaattgttgtatttttagtagagacggggcttcaccatgttggccaggatggtctcgatctcttgacctcatgatccacccacctcagcctcccaaagtgctgggattacaggcgtaagacactgcgcccggccttagaatcttctttaataattatcagcactgtaagatgtttctggtctccactcttttttcaggcctacaccaatggctaattgagaccatgcatcactattaaggcatcttcagcaaaaggaactatggaagttctgcatgaaacatagacacctgttagaaaaggaactaaatttcaaaccgggaatgtggtgttgaatcacagcaaagtgtccagaaggaactcccaaagtactgttttccaaaatatagaatgatatagaagattgttttaggtggaattcctggaaataaatttttaaatgtttctttttgacttccttttcatatggcaaatgataccaatgttccatttatattagttatgaatttaaagaaatattgaggaaatcacatttcacctggcatatgagtatgggaaaaatcatgacaatggaaggcaaatgacttaagtttgggaaacatttggctgagaggatgtgttggaaagcaagttaaaatcccaaactcagccatgtgcagtggctcatgcttgcaatcccagcattttggaaagctgaggcaggaggatcgcttgagcccaggggttcaagaccagcctgggcaacacagggagacctctgtctatacaaaaataaataagtattgattagccgggcatagtggcacacacttgtggtcccagccactcgggaacttcagcccaggagctcaaggctgcagtgagccatgaccatgccactgcactccagcctgggcaacagagtgagagcctgtctcttaagagaaaaaaagatagattcaaaatytgataacagtaggtttggggatggccccgaggtcttgggcttttcttttctctctctctttttttttttttttttttttgagatggagtcttgctctgtcgccaggctggaatgcgatggtgcaatctcagctcactgcaacctctgcctcccagcttcaagcgattctcctgcctcagactcccgagtagctgggattacaggcacctgccaccacgcccaatttttttttttttttttttgkattttttagtagagacggggttttgccatgttggccaggctcgtcttgaactcctgacttcaggtgatccacccgtctcggtcttccaaagtgctgggattacaggcctgagccrccgcgcccagccaggtcttgggcttttcataggctccctgggcatctttcaaggtgtggaaatttgaaagccaggaacaatctgccatacatcaggaagccactagatggcaggagccatcccttggagcccattcttcagtccaaaaagtggtcagagaggaaacctgtcaagtggggaagaatccaagcacacatgttaaatgcactttaataaatagctggtgcagatgaaagggcaggaagagtttatctcatctcttgcccccctctagtgtcccctcaagtatttgaaatgcttcaaggatccttaaataaaactgcaaccagggagctgtgctaccctgtagcacgaccagctaaggaaaaaactagctcaatgatagggctagtatttatatggggtcaatggcttttactggcagacatatatggccttttgtgcaatataggagataggaaaaacccaaaccaaagcttttttttttattttttttctgctctcaatcaacacagaatacttctgtgaccaaatgtgggcaaggttttccccagacaccaaacaatccgttttccagcaggttctccagtggacactagctgggtgtcctctaattcaactcaattttgacactccctacctaaagacagtgttagatctcataggttcaggggttagtctcacaaaactgtccccaacttcagataccagttgcagatctgagcctctagaacttctgacccaccagctacaaattaaggttgccacatgcccctccccaggttcaattaatttgttagagcagttcacaagaactcagggaaacacatttaccaatttattaacaaagaatataataagggctcacctaactagcctaaaaaaaagaatatgataaaggatacagatgaagagatccatggggtgaagtcagcaagggttctgatcctaggagcttctgtcctcatgaagttggggtacaccaccctcccagcatgtggatgtgttcaccaacccaggaggtctccaaacccagtccttttgaacttttttttttttttttttacagagtcttgctctgtcaccaggctggagtgcagtggcgcgatctcgactcactgcaacctccacctcccgggttcaagtgattctcctgcctcagcctcccaagtagcygggactacaggcctagctaatttttatatttttagtagagacggggttttaccacaccaccaygctcagctaatttttatatttttagtagagacagggttttaccatgttggccaggatggtctccatctcttgatctcgtgatccgcccactcaggcctcccaaagtgctgggattacaggcgtgagccaccacgcctggcctccttttgaatttttatggaagcttccatttgtaggcatgattgattatatcattagccattaacgatcaactcaattttcagccccccttccctccttggaggttggggcctggggctgaatatcttaaccctgtaatcagaacttgatttktcccacaaaaagttcccaccctgaggctatctagaggccctcagcctccagtcacctcattagcacagaagattccaaggattgaaggaaccgtatgtcaggaaaagatgaggaagaccaaatacatatttcacaatatcacaccttccaagtgtatgaccctgtacctaagagataacacatgttaaaatcagatacaaaacagatagtrccatcccgtgatttttctgtagaatgtgcttttcctccaaatgccaggaaatggcataacagagactaaaattcagagtgcttgctcttctttttagtggctactaacgtggtgtcaatgtgtagagctaatatttagataaagacaggtaggcaagggcactatttgagacatatgaattattgttggtgtctgattttgttttattccaacctaattagttctgccttgtaaaatactctcattacctgaattaccactgtgaatattatactctaacaatttattattatagaaatagtacccttcagtttttgaaatagtttagaaagcagtgatactgggggcacttaaatatatttttaaagtggttaggccgggcgctgtggctcatgccwgtaatcccagcactttgggaggccaaggcaagtggatcacctgacgtcaggagttcaagaccagcctgcccaacatggtcaaacgccatctctactaaaaatgcaaaaattagctgggtgtggtggtgcacgcctgtaatcccagctacttgagaggctgaggcaagagaatcacttgaacctgggaggtggaagttacagtgagccatgatcatgccactgcactccagcctgggtgacagagcgagactctgtctaaaaaaatattaaataaataaatgtggttaatgtaaccaatcatggtgtacttttttaatttattattattatttttttttttgagacagagtctcactcttktcatctaggctagagtgcactgacataatcggctcactgcaaccttcacctcccaggtttaagcgattcttgtgcctcagcctcctgagtagctaggattacaggcacctgccaccacacccagctagtttttatatattttagtagagatggggtttcatcatgtggccaggctgatcttgatctcctgacctcaggtgatctgcccatctcagcctcccaaagtgctgggattacaggcatgagccatcacccccagcctacttatttattttttgagatagagtctcgctctgttagccaggctggagtgcagtggcgcgatcttggctcactgcaaactccgcctcccaggttcaagtgattctcctgcctcagcctcccaagtagcagggattacaggcatgcaccatcaggcctagctaattttcctattttcagtagagatggagtttcgccatgttgatcaggttggtctcaaactcctgacctcaggtgatcttttttaagtatgaagaatatattttcattatacttgtctataagtgattgaagtggtcagaggagctactgaattcctcatttacttttagatgaagcaaagactaacatcctgccctcccagccaaatagatactaagttgaatattctttctgggaacctggagaaaaagtggataaaaatcactacttccaggctgggcgtagtggctcacgcctgtaatcccagcactttgggaggccgaggcgggcagatcatgaggtcaggagatcaagaccatccttgctaacacggtgaaaccctgtctctactaaaaatacaaaaaattagctgggcgtggtggcgggtgcctgtagtcccagctacttgggaggctgaggcaggagaatggcgtgaacccaggaggcagagcttgcagtgagccaagatcttgccactgcactccaggctgggcgacagagcaagactccgtctcaaaaaaaaaaaaaaatcactactgccaatgtggcactgtagattagcaatactgattatatctgatggaggacaacagatgttatcatgtgcaaatttaggatgctgaagaagtgacaagaaaaggatcagagccttgccacaacatagaatttatgtaagtgcttgaatgatgtcatctttcttgaagtccaagatgtgctggaaggtgagcaggaaataaacttagtcattttattttgaatcaagctgtatctttgggaataacaaatgcatagtacagaatgtgttgcttggttatttataagcttgggttcagagagttaatgcaaatgcaaaagcaagcaaggggctgctgtcctcttagtaaggatggtgtgtgcagctgagtcagaggaagggttggaagcctagccccagtgctggctagctttgggagtgtaagcaaagtctcaacctaatttgaaggctctctgttcccatctgtgaaatgggtacaaaccccccatgatctgagctgtagtgaaagaaaggaggccatgcacgtcaagatccaggcaggtggtcaggctcagtaagggagaggtcatgtcactctggtacttgagaccgagaccggactggtaacataagccttctgggccttccggggccctgaagcatggatcacggggaccactggttggcgccacagatgctcaaccagcaaagaggggaagggagaaagcagagcccagggagggctggaggggatcgttcctggtgttgatccagaaaaccacagggttccttgtcttggttttcaacaacttctctttctgtgtgtgtgtggatggatgtagcacattgttataaccaagctcaaaataatgcaaaactttgattatatatgttgttaccatggttaacmaatgtattcttccatctgagaatcctcagtagtacagagaraggttttgcatttagaattctatttagactttttattccttgaagcatcaaaagtacataaacaccccaaaaggttatatcagaagtcaaagcattatgatctytytggatgcttttcagacatggtgggkgagcgttctgaatcccaaccccgcccccaatgccccccagccgccacccggccagctttgcctggagagctactragattttccactatctagtcttgggatgctgaagcctcaagaggttaggaatgaatgcaattctcacccacctracaatgttggtatgcaagctttggttgctttggttggtatgagaccacctcatcctactggagaagttattttcttgtctttcaccatggaatcatttacttttgtggtgggggaggaatgctactcagaaagagatttcaaagaacgaaggaaaaacttccttatcttcttcttcttctccttattcttcttttttcttttagtagagacagggttttgtcctccagrttgcagcacagtggcaagttatgctcactgtaccctggaactcctgggctcaaggagtcctcaagcctcccaagcagctaggagcacaagtgcatgtcacttcttaaaggagacttgccacagagaataatgggccacactggcttttgttacttggtgaaatgattttgttggtccatatagatactgctactctacggagca

SEQ ID NO: 13420 - DNA, 28499 bp, Homo sapiens
gagcctttgccagatggatgagttctgtgtggaaatcgttgtgggggaagtgatgggagcagggaaaggaggggcgcaactgtgcggggcatctggcacctggggaggaactggggagccatggagggggccggccatgagcaggggaggtgctggggctggtgggaggttggctggaagggaggaatgcgaggaaggggcaaagagagctggcggacggggggtgaatgtcctttgttccgtccagcagcctctcctgaggacacttgcatgctaggccctctgctcggtgatgccggggaccctgaaggtccagtttgggggtaacccatctaggtgagctgtgtgacagtggcagtcgcagcactgcaggaacagaggaggatgctgatgggggacaggtgtgctggaaggagcctcccagactgagatggggtccccagaaagaggggtgtcccgaacctggcgctgtgactccagatctgccttgttcccgaccaacacaacggggaagtcgtcgcggtccttgacccgcagaatctgcgtgaagagcttgcccacctcgttgaaactgcgagtgaagccggaggcatgaggtccagccagctgcagagcccaggtcctccccacacccacccactgctccgccaccagyaacccctgtcacctctgcyggtcrttaatggcgaacaccagcaggaagccgtggccagcacgcatgtactgctctctcatggccccgaactcttcctggcccgcggkgtccaggactgcagagacagggagaggggccatygtggggaccaggctccccgcagtcacccccaagagcmctcagcccccactgacaccacccccatccatcatccatccttgccgccctcactgtccagccgggctgggatgccatccacactgcagatcttcgtgtaggagtcctcaatagtggggtcgtagtcagacacgaagtaggactggcggggtggggagaggatagttactgcagtgccccggcagacaggacgaagccctgcccttgggatgcctctctcagtctctgtccctctctctctaaatgtctgtccctgttgctgggtctctgcccccttttctctgggtctctgtcccgtctgtctctctgartcttttttttttttttttttttttgagacggagtttcgctcttgttgcacaggctggagtgcaatggcgagatctcggctcactgcaacctcygcctcctgggttcaagagattctcctgcctcagcctcccaagtagctgggattacaggcatgcgccaccacacctggctaattttgtatttttagtagagatgtgttggtcaggctgtgttggtcaggctggtctcgaactcctgacctcaggtgatccgcccgcctgggtctcccaaagtgctgggattacagatgtgagccactgcgccctgccctgtccttctctctctctccagatgtctgtccttgttgctgggtctctgcccccttttctctgggtctctgtcccctctgtctctctgagtctctattactctctctctctgggtctctgtccccttctctttgggtagctgctcccctgcccccctttccctgccccccacccctcctaccagtcttcttctctctgagtcactcctggtcctctctttctggtataaggtacatgtcccacatcgtgattacatcctagctgtgtgacactgaacaaatcacttcccctctctgagcctcagtttcctcatttgaaaaaggaggctaagaacagcactacactccatccagcactggcaagattcggagcaaaaccccattaaatattgaatgtatcagttatcggaggcgttgttgtccagactgcctgtttatatctctccctcctcttctgcttcctccctctcttcctcctcccccgtctcctcctcccccgtctccttctcctgctcaggcggcctccagcgtctcctcccaggggaaggtcccggttccaatccggctgcggagaggctgccccaccctcgggccccagcccctcccttcctgcctgggtcctgcccgctgccagccaagcctttggccagctctgggactgcctctgggtgcaaggggcccagggctggggcctttctctacacaagcagggcttcctcccaggcccttgaaggggtctcttggtgggggtgaggggggtgtcctggggccccggggcctctgcggtagcatgtcaggccaagacacttttctaggatttctttgaagctgggaggacctccctcaggaatggggaggaggtttcctgggctggggtggaatttcaggaaagggggtgatgtggaggctaggggtctgaaggctgcatctgtcggttagaggggtgcttggtgaggggcttgtcctggagggaggctgtaaggatcaagccctgggagggattgtggctctgggggtagttaggggcgtgacctcagagcacagcgtgagaagctcagggctgagaactgggagccagcccggaggtggctcargggttttgggaggttatagtatatacagtcttagaaacattgagttcatttatggggtcagagaaactcccaaggaatagatctttctgggggtgccaagaatctgggggcttcttccatggagatgatttgagagctattcagggtttctgagaggggctcagggagttgcagcggagaaagcatgggatggaggaggggctggttttccttgggggtggggtgggagagtggaggtttgggcctccgggaatgggggattgtcaggacttggggtcttggagatttctggaatggccaaggggcaggatgtctttttaaatctcgggtcggagagcaggactctcttaggactgggtagtcccagaagagtctcagggccagggtctgggtagaatttctagattctgggggcagtcatggaaggggctaagaatcaaacgtggggccgggcacggtggctcatgcctgtaatcccagcactttgggagtccaaggcaggccgatcacgaggtcaggagttcgagaccagtccaatatggtgaaaccccgtctctactaaaaaatacaaaaattagccaggcatggtggcactcgcctgtagtctcagctacttgggaggctgaggcaggagaattgcttgaatccaggaggcagaggttgcagtgagccaacatcgcaccactgcactccaccgcactccagcctgggtgacagagtgagtgagactctgtctcaaaaaaaaaaaaaaagaaaaaaaagaatcgaacgtggtggaatctcaaaggtgctgggcactggcattctcccaggaaggctctcaatggcttagaggggaagttggggactgggatttgggggagatagggctcagggtggtggaaggtggcaccaagggcgtggtgggggtcctgggagtgcttagggtccgaatggggtgagtattttgtatttagcatgctcccaggaggtgctcaaagccaggtcagcaggtaagcggggtcttaggcactgggagagggaatagtgggtctcgggatgcgagtgcakaaggaagggtcccccgtgcaggggatggaggctctccaagagtttaggttacaatctgtggggatcttttaagattagagggccttataggagggtctcagtgatgggtcaagggggaaaaggggtctcggggatccccccaagggctcagttctgggtcccgggggacaccctcccgggtgagggcccactacctggatgaactggatggtcagcgcgctcttgcccacgccgccgccgcccacgaccaccagcttgtgtgtctcgctgggcggggggtccccgggcccaggtcccccgccccggggccgcccccgccctgtcccggacgccgccccgctgctcatgtcgccaccgctgctgctgccttcgctaccgcctgcgggggagccgggcgggacccgggggggcgggctacgctaatgaggctactgcataatcatgagctctggcaaggagggctcgcgtctccggacacttaaggagggggacgggccaaagaaagggaggagctatgttaataagggaaagggaacggcgttcgctgcgaaggggaattccgaatgaggcggggctatgctaatgagagacctgtgctttgccctgagcggcgccacgcgctctcagcgggagggcggtctgtgggcgtggctatgctaataagaatttattctttcagcagacggggcggaaagttcctcaggggaggggctatgcaaataaggacccctgtgacactgctgcttggggcatcgtctccgaggccttagtatggtaggcggagctcgtcgactcgcgcgcgcggccgtatatagggcgctccgaggaagcagcaggttttgaggagtagctccacctccctcctgggatcctagccaagctttcgaccccggcgtctgggttagaagctagagtctccgcccgctaagggacccaggcttccggttcccgctgtcccagccaagcggaagacagactgggaggagagtggggccctagagggggacagcagggtaacggggcagggaggggccgtgagatcactgcattcctaatccatgagccagctcgcccaagtagggatgcctgggtcatgaagagcctggggccaggatttctgggtcttgaaggagaaggaagcagagggcccagactcctgggtccttaggagaaaatggggctggagatgtggactcctgggtcctggggaggagggtgtcagggaggaaggtagacaggttccttcgtactaggttcggtaaaggagggagccgggggcctggactcttaggtccaggaattggagaggctggggacccaggattctggatccgagcgagggcactggcttggggggacccgaattcgtatgtgagagcttgagaccaggactagtctgggagaccgactcttggatccgaggaaggaagaatcagactcctgagtcggagggaggagggaaataggagtctggacactgctctgagtgagaggattcggaattcagacttctctgtactgaacgaggcggctatggggtcgggcttctaggttctaagtttatttttatttgtttatttttgagacggagtttccgtcttgtagcccatgctggagtgcaatggcgcgatcttggcccactgcaacctccgcttcccgggttcaagygattctcctrcytcagcctcccragtagctgggattacaggcgttagccaccacgccaggctaatttttgtatttttagtagagactgggtttcaccatgttggtcaggctggtcttgaactcctgatatcagatgatccgcctgcttcggcctcccaaagtgctgggattacagacgtgagccaccgcgcctggcctatttttatttttttagaggcggggtctccctatattgcctaggctggcttctaacttctaggctcaagccatccttccgcctcagtctcccgagtgggactacggtgtgcgccactgcatcccgtctggttctaaatttaggggggcctagaggatctggattctgagagccccagaatgtgggcagcacaacatccagcaagtcgtgctcactccgccggactacaattcccttgcgtctgttctgcctggcgcctcttacgtcacctcctgttccgccaccctttccgcgcgcgcgcagggcactgtggggcgtcatcgcgggctaccgcggccccgcccacttcacctctcaccccattagctgtccccgcgcgacagaggcggtgcgcggactacgcctcccggcgtgcatcgcgcggaccccgccccatgtgtcccattggcttctgggaaaccgagtgcggttgccttcccgccggccttcacgtcgccgtgctcggtacttgaaatcccggcaagctcggcggcgctttagctccgcctctctcctcctttgctcacgaaccccgccccagcccgccccgccccgcgccggggccggagccgcagcccgagcggcggggtaagatggcggcggcagtccgggccgcggggctcgggcctattggggtgggcggggcggagttgggtcgctagttgtcccggggtcctccccacaagccacgggtcctagagggcttctcggggcggtctcgggcccggcagctgcggcgaaacctggcgccgagaggggggccttctcagggccccgggacgcatccgtgggttcctgggggcgtctatggggcgtctccgagaggacttggggcgtctctgggcctagaccgagcctaaggcctgccctccatcacacagctggcctggatcgtgtctgtagacactgtagattgtctttttgggctgaccggaggctagggtctggttagagggttctggggccatcttgagatcttgagatatgtcccaggggtgaaggagggtctgcaagacctgaagagtatcttcagagccatctagaggcctggggtatgtcttttagggctggaaagtgtctgcatgggctggcctgaggatgcaactggtctgcataagtctggggccatttatcaggcctagaaggagtgttcaagggctaagaagtcatttagggccccctagggggttgggttatgcccaccagggaagggcgccaaatattgagatgtactgagggtctggggtctccaaggtatgggtagtgtctaataatgggtgacaggaggctgggggcagttagaaggacctggaaccatctagatggctttaatgtgactgcaggaatgcagttttgatgcctggagcaaattcgaatgcctttggggtcagagcagcttgtggcgaataataatacggaaagagaatgaggaaattttgcccagcttagatatacttgcccttcagacagtaattcaaatgaaaaatgttttaagattctgcattaccctgggggttattgagagagttagaattaatctacattagtctggaagagtctggagggtcatctagacccactattacagtgcttttcaaggggaaacctgggccatgttgaccgtgatctgcattaagatacattttttcattgagacctggtacagacagtcataatgtatttaacattatataacataatgtattaacattaactcaccttccacgaattgacatttccacttactacttgtgctgtgctgtgaagaactattttgttctatttactttttaaaacaagctatttgtgaagcactaaactggtatatgaccctgttgttggggaaaccactgatccagataggacctagcagtatctgcagagcattcttctgttcagaagatctcagtagctgagggtgtgtctgcgaagcctggtgctttctaaatgagcaagcaagcatctttgtatactgcagagggtttggggatccctcagcctgtagtcagcagatgttgattaagcttctgatatgtgacagtcactgttgtaggtagcatgtgcttccccgggaggtgctggagagcagttccagggccaggaactggggctgagcttattgagtattggtgaaagaggctgggatgtaatagactatcagggttgggtgtgtcttaggaagttaggaattaggtggagctgggaggctgaatatggaggcttggcatggtttgaaaatctatatgggatctagaacaggaccagggccttgtctttgcaggcatgctgtgggggaagcgaggagacagatgtaggggaaacctgggcgttaagggctaatagtgtcattcctcttcatccgtattgagcacttgaggtgctctaaatgtgtggcagaagtcaggctttgagtattcacagccattctctgagatagatgctcctatttcgtgcatttacaattaagcatactgagttgtgggttagggattttgaagctttctaggaattttgagattggatattgtcttatgagtagcagatttgacagtcatggggaagcttacagctgaaatattcatatttttctgaagccctaatcaagacatccacctgtttgatggatgatctttcaactgcctgactggggaatcatatcaaagaatttccatgacattgcaaaggctttgtgcagatggcgataggtaaatgcctcctgtgaagttttcmttcggcatgtctttctgaagtttagcgttttcattttaaaaatggcatactggttttgcagatcactcaatgaagtttccaacttaggtgtataaatacaatttgggggtggtcctcaccatcgaggacagttgatgctctaggaagccgtgtggtgtttaaggcatggtgttgaatattgcccagcacattggccttgggaaaggtgggtttataggactgtggaacacaccctttgaaatcacagtgcagcacacacaaaaaaccttggtgttggctttgcctcttaggaggccagggaatgaggtcttgaagtttggataggttgttggggaagctgcgggaattgaggagtgagatgttaaaagcggaggccagggaggcctccctttgacataagaggcacctgaracccagaaaaaaggaagagaattgctcctagtccctggggtgtctgtgctgggtccagcgcccacccaagcacagggtgragtgggagraggtggaggagaggaggggtgccagaggggatgctgagggagatagtgtggggcccttgaggtcttcatgtctatcctctacttccatcctttctcccgggacctccactccaaactctmccccctggacccccaggtgaccatggaggaagaagatgagtctcgagggaagacagaggagtcgggggaggatcggggcgatggtccgccagacagagaccccacgctttctccttctgcctttatcctggtgaggctgctgggctcctggcactgagggatggaggagctgggcatccacactccaggggcctgactccagggcctgaggcaggggcgctggactcttggctcccttgaagcacttgagtctagctgtcagtgtctgggatgtctgtctcccaaggggcagaggttgcaaagcatctgcctgggtccyctgacgcttggttcttccccccttccccagcgagccatccagcaggctgtgggaagctccctgcagggggacctgcccaatgataaaggtatggcggcttccggttccttttagcccctgccccctctctgcattctttatcctaatgtcattcatacaagcttttctgaagcctcctrggtgccacccttgtgctggcatggggagccaaaaatgggcagacaccctgtagctgccttggaagggcctagtgtgcagtggaagggagacaggcacagtgctgggagagggcaggaggcccacttgagctagcatggtgggagacgggtcagggcaccttccccgagcagggacagtgaacggctctctaaggacctagaagagtctaaggacctaggattagagggaagcctgatcagctgcagcaggcctacagcacgggtgcagcggcgaggggctgcgctgggcttccttggggctggcatgcaggagggtgtgagtggggttgggggaggcaggagaggtctgtggggactggatcccagcaaggcctgaatgccaggttgaggtgtctgagggcagacaggaggacgaatggctgagcgtcgcagcctctgaagtgggtgctgggaagtcctcctgggaggtggcgcatggaggcctggagagcatgcgggaggctggttccrctgtcaggaactagatcaagctcctctttcctctaccccgcaagtctctgcagcaagtcccctgtgtccaatcccccatgcaaatctctcaccagatggctctcggtgtcatggccttcgatggcggcgctgccggagtccacggtcagagccccgttcccaggaatcagggggcactgacacggctactgtgagtaagaagagggggctgggggcctggctcacgggtatcagggaggaagggatgggggcctgagtctgggggaatggggtttggggacctggactcctggctctgcgatgctgaccaggggcaatgttggagagtctgggggcctgatctgtgggcctgagctttgagtgttgatggcagtcaggctataggaattagatcctcagttttcttggggatcttagatgtctgggttcctgagaggttagggagtggggaagcaggatttgccagtcttcatgtgaccagggacggcgtagagcctctctggcctcttccaggtgttggacatggccacggacagcttcctckcagggctggtgagtgtcctggatcccccggatacctgggttcccagccgcctggacctgcggcctggcgagtgagtagctgggcagctggagtgggagaggcctcagcgtgagagccagaagcacccctgaggctcacccaccccttccgccttgcagaagtgaggacatgctggagctggtggctgaggtccgaatcggggacagagatcccatccctctgcctgtgcccagcctgctgccccgtctcagggcctggaggacgggcaaaacgggtatgtggggccagggcggagctgggcaggtggtcgtggagttgtgtggggatcggctgtttttggtagtgatggtagcggtgatcatgttatttagacaaaacctttcccttctcttcgtattagacgtgattaaggctgtaggcgcatacagatgtacataaagtaaaaactgatgtgctggggctatgtgggagtggtcagcgtgtgtgacaactggtttcggcacgctaagtattagtgtcactgcactgggcgttcatctccccaggagggggactcttcgaatctctatcttcagagaagcagacagcctgaaaaagggcaggcacttgcccaagggcgcacagccagatgctccgtggggtgcctgggccttgagccctggtgtgtctgagtctgaagcccaagtttttgatgtctgagatgtgcgctgcccaaggaggaatctcttcctccaaccccacacacaacggtaaccctgtgagccctttagaccaaacgcgaacgcacatctcagttgcaaggaggacttgttactatgcacatcactgggcccactcccaagagttctgattctgcaggtctggggtgggacctgggaattttcattttaaacaatacatgctgctgagccctggactctgttgagaaccctgggtttaggccttccttctacgtgaacatctgtatttggaggaggggttggagggagaggagaagaaggtgcagtcagctatgggcaccagctgtgagccgtgagcaccagttctgtggtagagcagsvmcaccactctgtgccaggtcatgtttaccttgtttaccttgtttcgctgtgtcgcccaggctggagtgcagtggcataatctcagctcactgcaacctccacttcccgagtacaagcgattctcctgcctcagcctcctgagtagctgggactacaaggtgcatgccaccacacccagctaattttcgtagttttagtagagatggggtttcaccatgctggccaggatggccttgatctcttgacctcaagtgatccgcccgcctcagcctcccacagtgctgggattacaggcgtgagccactgtgccctgctaccttgtttgttttttttgagacagggtctcactgcrtcccccaggctagagtgcagtggcacagtcacagctcactgcagcctcaaattccccggttcaagttatcctgttgtctcagtctctggagtagctgggactacaggtgcatgccaccatgcctggctagtttttttttttcttttttctttttttgagatggagtcttactgtgtcacctaggccggagtgcagtagtggggtctagtctctctgcaacctccgtctcccgggttcaagtgattctctcctgcctcagcctcctgagtagcagggattataggtgcgcatgccaccacattgagctaatttttgtatttttagtagaggtagggtttcactgtgttggccaggctggtctcaaactcctgacctgaagtgatccgcctgcctcaacctcccaaactgctgggattatgggcgtgagccaccacgcccagcctttattttttatttttttaaaatttttaatagagatgaggtcttgatatgttgcgcaggctggtcttaaactccagagctcaagcaatcctcctgccttggcctctcaaactgctgagatcacaggcatgagccaccatgcctgccacaccccccccccctttttttttaacagctggaaatgatttatccattaagtacagtgatatggtgcctaggacttatgacattcttaggggcccacaaaagtgtttcaatttctttaaaatcagaagctgtagggctgggcacggtggctcacgcctgtaatcccagcactttgggaggccaatgtgagcggatcatgaggtcaagagattgagaccatcctggccaacatggtgaaaccctgtctccattaaaaatacaaaaattagctgggcatggtggcacacgcctctagtcccagctactmgggaggctgaggcaggagaatygcttgaaccaggagatggaggttgcagtgagctgagatcgtgccactgcactccagcctgggtaacagagtgagactccctctcaaaaaaaaaaaaaaaaaaaatcagaagctgcagaggataagtaaacaaatgggtcaggcaacgttcctctaaaacttgatttaggaaaacaggtggtatgctggatttgacccctgggccttaagagtgataagggtgtatccggaagctaatagtagttgttttcagggggactctgaggttatgttttctttgcttattccaggtagctttaaaaagaaaagaaagttcacccataatcctgtcccatacagaaatttatataaagctgtggatctcgcgtgtttgcagagcgctctagtctgtggagagtattttgtgcttaaggtgctgggaatagcaatgaggctaggaaaagctgaggctcagactgtcctcacccagcagcaggtgcagcctggctctttctgcgcactcatctattcctccgcttatcctgggaagtaaatgctgtcatcatcacccctgtttcatcttcccctaagcccttggcagctgagggaccgtacactccactcattgatattttttttgtttgtttttgagatgaagttttggtcttgttgcccaggttggagtgcagtggtacgatctcggctcactgcaacctctgcctcctggtttcgagtgattcttctgcctcagcctcccgagtagttgggattacaggcatgtgccaccacacccggctaatttggtatttttagtagagatgggctttctccatgttggtcaggctggtctcgaactcccaacctcaggtgatccatccacctcggcctcccaaagttctgggattacaggcatgagccaccccacccggccataaagggtgttggatgaatgaacatacccccattttatagatgaggaaactgaagtaagacacattgatccacttgcctgtggtcatgtggctggtgagggccagcccctggatcaaggggtggctctggtgctgccctcttgacccctctccttccctggcactgtcctcacaccactctgctggcatccttgcctgtggtgtggcctctgtcagccatctccatcgtgtgactgtggcatcatgactgtagtacttagcacagtgcagcgggctcttygggggcgaatgaggtgacatacgaagcaccatgcctggtttggaggaagaggcaaacctttgtcattgccactgtcactggtcagtggtgtctttgagtcctgagcagatgtaattccttgggtggggactcagcacagagtgaagagcttggggtgaagaccagccttcctgggctccccagctctgccatttcctggctctgcactggaatctcaccctctaccaaacgggagaaactcccacgagaggcagctggcgcagcaggccagagcttgtttttgtcttggagggggacttaggtttgaatcccagctctccccctgcagcctgttttcctgtttcttctccccccaggatggagtgtggtgttgtggtcatagctcactgcagcctccacctcctcctgggatgggtcgccggcactggtcaagatagttcctagtttcaaggccagggtacattgcccagggtcaggccagtgctgtctcaggatatgggagtgcaggttcggggccgcactgactgagtttacaccctgactgctgccttctctctgtgtgcccttggggaggatactgcagccctctgcctcagtttcctcctgtgacctttgggttaagaaccatggtgtgcagttgttgggagcatcctacggctggctcctgtgaagcacttggggcttcctgggcaggacctggtggcccagggagtgtccacggctgggccagcaagcaggcaccaggagggaggcaaaggccctgaccgcctctctctccctgttcctttgcagtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccgccccctgcacccccagccccacctgccccccgattcgatatctatgaccccttccaccccaccgacgaggcctactctccaccgcctgctccggagcaaaagtacgacccttttgagcccacyggctccaaccccagctcatcagcggggaccccctcacctgaggaggaagaggaggaggaagaggaagaagaagaggaagaggaagacgaggaggaggaggaaggcctgtcccagagcatcagccgcatctcggagaccctggcgggcatctacgatgacaacagcctgagccaggacttcccaggtgacgagagcccccgcccggacgcgcagcccacacagccgactcccgcccctggaacgccgccccaggtggactccacccgggctgatggagccatgcgccggcgggtcttcgtggtggggaccgaggcagaggcttgtcgggaaggcaaggtctcggtggaggtggtgaccgctggtggagccgccctcccgccgcccctgctgccgcccggcgactcggagatcgaggaaggggagatcgtccagccggaggaggagcccaggctggcgctgtccctcttccgccccggcggccgggccgcccggcctmcaccggccgcctcggccacccccacggcccagccccttcctcagcctcccgctccgcgggcccccgagggggacgacttcttgtccctgcatgcggagtcggacggcgagggcgccctgcaggtggacctaggggagccggctcccgcgccgcccgccgccgactcgcgctggggcggcctggacctgcgccgcaagatcctgacccaacggcgggagcgctaccgccagcgctcgccctccccggcgcccgcgcccgccccggccgccgctgctggtccgcccacgcgcaagaagtccaggcgggaacgcaagcgcagcggcgaggccaaggaggccgcctcgtcctcgtcgggcacccakccagcgccgcccgccccggcctcgccctgggactccaagaagcaccgctcgcgggaccgcaagcccggctcccacgcctcgtcgtcygcccgccgccgctcccgctcccgctcccgctcccgctccacccgccgccgctcgcgcagcaccgaccgccgccgcgggggcagccgcaggtcgcggtcccgggagaagcggcgacggcggcggcgctccgcctccccgcccccggccacttcctcatcgtcgtcctcgaggcgcgagcggcaccgcgggaaacaccgggacggtggcggcagcaagaagaagaagaagcggtcgcggtcccggggtgagaagcggtctggggatggcagcgagaaggccccggcgcccgccccgccgccctctggctccacctcgtgtggtgaccgcgacagccgccgccggggggccgtgccaccctccatccaggacctcacggaccacgacctcttcgccatcaagcggaccatcacggtgggccggcttgacaagtccgacccccgaggaccctctcctgctccggcctcctcacctaagcgggaggtcctgtacgactccgagggactgagcggcgaggagcggggcggcaagagcagccagaaggatcggcgccgctcgggggccgcctcctcctcctcctcttcccgggagaaggggtctcgtcggaaggcgctggacgggggtgaccgggatcgggacagggacagagatagggacagggacaggtcatccaagaaggcccggccccccaaggagtcggcgccttcctcagggcccccgccaaagccaccagtcagcagcggctcaggctcttcatcctcgtcgtcctcctgttcttcccggaaggtgaagctgcagtccaaggtggcggtgctgatccgcgagggtgtcagcagcaccaccccggccaaggatgccgcgtcagccggcctgggctccattggcgtcaaattcagccgtgaccgcgagagtcgctcccccttcctcaaacctgacgagcgggcccccactgagatggccaaagcagctccgggcagcrccaagcccaaaaagaccaaggtcaaggccaaggcaggggccaagaaaaccaaggggaccaagggaaagaccaagccatccaagaccaggaaaaaggtccgcagtggaggtggcagcgggggcagtggtggccaggtgtcgctgaagaagtccaaggcggatagctgcagccaggcggcaggcaccaagggggcggaggagacttcctggtccggggaggagcgggcagccaaggttcctagcaccccgccccccaaggcagccccaccaccccctgccctcactccggactcgcagaccgtggacagcagctgcaagacacctgaggtctccttcctgcccgaggaggccactgaggaggctggggtccgaggtggggcggaggaggaggaggaggaagaagaagaggaggaggaagaggaagaggaggaggagcagcagcctgctaccaccacggccaccagcactgctgcagccgccccaagcactgcccccagcgcggggtccacagccggtgactcgggggcggaggacgggccagcttcccgtgtctcccagctgcccacgytgcccccgcccatgccctggaatctgccagctggtgtggactgcaccaccagcggcgtcctggcctgtgagtgtcccctgggggagggtggtgctggggcaggtgagacaggatggggactggagggtacagacttagaggcagtggggtgccctggcagggagaggtttatagggacatagactgggagggtgggggtgagtaaaggccagccaggctctaggtgcctgggtgtactgggagagaggggccggtgagagcaggtggtggccagcacagactggagtggtgggctgggttctgggattcccctagacggggagtaggagagagggaccagaaagaatggcttgagcagggcatcgtattccttacggatggcggttgcctctaccagactgcagaggtggggagagaggttgggactggccacagcgggtcaggaggcagaatctcactcctgccactgtctcatcactgcatgaccctggccaaccccgcacccacacacctggagtcccaagaacattcgtggtatgggctgttctctcattggccaaggcccccttttcccagttctgagcgtgaggctttgtggctgttctggggccaagggcaggagatgacagcaggtgtccaggtgaggttcaccagctcctgtcctgtcacctctcccatcttcatgttgtcacctctctgcctcctgcagtgactgcacttctcttcaagatggaagaagccaacctggcgagccgagcgaaggcccaggagctgatccaggccaccaaccaggtgggctcccctgggggagagtccctgccgccccttcttttgtccattgcctcgggttaggagaggaaccgcgggcctggcagctctggggcaaggtatcggcctgaagaggagcctgttgcctcagctgtggggaagtcagcgtgggaacagtggggtgcacgtcccctcttcccctccacctccctttactcatcacccctctgtcctcgtcccacagatcctcagccacagaaagccaccctcaagtctggggaygaccccagctcctgtgcccacctctttgggtctrccccctggcccctccagctacctgcttcctggcagcctccctctggggggstgcggttcgaccccccccacccccaccgggctggctgccacgtctgacaagagagagggcagcagcagctctgagggccgtggggacacagataaggtgagctggcctggggagaggtggggcggtgctgacagttctgtagagaatatggacaggaactgagacgcgggggcccaaggagaaagggagactgaggcagggagacagggccgtagagaccaaagtcatggaaccataaggaactccactttgctggaatgggtgagcaggaaatgcgttaggcgtgtccaaaggaaaatcgcgtctgtgcgtgtgtggggctgtgtgcgtacacaccacatatacacaccctggaagagatgccccgcgctgcagcccaccccttgattatctgttgctcgcgctgtctccgtctctgtgagtgggggagggtggtttccgaatgaaaactcaagaacctgtttgtagatgaagcaggggagaatgggtgccaggcagacagtaatgtaggttcttactcagctgctctggccggctcctactcctgggctctggagctgtttctctcttggtcaggtctagatgtgggtttttgtttttgtttttctttgagatggagtcttgctctgtcacctggtctggagtgcaatggtgccatctcggctcactgcagcctccgcctccagggttcaagtgattctcctacctcagcctcccgagtagctgggatgacaggcacccgccaccacacccagctaatttttgtatttttagtagagacggcatttcaccacgttggccaggctggtcttgactcctgacctcaggtgatctgccagcctcggcctcccaaagtgcagggattacaggtgtgagccaccrtgcccggccttggttggttggtttttgagacagggtctcgctttgtcacccaagctggcatgcagtggcacagtcacagctcactgtagcctcagccttgatctctcgggctcaagggatcctcctacgtcagcatcctgtgtagctaggactacaggcacgcgccaccatgcccagctcatttcttaattttttgtagagttggggtctcactatgttgcccaggctggtctcaaattcctgagctcaagtgattctcccacctcagcctcccaaagtgctgggattataggcatgagccactgcacccagcctagatgtgttttcttacagtctagtagcccatagccagacggtgacgttggccacccttacacagctgtgtaccgtgccagataaagctgtataaaccccattaaacatcctgtgtgagccgcagaggcggggctgcagtttagtcggtcacttgtccgtagcttgtgccttgcgctgcaggactcrgacggtgaggaccccctggtctacagtggcccttgctctgccctggtctgtgctctgccctttgccccgctttgcccatccgagatgggtgttggggagcagcgtctctctagagacccacatcctgtggggccaggcaagcctgagaagtccctccagggcagcctgtgtctcttctggccacagagttccctaacagctcagtagctcgtcagacagtgtcactgatgttgctcctggagtcggctagccattgtgccctgcccttcccaggactcagtttacctgcccctactttgatagtcacctggcttgggagggcagcttctccaagggtggtgccaagggactgtcccttgtgcctgcagaaggcctgttcttctctggtcccacgtggctctctggctagaggtttcctgtctgcttttgcaaggattctgcctgaggccagggctgcagctgctgccccgagcctgcggctgcgggatctcctagcttgctggccacaggcgggaagagccttgcctcggaggctctctgccctgtccctgttgcgtcctccccttttcatcccatggccatcccccttggaacaggcacagctcccctggattgagtctttgctctgtacccagcctgtgccatgtcctccatgtgtgtcgctgtagtactgcccataggtgctgtccccgttttacaaatgagccacaaaggtggccaggcacggtggctcatgcctgtaattccaacacttcgcaaggccgaggcgggtgaatcgcttgagcccaggagttcaagatcagcttgggcaacatagtgagacctagtcgccacaaaaagtacaagaattagccaggcgtgggggtggcacatctagtcccagctattcaggaggctgaggtgggaagatcgctttagcccaggagaccaggggtacagtgagcagtgattgtgccactgcactccagcctgcatgacaatgagagaccctgtctcaaaaacaaagaaacaaaaaaggagccacaaaaaggtttggctgagcatcccaggggtcagagacagggagtggcagaccaggcttctgatacaaatgggctcaaggtcagtccccacccccactccccagtgcccctcacccctagccaccccctccatcccctgggtgaccagagcagtactgtaaaaacctaaactgagtcctccccgctcccgcggtgaaaagccctgtgcagttttctacagccccgcctctagagtctgattcaaaaccagctgcaatttcttggccaatgcctgtcttctcatcagactgaactttgtgagggcaggcgacacacatgtcctggtcccggccaggcctggagcagcccagggttcggcctggaggagatgttcagtgacatgcagaggcccaggcctggcctttggtcccgggcacctgcagcagagggcgcatgggacagaccctcagcaggacttccagcctgagagcagctggacggccagagaggttaggctggcagcagaggcgagtggaggtggaggttccgcaggtactcactggcccttgctgtgtcttcccccgctgtcgccaccccaccagtatctgaagaagctgcacacgcaggagcgggcggtggaggaggtgaagctggccatcaagccatactatcagargaaggacatcaccaaggaggagtacaaggacatcctgaggaaggccgtccacaaggtgggcacccggagagaggggcagacacaggccggggagagaacgagctggagggacagatgtgtgcagacagatggacgcggatgggagacggggaggaggtcagtctgggaggtgakgagggtgacaggattttctcaaggccacctgggcctgttccgctggccctggggcacccatcgtctagggggacagagggactttggcctggttattggggaagctcctcctaccgcagttccaagctgcgcccaacagtcctgggtggatggggccccgggagcctggtggtgactccaactgtccccggccccccagatctgccacagcaaaagtggggaaatcaacccagtgaaggtgagcaacctggtgcgggcctacgtccagcgctaccgctacttccgcaagcacggtcgcaagccaggggaccccccagggcccccacggccgcccaaggagccagggcccccagacaagggtggcccgggcctgcccctgccccctctctgagagccctggccagctcttcgcccctcacctctttgaaactctggacgtatttatggctccacctccccacctccctcccccgtcagtgggatgactgggggagggttgctgcagggaagaggagagccccctgccctgccctgccccgtgyccacctcccttgcccccaagcctgtccccagtgcccctcccttctgtttgtgcccctctccccaatttcattaaagatttcatgaaacattacccctgagccccatggttctaaccctttgttttcggagacaaatttgccagagggttggggagggacccccaggaggctgaggatgggagacagagaccagactgtgacttggggcagctgcctcccctgggcctcagttttcttatctgtgtagtgggtgttgtgatgattgaacaagacacaggtggagcacttagcacagtctctggctgggagcgagctgctcacagggaggcaggggccggaccccacctgatcagcatcttcccagctcggctcctgggtgccatgtgcctgccttggaattgctcccagagcagkatctgtgttccccattgagttggcttctcttttcagcagccccgtgaagctggggtgatctcatcaactgtcctgagagggaaactgaggcacagagcagcaagggccgaagggtgagtcagggctgcgctggcttctgccagtttcatcacccagaactgcggcccaaccaggagaggtgacagtgcccagggtcaccaggcaggcaggctttgcaggctccagggtggccgcagagcccctttaccaagacccctccagccccacgtggaggggagcctgaggcctggaaggagaaggaccacttgcccaaactgttcataggcaaggcagggggcctgggttctggctagtctttgtgtttcctactctgtgacctttgcgcctctcccagcctgtgtcttggtctacaacacggggacagccatcacccaccaggtccctgggcagaagtgaggaggtgtcagctgccccctgcagtgcttggtcttcatgcattgagcacctgagttgtatatagctgcacagatgggtaaactgagaccctgagcgggaataacaaccatattgggtcagagggcacccaacaccagacacgcacaagtgatcatagcaggaaccagtttattggttgaggtggtggggaacaggggggttggaggcacaccatgaggagcgagggctcagstctccccagggccctggaaatccatgccctccaccaagtcctgcaggtaggccttgtactggtcggaggtgagggagagtgggtggctgttggaaatgtgcaggtccacagtattctccagggaggaggcaccccctacccgggccatttytaccaaggccctgaggcacgtgggcacaacctgcaggggaagtggggacaggagtcagggaaaacacccagccactgtccaccaaggtaggagtcagggcttggaggactacaactccctgcagcccctgctgtaacctaggatgaaccataggcctagggctgctgggagttgtagttttacacacacacacacacacacacacacacacacacacacacacacaccccctgctgtaactgaaccataggcctagggctgctgggagttgtagttttacacacacacacaaacacacacacacacacacgtcagggctgagcagtctgtgatcttgactcctgggagccacagccatggcctcacaatggcagctaaaacttgagtccaccagcttctacatggtttagagcaggggtccccaacccccctacggcttgttagggaccaggttgcacagcaggatgtgagcagcgggtgggggaatattactgcctgagctctgccttctgtgagatcagcggcagcattagattctcagaggagcacaaactctatcgaactgcgcacgtgagggatcggctgctccttaagagaatctaatgcctgatgatctgcagtggagcagtttcatcccgaaaccacacctccctgtccgtggaaatattatcttccatgagactggtccctggtgccaaatagtttgggggccactggtttagagagttcaaaacaggttctgcaggtgaggccatgggaaggagctcccggggatgaaaaactggttattgcagagatcttggaagttgcagttttttagagggccctctgggagttggagttcctgggagcaacctcttccctctgtaaggccacccctttcagccccagggactcaggtctgcaggcaccttgaccatcacgagcctcttggtccacggctggtcctggggccatgactcccccacacagaaccagagggcatagcgtggtgagcgtccgcttccttccgtgaaggtaatcagatctgggggcccaggagcctagtcagggatgagaagaggaccctctacccacccttccccgtaaacttgaatgataacccccaccacctcccctgacctaaggccctctgctgcctcgaccaggggactgcttgtttggggaaagtcccctccttccctccctccctccctcccatcagggtggggttgttggaaggccacacccccaagcccccaagcctcagcattcataacaggcccagagtagggggcccatgctcccaaggatgctcagtgaatctggagaagctggttggcattcagtccygtctgaggctgcattgtccaattgcagccattagtcatgtaaggttatttcagtttaaattgtaaccaattaaaacgaatcacgtcctggttgcactcgcctcacctgagtgcttggcccctgtggctagtggctgctgcaccggacagtgcaggtgactgtcatttccatcatggcaraaagtgccactgcacagcgaaaccctaagggatgtagctttcctgctattggtctgttcaccatcattagttacgatgatgatgacagtggcagctaattccctgagcaggctctgtgtactgggcctgtgtctcaccccagcgctggcaggcaggtagagagaggagaccatccttggattccacgggctcagggcaaagtcctttgcctcggttatacagcgggccaagggcagccagcgtctgaattcagtcctaatcatgagttcttttttttttgttgttcgagatggagtcttactctgtcaccaggctagagtgcagtggtgcgatctcagctcactgcaatctccgcctcctgggttcaagcaattctcctgcctcagcctcccgagtagctgggattacaggcacgtgccaccacrcccgactatttttttgtatctttagtagagatggggtttcactatgttgaccaggctggtctcgaactcctgaacttgtcatctgcccacctcagcctcccaaagtgctgggactacaggcgtgagccaccgtgcccggccaatcctgagttgttaaccactgtgcaggctgctttgtactggccaggtcgaagcccctgtctcactcacctacaatgaagggccccaggtcaaacacgcctccttccttgtccttggggacctcgccatcaggcccatgcccgctgttggggagcagctcctcgctcactgcccagtatgtgtggcagtgccccagccgctgggcccagagccactgcccggcccgccagagagccagtcccccacccaggcagctcagcacatgcctcacgtagctcatcactcccctgtctgtcagggacatgccagggtctggcagtgtgactggccatccaggcagcgtcctgtctcccacttcggaccccaccagccgcaggccctccgggcaggagatggtctgctggaagacttggcggccccggtagaaggctgtcacctcgaactcccactctgagcagcggcagcagcggcatgaaggggagaggggttgagaatcaggggctgccgcccagacctcagccctcccagcctgcagctgacactcaccttcccccggcaccaacagccgcttcagtgggttctcagagggccccaggtttgggaagggagtgggattgtccaagctggggctccgcaggggctgagggcagggctcaggggctacagccaggcttgggggtcccggatctgggagtggggccaacaccatgttacccagtaactcatccagaatgtcttcctggagggaaacaaaaaaagagaatcaggcatttccatatccttttctggagacttcatatggaccaggtctgttctcagcaacgcagggaggtcaggcttgagctctgccttcaaggggcttccagcctggggacagagccagccatggcatcaacagccaaacaaacactaatgaacgccaggtgctaccattccaacccaaggatctggctctatgcaggtaagacctgggcaaagcaggctgggtagaatttcagaggggatgctcccccagcttgggcctcagcaggatcaaggtgagggagtttttcagttcccaagaggctgacagccccctgcgaatcgaaatccatgaaatcccgggaaggtgtgctcgggccttgaatgctgggtgaagacttggaattttctcctgaggagaccggggcagggacagacagggtcagcactggctcaggtgaggggcaggctggaggcaggggagtggggggatcgtctagagggagaggacaaggcccatggagacaggtcggagactgaggggcatgaaagttgggcacattctcacctgggtatcagaagtactrcctccaccattggtgtccggagaggtgtctggctgggaaaagtccccaactcctgttgagaaaagtggtgaggggagtaggagtgccaggaacccttggggccccagcctcccacacgaaccccaagctggcagacctgagttcacaaactcgtagattttatgtgggtcgtgagggtccttgctcyggtcctctgctaaacgcaacccttctttgcggttgagggcagagcggaaattcctcttccaggttggcaggtctggcttatccctcccgggaacatatgcaccagtggcctcggcccaggcctggggcaacagtggtgtcaggayggtgggggaggacgacttagatcctgctcctggggccctaaccctgtctcccgagtcctaacaccaccctctttccctggcaagttctaactctgcaaggtccatccccaaatccccccgtcccacctacctccatcccccacctctagttttcaaaaggctttttttctttttgagatggagtttcactcctgtcacccaggctggaatgcaatggtgcaatctcagctcactgcaacttccgcctccccggttcaagcgattctcctgtctcagcctcctgagtagctgggattacaggtgggcaccactacacctggctaatttttgtatttttagtagagatggggtttcaccatgttggccaggctggtcttgaactcctgacctcaggtgatccgtcctcctcggcctcccaaagtgctgggattacaggcatgagctactgtgctcggcctcttcaaaagcctttgaaacctctttggtttttgttttgtttcgcttttgtttttaaagagatggagcctatgttgcccaagctggcctcaaactcctgggctcaagcgatcctcccgccttggccttgcaaagtgctaggattacaggtgtgaaccaccgcccccggcccaaaaaccttttctttctaagccaggcttccaagtccaacttggtgtctaatcccgtgcaccacctgccccgcgacaccctctgtgataaccccgcccctcacactgtttaccacctctggcatatactaattcggtagttaggaacctcagatttggggctccaggcctcacctctgatgtttcaagaaccatcccccagtatctatcctacaaccaagagccccggcctctagaaagccccaaacccccaggatgcatttcctttgcgtactaaccggctttcccggttttattcccgtaascctgcagctccaaccctgcttgcgccccaccatcagtcagcggatccggctagccccgcccctcccgttctagccccacccaccagcgttggcacgagcccgcccctcgcgcgccacctccgccttctcagccgggcccactaggagtcctttccgcccagcgcgcagctccgggtttccagc

SEQ ID NO: 13421 - DNA, 403278 bp, Homo sapiens
  misc_feature (1)...(403278): n = A,T,C or G, or insertion/deletion polymorphism (see Tables 1-2)
cataatgcctgtcattcacctcacttcacctcatcgtgcaggtgaatacaaaagggtgaatacaaaacaatattttgagagagaccacattcacataacttttattacactatacttttataactgttctaatttattgttagttactgttaatctcttactgtgcctaacttataagttaaactttatcataaatatgtgtgataggaaaaaacatggtawatatacatagggtttggtactatctgcggttacaggtgcccactgggggtcttggaacacatcctgtgcagatagggtggaaccacygtaatcatttaatcaaataactcattccacatgaataaactatttgcttagctgtaacaagcaagaaattgggtgaacgtctaaaaagttaattctgctcatcatgagtttgaaactgacctgcaactcctacttgatgtgaagcatatcctggtaatctgctgggcccttctctcagccacagagtcaacgttgatgaatccgattctgcgtggtgaaagcrgaagcccagggaagcagcaggggcaataaatcggctttggaggatgggaatgtgcagccatacagctgttctaccttctgatcgccattgctgtactgcagctaaatgcagaagaaaaaagtctaaataatttccaaagagacgagtggaataaattaaaactcacctcagggtttcgcctcctccaggaaaccatctttaagcaaaagaggtccccaaatgtcttgttcacatcgctggcactggaagtaccatgttttatagtaaccaccttgtttatatgatttttccatcagactgaattccttcrgaataaagtcattacactgctgacctttatatccataccaccaaagacaatgcttggcacgtaacagatgttctgtagttttagagtggacaaataaaaggatttaaaccgaatcaaataccatttgaatgctgttccttttaacatccttaggtttaatcttaaagacaattatggacttctatttttttcttcctttaggagttctgttataatgtttttaatgtataaatttcaaggtagttaaactttgtttttaaataatgtatgctggttgtagaaattttgaaaataaaaaatatgaagaaatcaaacttcacattttactagcatataggaataaaattctaatttttccttattatagataatatcatggtgaacataattataggttttctatctttgccttctttaaattctctttactacttaagattgagccaggggaaaaagatgctaatatctatttgaaacttactaagttccaagcactttatatatattatctcattaagtgcacaaccatgaaaggtattactaccttaagtttatgggtgaagaaataaatacttcagatttagagtttttagaaaagcttttcagatcactttcttcatccatcatctcacttaatctttataataacgctataaagcgtgtgtgtgtgtctgtctttgggggttgattatatatcaaatagttaattaactttcccttctcttttccctagctctgcaggaagctcctctctttaaggacaatgttctctacctctttgaaagttgctgtgcctagcacagtgacaggcacatggggcctttaataaagacttcctgatttgagttagcatgcagtggaattatgggatcaggtccttctcaccttgctctctttgtctgatgacatcttttaaaaattgaggtaaagtacataaagtgaaatgtacaaatcttaastgtacatttcatgcgatttgacatatgcatatgcccrtaacacactttaacattatagaacatttctatcactccatacatttcacatgtgctccttcccaggcaatccttccaatcaaattaaaaggctactttctaaaagcaatgctatttgcttgctgttttatatctacactctgtgtcttggagaatccactctcactgcttcagctgatacatacatgaggatggctgcccagccctgacctcactgaacactaaactttctgttctccagttgctcccagacatttcctgtcctgaaggttaccacttcagacttcacaaagtgtgttcaaaactgaatcttttgttgttgttgttgagacggagtcttgctctgtcaccaggatggagtgcaatggtgcaatctcggctcactgcaacctctgcttcctaggttcaagcgattctcctgtctcagcctcccaagtagctggaattacaggtgcgtgccaccatgcccagctaagttttgtatttttagtaaagacggggtttcatcatattggccaggatggtcttgatctcttgacctcgtgatctgcccgcctcggcctcccaaagtgctgggattataggcgtgacccaccgcgcctggccaaaactgaatcttacaccccaaactagcttcatttataagcttatttatttctggcaccaatgcttgaaaccttagaatcatttttaaattgctttcttcttttccctaataagctttattgctttttcttccctcacctcccattcccattgctaatatctatcctttaaagtccagctcatattccacatctttgaccagtctttcctaaccactgctcatgagctcaccattatgaatttaaagactactatgtctgtacaatttattagaacttattacatatgacctaatgatatctcttccattagctattttttccaatyctatttaatattccatgcatttgcaatcctccagggtaaccctacattatgcactggggctcaatttgtactaatgaaatgactggcttgcctaaagtcacatagctggtgagtggcatagcagggaccagaaccagtgctatttcattactgatgcagatatgttatgtgtgaagctaacaacatattgcctgtttatccctctaacttcagttgttggtaacaaaacatcaatagttcatgttctaaaagaatatgaatagttgacttcttattccaccaagaatatggacttcttagtccataaagactaagaatagcggacttcatgtgtaaatagtctctctttataggcactaccattcagttagttttgttcaattataacaacagaaccagcaggagttcttcaaggtagcatagtgcagtaagaaaggtgtagagccagggcaagtaaatttttctctctgtgcctcactactgtyatctttaaaataggaataataatgctatctacctcaaagggttgttaggaggattaattactatttataaagatcctaaaacatctaccattaagtgcaacaaaatttgttttattgaaaaaatrtaacaagtatttggtacttaagtttacaaattagtttcatctttgatcaacgcatctatccagtaattagagctggcgttattcacaaaaagcaagctaagaagcaaatatttttggtggcaatttgcctaatgcctggctaagcacatggcagaacctggtacttaaacccagaatgtgcayctccaaatcgcacagctttctgctttgtcatgctgactggggtagtgctttgatcacctgtttggtcattgataagtatcagtgggtacaacacctgtgtctacccacacactggaagataaaacgattgattctcctattagtgacactgttgcagtataagcgggcttgtcagcaattactagcaagtaggagagaaaataatgtgaagaggtaagaagtctgggaatgaggatgagtaaacattgaaataactagctcaattatatttacagatatgcttcttgccatattgctcaataggataaagattattttgagtttccagtgtgagagatttttccatagttgaatttgcatgctatgccttcaattagattataaaaccctcagaggccgtttgaaaaactgctgcaccactaaatcgacttcttycaaagtgaaggctcctccatccaagctttcttatcattgggctcaaggttgaaagccagtaaaaagttttcttattgaagactgaaaccacccaccaccgtccctggttaatcataaaagaagcgttattctaaaaaactccagttctcgctgagacagctgttgacccaatttgtatacaaatgtgacactctgaacctctctggtttagtatttgatagcccaacagggtgactatattcaataaagattcaggctgggtgcagtggctcctgcctgtaatcccagcactttgaggggccaaggcgggagaatcagttgagcccgggagactgagaccagcctgggcaacacagtgagacaccgtttctagaaaaaatagaaaaaagccagatgcgcgcctgtagtcctagctacccaggaggctgaggtgggaggattgcttgagctcaggggttggaggctgcagtgaaccctgatcctaccactgcactctagcctgggagacagaatgataccctctctcaaaaaaaaaaaaaaaaaaaaaacaaactgtacatttaaaaataactaagagtaactggattatggttgaatgcttgtggtgatgagtatctcatttaccctgatgtaattattacacatttatacctctatcaaaatagctcatataccccataaacatacacacctactatggacccacaaaaattaaaaataaaaaagaaaagcctctttggtccactcagtccaccacccgtattagaatgtaagagtttttttccttgggaaaagtgtccgacagaaccaaggctcggtaaaggatactaataatgtaataatataatattaacaaacatctactgagctttaaatacgtggcaggcactgtgctgtgcactttatgtgcattatccaaattaactctcagtaattccaggagttcttatcaccggggtctgtggaagaggaaatggtggtttacggcaatttccgaatgtcgcacagtagaaagtggaccagcaaccagggttgcagatcccaaagtccgggatcttcaccatttcacccaaccgccttagagacctcccagcaaaaggtctaagcacgaatgctccagaaaacaggtccaggtcacgcgtgccttctccctttccctctgggctcgacagtggtgcacagagcgactagggagtgggggccgcggttatttcattagaaaagctctggagccccgggagcccttcgtcccaggcgcacttgccctgcaagcccttctggaaggcggcagcgtccaggcggtccagcgcatcgagccgcgccaggcgcaccgagatgcccccgaatctgtccagctcgccctgcagatcgcacgctccaactggcggattccgcacgtaaccctgtgcgcccgaggcccagcggtaacccgccgaaggcccggggccgtaggttcgggcaagcatcgcgcgccagcggccccagctcagyggctgccgcatctccacgccgcttrattcgtccgttgcccaaatgacccctccgcgctccagagcggagatcgcggccgtacattttagaagagtgccatcaataccctcagagttgagctggggttaccactctgcagagctatgccaaggagaccgcgaagtggtccaccagcccttctcagcaatttgccccgctccagttaagcgggraaaacctcctcccccaccgccactcacttattttgtttggtagtttaattcaacagacgttggtttagggatggggaagccgggaggagatgcaaaaacgtcctgtttttcaggaatttacaatctaagtggcagttccgttcctggaacctatcttctttcacagatgccgttacagctgtttcaaagactgctgkttttgaaaacgctcagtccctcccaccacgctgtgcactgctgcgctccactcaggggattacggcgcaggggcggaccctcgctgacttctgccccggaagtttttctctcagttgaagcgcgcacattgagtcggcttttctactgcttcggctagggtaccttgtgaccatgtcttccaagaagaatagaaagcggttgaaccaaagcgcggaaaatggttcgtccttgccctctgctgcttcctcttstgcggaggcacgggctccttctgctggatcagacttcgcggcaacctccgggactctgacggtgaccaacttattagaaaagggtaaagaattccgggtgggagactagaggccgagggggcgcaacctgaggggcgggagactcagtgatactgacttggggtgcagagacttttgaaagttgggcgtggcatgggtctgagagcggcacagaagcgtgtaagacttctgtatgtaagaagcatgcaaacgtagccgcgcctgcactggagaagttaggctgaaatggtttatccgtgtccaaggtttctcttttgtaaattattttgaatttttaagttgcacttgaaacgctttgtctcatttaacattaacgacacatttaattgcaaaattgttcataactagcgaacatgggatacttatcctaaaaaactaaataaccaattcagtaaaaatgtggatcactctgcctttaggagtgatgatagcattttcttccagtactacgcaggttatgatatttaataactgctagtaactgcacactagtgttagcagtatatatagctcatctaatttctacagaagccgtgaccgatgggtatagtaatgacagttttatagagggaggaaasttaacgtgattccattcaggctacacaggtgctaagtggcagagccgatatttgagtccagatgtgtttgacttaaaagccattcctagatgacagctcctttgatttgggagaacgtatttatactgaaaagtcttataaattgaattaaaaattgaaaatttatatttgatgtgtaatagctttgaaaaatggaccagactagtggcaaaaacttttatgtctaatcagaccttaaagacaatttagagttmacatggtattttcactctgccttaggtatcagaggacaacttgttctgtcctgaaggttcaacttgtttttgaactagatccttcccattgacatgtaaacatgctcatttctcttccatcttaaatcagaacaaaagctccacattttcttcctgcaaccgtctctctrtccattgccaagcttcttraatggagtggtctctgccgcctcaccacttacatactctccctagcctattcctctttgacttccaccccatcattccatggaaactgttcctgrtgtggtctccgagcatctccgtgttgataaaccttacgtgaccacagcaacttttggtattgttgaccattccctccttctcgaaacacttaacttcttatgtgttgtcaaacttgcctggttttcttcatctttgttgatgtttcatcatttttctttgcaggctcgtcctcttcccttgaccattaaatgttgaagttcgtcaattcttagtccaaaaccttttttttcctctcaataaatcctgtctccttggcaagttcatccagtgcccagagtttcccatctatagtctcttcagtgtcagatttatatttgtaaatcttttgtttttgcgccttgatgtggttgccttttagccaaatgcttctcaagctctctgtggtgaagactttaaaatttataataggtcacagatcrgcacttttctaaaatacagtaaaaatgattttctagaaaaataaggaaaaatttttattaaacagatgtgaaattactctgtaaatttcaataaaagcttctatatacttwttctcctgttttgtacttgtcatgaagcagtaacaaatcgttgtgggtcatattttgaatagcactgtacaataactcttctcatgagtgtcccaaagatacttcaggactaacttcatgagcccgttatttcctccaacaaaataaacttcaactctgttcagtttttcccgctgcaaaattcagaaacctaagagtcatccatgactctcccccccatatctcacatacctagtccaccactaaatcatgtttattacctaaatattttacatattcctcttctgcatgccattcccactgtttctaccttaatttcagacaccatcatctctcacctggactgctacaacagccttttgactgattttccagcttccaattttgccccttattccttttccattctgcagccagaatgatcttgtaagatgaagatcttgtcatgacattgcttttcatccctttctgggctcccactgctgtcagagtaatgaccagcatcttgatgcagcctattgcactattgtcctgggtggtcttgaccttctttacatggcttccctatgtctccaccactctgcctatactctcctgaggatgcgccatacccccttctgcccaggaactttgtacatgctgtcctctttgctgagaattatctttttcttctcctcatttagttagttcctactcttctttcagacctgatcttaacatcacttcctttgagaaacattctcttatttgaaattaggtcagatcccacatggctctcctggcactctaagtcattttttcattgtattaatcttagtttattattttacagctatccactgattgtttaataactcactcatcctacaaggctataaactctgtgagaccaaggacttgtgaacaaaagtgcctagcatagtatctttcatatagtaggcacatagtacatatttgctgaatgaataaatgaagggtggatggttgtttgaaattatctttactatcttgttagttaatgtgatacttaaggtgctcaataaatgtgaaagtagttaatggggaaattagatgttgacatatttttaaagtattggaggagtgaggtgagaagggaactgtgtggacaacttgagtagacctatatagtgtaagcagagaacacgttggtgatgttttggaaaatgagaccagtggctgggaatttgaacatgattaccattgaaagacaaggtggagaataaatcctgggacatggagaatgtgctggatagggtggaaggagaagaagaaaactaaagtcttgggaaggactgagaacacttgtgtggtaattgtcaagagggaaagatagttcattgaggtttaggaagaaagaggcaggaactgaatattatgagatcatctaacagcagtatgctttactgttaatgaccagcaaacaatgtaagagaactaatgctcattggaaggttgaatttctgtccagcttcttgtattatgcagtatgtgttcatttcgttttatactcagtgctgttcatcttagctctgtgagatgctttgtttttctagatttgcacctcatataagaaggaaaagaaatgtgttggggagttgttttgtagtgacagaataatgtaaatcatatgggtaccttatggttttcctttccttgatttaatttcttttttattacagaatatctgttttctgattattaaggaaaacttaggtagagctctgtgattatggtatatatgtttacaataaattttataatgaagttgtgacatttttaaattctctaagtgtttcatagattttgtgctgaaaagaaaaccattgtatacttatttactacatttattcattttatggctatttattgtgcaactgctatatttaatgcactgtaagcattggagatacagagagaaataggacccaattcctgcttcaaagcagtatacaattaaggagaaagactaaaacaaatgaatattatggtaaatgctattaactggcagcacagagtgctggaggaattagaggagggacacctaactaaatatggagcttggtgggggtggggtggatagaaaggagtggagatgacagcacatcattttcagaggtgttgttaactggcctgaattctggaccccctttttcagccaaaagttgaaatcactagtggtgtgtgttcgtataaggaagacgacttctgttactmtctttacgtattcttggtaatacaaaagaaaaagatctggtgaccataatgtggggcagaagtagaaacataacttaatcctctagagccagatagatgtgccagttcccagttcaatcctttgaatactagtagctgactcaactttgaacttaaagctcagagactctcttttgcaattatgtttacttcttaatgaaattagagactcagaaaaaaagaaaccaatactcaccccataaaacatcttctttttagttaatacttaatatgttgccagtagaccctcaaaagcatttgattttaaatctgttttgttataacaaaagttggaacactagtttctccagggtatggtaagtacattcatgtggttatatggttagagtatttttatttactgcaaaagaaagcatgccttaacttctgttacaaagtagtacaaaaataattttcttttccttcatagtagatgacaaaattcctaaaacattccagaattcccttattcatcttggactcaacactatgaagtctgcaaatatatgtataggtcgaccagtgttgcttactagtttgaacggaaagcaagaggtaagagtctttttcatttccttagtttagaaatacaaactgaacattgcaaatccaagaatctaaactctgaaatgcttttgagtgccatggtagtcaaaggaaatgctcattggaacattttggatttcagatttgggatgcttagccagtaaacataaggcaaatattccaaaatggaaaattcaaaacgctcctggtcccaaacattttggataagggatactcaacctgtgtttgagatgtttctgattttaattttcaacacaagcaggaataaatgaaaaactgtattttaaaagacattaacatgtatattaactctgttcctttgctgtctatgactctgctgggcatagtagcccctaaaatgttatgtagagagaagtgttgcctccggcgatagtgacagtatttctccctgtcagttagttatatttctttataaaaatattattttgggggtaagaaggtcacctgttctgtatataaatattttactattctcccttgtttcagctgtttctccttgctgtcatttttcatacctgagattctaagcctggaacctttcctggatcatttttggcagcttggctttcttttctgctaccagccccttatctttcatggcttcctttgatgcttctctgatttgctggggatcctttggaaatactttgaaattttttgtctgctgatggcacccctcctattcttttcatttttctggcttatgctttaaaggtcctttactgtgtcttttagaagagaggactataaatgtgtgagcttaagctagaaattttcgctcctccctcttaacatttaaatctgataagacccaggttctgacaaagctcttgttctgtgtccctcactatttcctggatgtagtttaatttccaggctggattactttacaagttattttgccttaatatttttgtcattttctcattatcacctgttaatgcctttatcttttttcatatatttttcatatcttctaccgtcttcactgtgggatcattcttgatctttagaaaaagatgtaatatttattaaaaagtttatttttcatgagcccatgtagtatttaaattttttaaaaaatgcaatktatcttattgcaattggtatcagattgtaactctttttgggtaaagactstattttgcatatcttaagtgcttgactgtgcttagcattctaccttataaattgatggtattctatgaatatttattttctaacatttttatttcctctgtctggcaggtgtatacagcctggcctatggcaggatttcctggaggcaaggtcggcctgagtgaaatggcacagaaaaatgtgggtgtgaggcctggtgatgccatccaggtccagcctcttgtgggtgctgtgctacaggctgaggaaatggatgtggcactgaggtttggctcttttctttggtgactatctggatcaaagctgcccagtagaaatataagagtcacaaatgtaaaccacatatgtaattttgcattttcttgtaacattttaaaaagtagagagaaacaggtacaatgaattacaatagtatgttttatttaaccagtatatataaaaatgtattttaacatgtaattataaaaaattaccaataagggctgggcgcggtggcttatgcctgtaatctcagcactttgggaggccgaggtgagtggattacttgagctcaggagttcaagaccaacctgagcaacatggcaaaaccctgtctctacaaaaaatacaaaaaagaaaatttctgggcatggtggtgtgtacctgtagtcccaactatttgggaggctgagacaggaggattgcttgagcctgggaggtggagattgcagtgagctgggatcgcgccactgcactccagcctgggtgacagagtgagactgtgtctcaaagaaaaaaaaaagttaccaataagatattttgcatcctttttttcaagctaagtcttcaaaatcaatgtgtatgttacacttgtagcacatcacagtttggactagccccattttaaacatttgatagctacatgtgctgagtggctagtggccacttgtgttatattagacaacccaagctaaatgagtgctatataatttatagactaaggactttgattttccatgattagagtgtgccctgacattttaggtgagagtaattttcattgatgcatatttagcagtgtttttcaccttgacttgcagtgtaatcagggcttcttattttacagttgtaaagaaaagagtagattactgtgagtcaaacagaaacaagttttaattaagactatgcaagcaaagaacctgattgtatattttaacttgttgattattcgatttagtaaaacaaacsgtcattactatcagattttaaaataatccctcaccacagggtaattgtttgaatctacctatcaaggtagttaaggtatatcatccatcctcctggatattctattatctaataggatatcgacttggtttgcatatacaagtcttctcaaaaatcatttacaaaaagcatctttttatactttaatgtcaccttagtaatagtttgggggatgtgtttacattatatgtgagaattacaaaccattttctagtcatcagcttgattttaatatgttctcttttgctactattgtagattttagacttgagttttggcatattttttcctttataacaggagaatgttttcagagcttatagtaacagtttaatgaacaataaaaagcagaagggacaggagacaatatgttgagtaccggctgtatacagaagctttktatatattgcatgtatgtatacacacacacacakttacccttttctttttaaacagatgaaatagtctgaggagaacttgcctaatattttatgaggtagttaatagtactgttgagattaaactggattattcctcagactatgtcttaaaatggtgctacaggtagcagtaattcgttgactggaattagcatttatgatgacctacaaactagtcagacctcttgagcgcacagcagtcttaggtgagtaatgattgcttattagagaggactggatatgttttaaatgaaagctcaggttttaaaattttgttttaaaaaatcttatgttttaaaaaatcttatgtttaaaaaatcttaagtatagacaagaaagttaacttccagttgggaaaatcagtcattttagtctgcttaaatccttcmgttgcaactgtaagattttattattaatagtaatgttagagctccttctagtggaaattattttatgtgcaactattatttttttaaaagcaaaattggtttgatatttttactgtttttacatgtatttgtaaataccttctattcagagtttaacaaaagcaatttaagtataacttggtttagagttccataaacaaaagtaaatgtaagcatttaaggagatacatgcaattttctcattagtttatacatatatttgattcatgaaatttccccctcattgtatttctctcttgttctctcttttatatgaatatatagttgattctcattatttgtggttagttatgttctattaaagttgccttgaacaccgttagcaaatactgaaccatttctcctagagggaaataygtatgtgtgtgtatatacatacatgcaacacacacaatatatgtagcgtatgtatatatataatatatatacatacacacacattttacatagattataaccttaaaactccaaagtaattctttctggtagattttattttctttattttacaaaacagaagaggagatttagaagtgttagaaatgttaagggacttgcctgaggtgctagtgctgggattcacactccctccaactgaccccaggcctggagcttcttcactacactgctgtgtcccctatcacttccattctctggtcatctctgaatgaaagctgaaacaaggcagagtgtcacctcatcctacatggtaacatgggtgttgggtcacccaaattttttgctgctcttccatgtcactaatgascacaaatgctctgtgagtattgattttggggtacacataagtttttgggagttggtaaatttgcaaatacagcatccacaggtattgaggattgactatattgtattattactgataaaagtgattggaagccagacgcagtggctcacgcctgtaatcccagcactttgggaggctgaggtgggtggatcgcctgaacttaggagttcgagaccagcctgggaaacatggtgaaacaccgcctctacaaaaaatatatatgtataaaaattagctgagcgtggtggtgagcgcctgtgttcccagctactccagaggctgaggtgggaggatcacttgagcctgtgaggtggaggttgcagtgagctgagatcacaccaccgcactccagcctgggtgacagagcgagacctcatctcaaaaaaaaaaaaaagtgattggagaacaaggtattttttgaccagatgggcacacaggcacatgccaccacgtctggctagttttcttttgtattttttgtagagatgaatttttgccatgttgcccaggctggtcttgaactcctgagctcaagcggtccacccacctcagcctcccaaagtgctgggattacaggcatgagccaccatgctcagttccaatcacttacacttccccttgagctaaactgtcccccctccactggtcactgacagaactagacagctgtttgtctcccctcctgatatgggctgcttatgcacaagaggaggaggaaaaatgctcatgttctgagaactcctcaagagcagatttctttataaatgtatgatatttaggtgtgttcacttcctgcacttaagcaactctctggggtgacacagttatcattaggaaggaggggatctcatttttccttggtcatgccctttctccagaaaaaaaccttcattgtaaccattactcctctttttcctacttctgccttttcaagtaacatactgtataggacttaattttcttgaagaaataatttgtaagttatactgagagagtgaagtaagttattaattagagtctttctccaagctaggcaactttataaagggaattattagtttaggtcagcattttaaaaatgtttttgcctatgacaataaaaaatggatttttcatcagattctttgtatatacacatccatagataatagtgctcatatgtgtgcatgtgtgtatgtatgtgttagaagttaatgttttacaaagcagtatttaccctttctatattcagtgtaccctgcatttcttattctattaacaaagtgctgaatgaggctgactgaaatgatttcattacccttgtgttttgaagaacattgatttaggccactaaggcaccagattccaaatgatattttcatggctatatgtttctgaaaaatgcccatcatttcaaaattgtatacattatttattttaaggttgcaggtggattattcttttgaytaagtctatattataacyatatacatgtaattttacatcacagtttagtttctggtgtacctaatgctgatttctgttcccttcttatccttttacagtgacaaagatatggaaattaatgaagaagaactgactggttgtatcctgagaaaactaggtgagacaaatattttaaattgttttcttaagttttaagctgcaaggcatcagcaaataaagtgtctttgagggcttatatatgcatagtagttttcttcaaaatagctttgagaatattcccctcaatgaatgaatatacttttaagatagggatgtgctacttttcctggttaattggcagttgagcagtggaaagaatatatgacttgtctgtgraaagagtcagtggtagaattgagacttttaacctttgcattcttgccctttccagtgacagatgctatcttggagtgttggtttgggtgtgccattttcatttagtttattattgaatatggaatgcctggctatttgttgatgtgattgatagaatctgagatctactgagtgtggaggatttcagagaatcatttccttctgtctccagatggtgttataggggaatattaggtcctcaattttttatgacaattattttattaatactctgtctttgatttagtcttttcagataatagatgaaatatattgctatttaaacattaaactggtaaaaaaaattatgctaacatgtatatttaatatactgttttctagatggcaagattgttttaccaggcaactttctgtattgtacattctatggacgaccgtacaagctgcaagtattgcgagtgaaaggggcagatggcatgatattgggagggcctcagagtgactctgacactgatgcccaaagaatggcctttgaacagtccagcatggaaaccagtagcctggagttatccttacagctaagccagttagatctggaggatacccagatcccaacatcaagaagtactccttataaaccaattgatgacagaattacaaataaagccagtgatgttttgctkgatgttacacagagccctggagatggcagtggacttatgctagaggaagtcacaggtcttaaatgtaattttgaatctgccagagaaggaaatgagcaacttactgaagaagagagactgctaaagttcagcataggagcaaagtgcaatactgatactttttattttatttcttcaacaacaagagtcaattttacagagattgataaaaattcaaaagagcaagacaaccaattcaaagtaacttatgacatgataggaggattaagtagccagctgaaagcaattagagaaataattgaattgcccctcaaacagcctgagcttttcaagagttatggtatgatgtcttcagtttattgcacccaaaaatgttaaattcaaattaaaagacagttgacacttatgtaatgattgctcatcctcttttcctgtttttattttctgagtagtaggtatggtagaagatttcagttgctttgggagatgccagttaaatgggccatttgctatgctttggtatttttaggttgtaatgtgaattagtgacagccttgtctcttctaatagcatatttccacaattacctgtattggatctagaataagtatcttgtcatgctgggtcatctgtaatgactgaagggataaaccattcaaatacattagrtaaaacttcttaggaaatgtaactgtgtacccatctctttgcactgaagcaggtaattacgggaatggcttgactcaggaaactcagggcttctgctgcattgttattgccaagatcctttgcatatatttgctgtgtctgatctctctgcttttttcctttctcataaatcttatatatacatacatgtatgtatatatatgtatgtgtaaaatgaacccttagattggcattttgctcatacttatgtaccttttatactagcaaacgtatgtactcttcaagatggttagttggaaaaaaactgggattggtggcttgtctacctgtgttgtctgtgcttggtttttcgatcattgatctgtgttgtgtgggatggggcgttgcaacaatgtgggtgtccagttttttttttttttaaccaacatgcttcctctgttctgtggtctacagagagagaaagtcattgctgggtatcagtgtttgggctagttagtacatctttctggagggggagaaaaaactcttgactctttttgtgacgcaaggtaaagttaaattttataactcatgtttgaacttgtatgacaacatttataagaaacctagtaatggtgaatctagtgttttctactttttcttccaggaattcctgcccctagaggagtgttactttatggtcctccaggtactggaaaaacaatgatcgccagggctgttgctaatgaagttggagcctatgtttctgtaattaatggtcctgaaattataagcaagtaagtacatgatttaatagagtaaacttactattaaatatatttctaaaatgtggtttttaaaaatgattgtgtagtattctgtgtgatattttgtacactgaaatattttgcttcttaataaaaattgtttggaaaattctttttgaaagtaattttaagtattatagaaatattgaaaatttaggttagcttttatagacaaagctttaaaaacaataagaaatggtctttaaatgtattttatttgttacagattctatggtgagactgaagcaaagttacgtcagatatttgctgaagccactctacggtactctttatttttaaatgttttggaattaataatcaaggctgtattagtcaaagtgagatactagcaccttatacaaagcataaacagtagtacaaaaattatagtgatagtggtagaagtagattatagatctaatgaaattctatttctatctaatctttaaaagtttgataaatattattaaattacataaagtagaagaattaagacatagtgtttgataagtcatgtgaccttgtttgagcatagaaatccatgactttctttaggtgcttaggtgtttctaatatgcttagcttttctagtagactgtattattgtatgtagctctttatactagaactttgttatgttatactttgcttcaaagggacaaatcttttgcccattaaataatgactctggctgggtgtggtggctcatgcctgtaataccatcactttgggaggccaaggcaggaggattrcttgaccccaggagtttgagaccagcctgggcaacatagtgggaccctgtctgtttaaaaataaaaataattggctgggtgcggtggctcacgcctgtaatcccagcactttgggagaccgaggcaggcagatcacctgaggtcaggagtttgagaccagcctggctaacatagtgaaaccccgtctctactaaaaatacaaaaattagccaggtgtggtggcaagtgcttgtaatcccagctactcgggaggctgaggcaagagaatctcttgaacccaggaggtggaggttgcagtcagttgagatcgtgccattgcactccagcatgggggacaagagcgagactttgwctcgaaaaaataaaaataaaaataattagttgggcatggtagcacatgcctgtagtcccacctactaaggaagctgaggcaggaggatcactgagctgggagatcaaggctgtagtgagccatgatttcactgctgcactctagcctgggcaacacacaccccgtctcaaaaacaaacaaacaagcaaaatcaaaacagtggtagagacatagccatattatgagtgacgttaygtttgaccaagttatagaccaatatcctaatactcattacagtgtaacattgaaatctaaattccctgagctcaagtgatcctccccctgtagcctcccaagtagctggaactataggtgagcaccaccatgcccagctaatttttgtatttttttttctagcaacagggtcttgctatgttggccaggctggtcttgaactcctgggctcaagccattctcctgcctcagcctcccaaaatgctggctgtcttggtgtttaatatcataactactgctcttgaatcagaaaacccaccatttttgaagtttatttttttcccscaatgatagtagatgaagtaagcagtttgtagtcctagtactgtactgaaaatttgaaaactagtggtacaccttattgtttagtatgcttttgttgttgttgtgttcatggcagttgagatttccttctgtgagagaattcacatctgtttatgggagaattgatcatcttgcaagtttttattttaatggtttaaaaataacagggcatttctagtttatgtcctttggtttcaaacctgctccaagggatagtatctctggcctcagcttctgaattgatccagtcataacaacttaatgggcattactggggagagttcttaagagactcttatcttttaagcagcatactctactcaattacccagccttttaatggagggcagatagaatagaatatgaagttagtgaaktagtattttgggctagaatgaatctaaggatttttagcttaacattataatatctttataatattaagtgaattctaaatttgatatgttgcatttcagttaaaaaaattaaaactaagtaaaacttaaaatcaaatatagatgagagatttcattttacttgtttgtttttagacacccatcaattatttttattgatgagctggatgcactttgtccgaaaagagagggggcccagaatgaagtggaaaaaagagttgtggcttcactcttaacactgatggatggcattggttcagtaagtatagcactagtattgattctgtgtagggttaattcttaatacttatgtgtagtggtaaaaactattgaatgtgtcagagtctttggatattttaggataaaggaaaaatattagccatagcaactaggggaaagatctgtaaaataatttgctttagtagattacttagtaactgctaggacaacatcataacctggcaggttttttctagcatataaaatactataccatgatggatttattttgtgataaatgctgttagctttaaaacttgaagcaaagatcagtaaggaagatttagcagttaaattttaggggattttattttatttttatttattattattgtttttgagattgagtcttgccctgtcatccaggctggagtgcagtggcgcagtctcagctaactgcaacctccaccttccaggttcaagcgattctcctgcctcagcctcctgagtagctgggactacaggcatgcaccatcacacctggctaatttttttttaaatcttcttagtagagatggggtttcaccatgttggccaggctggtctcgaactccttaccttgtcatctacccgccttggccttccaaagtgctgggattataggtgtgagccgctacatctggccttaggggtttttattaagaaatgtcatgagtaagtcttattacccatgtacaaatggactctttcaaggctttgtactagggaaatgaaagaaagtgagaataatgcgaaatgttttgtataacatttaaaaaaaaacttattcatattaccagattctctcataggggatatgttctytctttttttttttttttttttttttttkggagacagagtttcgctcttgttgcccaggctggagtgcaatggcacaatctcggctcaccgcaacctctgcctcccaggttcaagcaattctcctgcctcagcctcccgagtagctgggattacaggcatgtaccaccacgcctggctgattttgtatttttagtagagacggggtttctccatgttcaggctggtctcgagctcctgacctcaggtgatccgcccgcctcggcctcccaaagtgctgggattacaggcgtgagccaccgcgcccagccgggatatgttcttttattaataaaaactatatgctaattatggaaggaacattcataggactaataagagaataggcatgaacaaaaattttctaagactcctgacatccattaattagaaaaatacacttttcatgctggattatgaataagtaaagtttttagaatcataatatgttagaaccacaataaattttagaaattatgtagtatcaagcctcttttgcacattaaaaagctggtcatttagaatttttttttttttatactttaagttttagggtacatgtgcacaatgtgcaggttagttacatatgtatacatgtgccatgatggtgtgctgcacccattaactcgtcgtttagcattagttatatctcctaatgctatccctcgcccctcccccaactccacaacaggccccagagtgtgatggtccccttcctgtgtccatgtgttctcattgttcaattcccatctatgagtgagaacatgcagtgtttggttttttgtccttgcgatagtttgctgagaatgatgatttccagtttcatccatgtccctgtaaaggacatgaactcatcattttttatggctgcatagtattccatggtgtatatgtgccacattttcttaatccagtctgtcattgtgggacatttgggttggttccaagtctttgctattgtgaatagtgccgcaataaacatacgtgtgcatgtgtctttatagcagcatgatttatagtcctttgagtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgttgtttcctgactttttaatgattgccattctaactggtgtgagatggtatctcattgtggttttgatttgcatttctctgatggccagtgatgatgagcattttttcatgtgtcttttgactgcataaatgtcttcttctgagaagtgtctgttcatatcctttgcccactttttgatggggttgtttgtttttttcttgtaaatttgtttgagttcattgtagattctggatattagccctttgtcagatgagtaggttgcgaaaattttctcccattctgtagcttccctgttcactctgatggtagtttcttttgctgtgcagaagctccttagtttaattagatcccatttgtcaattttggcttttgttgccattgcttttggtgttttagacatgaagtccttacccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtccaaagatcagatagttgtagatatgtggcattatttctgagggctctgttctgttccattgatctatatctctgttttggtaccagtaccatgctgtttggttactgtagccttgtagtatagtttgaagtcaggtagcatgatgcctccagctttgttcttttggcttaggattgacttggtgatgcgggctcttttttggttccatatgaactttaaagtmgttttttccaattctgtgaagaaagtcattggtagcttgatggggatggcattgaatctataaattaccttgggcagtgtggccattttcacgatattgattcttcctacccatgagcatggaatgttcttccatttctttgtatcctcttttatttcattgagcagtagtttgtagttctccttgaagaggtccttcacgtcccttgtaagttggattcctaggtattttattctctttgaagcaattgtgaatgggagttcactcatgatttggctctctgtttgtctgttatyggtgtataagaatgcttgtgatttttgtacattgattttgtatcctgggactttgctgaagttgcttatcagcttaaggaagttttgggctgagacagtggggttttctagatatacagtcatgttgtctgcaaacagggacaatttgacttcctcttttcctaactgaataccctttatttccttctcctgcctcattgccctggccagaacttccaacactatattgaataggagtgttgagagagggcatccctgtcttgtgccagttttcaaagggaatgcttccagtttttgcccattcagtatgatactggctgtgggtttgtcatagatagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcatatattgaaccagccttgcatcccagggatgaagcccgcttgatcatggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaattctcttttttggttgtgtctctgcccggctttggtatcaggatgatgctggcctcataaaatgagttagggaggattccctctttttctattgattggaatagtttcagaaggaacggtaccagttcctccttgtacctctggtagaattcggctgtgaatccatgtggtcctggactctttttggttggtaagctattgattattgccacaatttcagatcctgttattggtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtgctgatatcccctttatcattttttattgcgtctatttgattcttctctctttttttctttattagtcttgctagcggtctatcaattttgttcatccttccaaaaaaccagctcctggrttcattaatgttttgaagggtttttttatgtctctatttccttcagttctgctctgatcttagttatttcttgccttctgctagcttttgaatgtgtttgctcttgcttttctagttcttttaattgtgttgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgagtttcttaatcctgagttgtagtttgattgcactgtggtctgagagacagtttgttataatttctgttcttttacatttgctgaggagagctttacttccaactatgtggtcaattatggaataggtgtggtgtggtgctgaaaagaatgtatattctgttgatctggggtggagagttgtgtaggtgtctattaggtccacttgttgcagagctgagttcaattcctgggtatccttgttaactttctgtcttgttgatctgtctaatgttgacagtggggtgtgaaagtctcccattattattgtgtgggcgtctaagtctctttgtaggtcactcaggacttgctttatgaatctgggtgctcctgttttgggtgcatatatatttaggatagttagctcttcgtgttgaattgatccctttaccattatgtaatggccttctttgtctcttttgatctttgttggtttaaagtctgttttatcagagactaggattgcaagccctgcctttttttgttttccatttgcttggtagatctccctccatccttttattttgagcctatgtgtgtctctgcacgtgagatgggtttcctgaatacagcacactgatgggtcttgactctttatccagtttgccagtctgtgtcttttaattggagcatttagtccatttacatttaaagttaatatcgttatgtgtgaatttgatcctgtcattatgatgttagctggttattttgctcattagttgatgcagtttcttcctagtctcaatggtctttacattttkgcatgattttgcagcagctggtaccggttgttcttttccatgtttagtgtttccttcaggagctcttttagggcasgcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacctgacctttctctctggctgctcttaacattttttccttcattttaactttggtgaatctgacaattatgtgtcttggaattgctcttctcraggagtatctttgtggcgttctctgtatttcctgaatctgaatgttggcctgcctcgctagattggggaagttctctttgataatatcctgcagagtgttttccaacttggttccattctccccgtcactttcargtacaccaatcagacgtagatttggtcttttcacatagtcccatatttcttggaggctttgtttgtttctttttattcttttttctctaaacttcccttcttgcttcatttcattcatgtcatcttccatcactgataccctttcttccagttgatcgcatcggctcctgaggcttttgcattcttcacgtagttctcgagccttggctttcagctccatcagctcctttaagcacttctctgtattggttattctagttatacattcgcctaaatttttttcaaagttttcaacttctttgcctttggtttgaatttcctcccgtagctcggagtagtttgatcgtctgaagccttcctctctcaacttgtcaaagtcattctccgtccagctttgttctgttgctggtgaggaactgcgttcctttggaagaggagaggcgctctsctttttagagtttccagtttttctgctctgttttttccccatctttgtggttttatgtttgtttggtctttgatgatggtgatgtacaggtgggtttttggtgtggatgtcctttctgtttgttagttttccttctaacagacagggccctcagctgcaggtctgttagagtttgctagaggtccactccagaccctgtttgcctgggtatcaacagcggtgtctgcagaacagtggattttcatgaaccgcgaatgctgctgtctgatcgttcctctggaagttttgtctcagaggaatacccggccgtgtgaggtgtcagtctgcccctactgggggtgcctcccagttaggctgctcgggtgtcaggggtcagggacccacttgaggaggcagtctgcctgttctcaratctccagctgcgtgctgggagaaccacggctctcttcaaagctgtcagacagggacatttaagtctgcagaggttactgctgtctttttgtttgtctgtgccctgcccccagaggtggagcctacagaggcaggcaggcttccttgagctgtggtgggctccacccagttcaagcttccgggctgcggctgctttgtttactgaagcaagcctgggcaatggcgggcgcccctcccccagcctcactgccgccttgcagtttgatctcagactgctgtgctagcamtcagcgagactccgtgggcgtaggaccctccgagccaggtgcgggatataatctcctggtgcaccgtttcctaagcccatcggaaaagcgcggtattagggtgggagtgacccgatattccaggtgctgtctgtcacccctttccttgaccagcaaagggaactccctgaccccttgcacttcccgagtgaggcaatgcctcaccctgcttcggctcgcacacggtgcgctgcacccactgtcctgcacccactttctggcactccctagtgagatgaacctggtacctcagatggaaatacagaaatcacctgtcttctgtgttgctcacgctgggagctgtagaccggagctgttcctgttcggccatcttggctcctccccgaactttttgttttttactgtctagtggcagaaagtaaatatgtgaaaataatataaaggtttggcactaagtcacttatatactaacgtgttagtaattttaagagtctgtaagagaagggttgtcacctggtggaggctgcctgactaactggttctcagtcttggaacagtacctaggagtgattttcatgtcccaggttgattctcaggttataaagttgaagaattcagtgttattagtaggctggagatgatagagttgtgaggacagactgacccatgataataacacttacaagagaatcatgtataaaatagtgtcctagtttgtccatttacagtaagagatgtgactgttaagcagaccaaatgtttgtgtttatggatgaccatattttcaccttgatggcaaatatagagagctgtcttataattacaagggttcttggtaggtaggaaatcagatgaaaggcttagtgttggagaatcttaattatttcaatctgctgtctctttctctgccactgggataagcctgttgtggattagtattcttgcctttgggcaaggaatggaaacatgtgatactgatgttttagtctgaatatttttaagggtctgtttttgtacttctaaacttataattcatagattcgctgtagtccatgcattgtctgttggcacattcagtataattgattaggtttgagctttttttaaatttttttttttaacataaattgcattccagttatgcttgtctctgggtcatctgaatagaatattggataatttctacaggtggctgatcatgatcatagttctttattatttggttttcctaatttcattttcagagagtaaaaatacctatatattcaaatgtggctgatacttggatattggttatattgttgactcttattttcaggaatttaaaaatgtatccatattaaaaaaactagtctataagcgaagactttttagataactttctaatagaatcttgttctatttgagtattatatgtgtcagaatcctgactttcaagtaggggaaaaggactgtttaaaacaattaaaacaattatatggtacatattatatatatgttattttttatgagaatgatacagttaagatgtgagaagtaagagagatgtcatagtagatggagaggtgagtattgtaaaactttctacaggaggaagcatttaggctgaacactgaaaaatgtataataaaagtaataaatgtataataaaaatgtattactaataaaagtaattgataggtaatgaaagcgtaagaaataggacttagtakcctggacagttagatgtttcatccttgtctatacagccagtgtgtgcctctcacttttttttttctaactttcagaaaaataaatttattttcattttattttgttaggaagtaagtgaaggacaagtgttggttcttggggccacaaatcgccctcatgccttggatgctgctctycgaagacctgggcgatttgataaagagattgagattggagttcccaatgctcaggaccggctagatattctccagaaactgcttcgaagggtaccccatttgctcactgaggctgagctgctgcagctggcaaatagtgctcatggatacgttggagcagacttgaaagtcttgtgtaatgaagcaggtgagtgtggtttgctatggtgagtctctattgatgcacttatctccagtttacttacatacaaataatttatattttacagatttcttaatggaagtagctttgtttctaattataaaatgtgtaatttttatttgaaaaaatttttattggaaaaacctagatgattcagaagactataaaaaaaaataaaaatcactcaatcctacctctaaaggataaccaccattatagtgtatacagtcagccctccatatccttgggctcagcatctgaggagtcaaccaactgtggtctgaaaatattcaggaaaaaaaagttaaaacagtaaaaaataataaaaacttaaaaaatatagtatcacaactacagttgacccttgaactatgagggcttgaactgcatgggtccacttatatatgaatatttttcaataaatatattggaaaattttttggagatttgcaacaatttgaaaaagcttgctttttctttagcttactttattgtaagaatacagcatataatrcatataaaaaatatggttaatcagctgtktatattattggcaaggcttcaggtcaacaataggctattagtagttagtttttgggggagtcagaagttatgcatagttttttgactgcacagggattggtgtccctgacccccaagttgttgaggggtcaactgtatttacatagcatttacatgggatcaggtaaaagtaatctagagattatttaaattatacgggaggatgtgtgtagtctatatgcaagtactatgccattaacgggcttgagcagtccttagattttggtatcttaggggtcctggaacaaatactccatagatactaagggatgactatatcctactagacttctccagagtatacacacacacacacacacacacacacacacacacacacacacacacacacacggacatgtaatcagatccattggtggcggtattgatgatgacaatatttattgatatattgtgctgtgctgtggaaatcagggagaagtgtaaactggagaatcacaattttccttaaaattgagtgtcatgctggacccctattaacttcagtgggatggtaccaagtttgagaggccaaagaagggacccagagccaataaatgaaacttagggcttatttggcagaacttacttacagggcggcccagtggtgatgggctggacaggagaactgcaatcacttgcaaaaagcatgcagcttgtatagcattttcacttagcatcctccccccagcaacttccacatggcaacctcctttcttaagttattgctttcaggtgcatctgccatatactccgcaccagcatacccttgcgtggccctcacattcttatgcctttctgtcatgagatccctggggccaggtatgtggaggagcattgcagccagatgctgcagtagcaatataaactacaataacaaaaaagaataacaaatataataacaatcatactgtatagaaagtttttcaagggcttaggagttgattaaaacacgtggttatagggttttaagacttagattctgtagtggaaatatgggtatttaaggcctgcatggcctgggttagatcgtgagagtcatcaggaatacatacacaacaggttttaattaatccataggttccgcccttgtgggggcagttaagatgtccagggccatgcaattttacaaagaagggtgcatgacacactatctctgtctcactgctgtcatccactctagcccatcattgtgtacagcctacctacagtggggagtgacattaacttgctcctttaccaggcggaaaatatgccatctcaygttgttggtggtgggaaacttgctgcatgaggtgctgttgtcgctgaaggggaataggtgaaggtcactataccaagtatcgaagtggccccaggtactcatgttaactgccttggtgtggcatggcaggcccacagcggaggagagggggagctctccgcagacccagcagtctgttttcttctggagagagataaccatctgcacccagtcagcaaagaggtttgcggcacaccatctatgggcaaaaggtgagttgtttagtgggtacaagaaaggacaagtcctggccatttaacaagacatggggagttgtgtcattctgagagagcaccacccctggcagcagcctgatgcctggtttacaataccaaatggactggctcccctctgtaatgtgttgcaggaggccagaggaagacagtggaggtatagtgtttcatgagaggatgttcatccccttgcacaagggaggactaggattcattattttagaattacagtggagagtatggtatgaaataggtgtgacatatatatcctgttctaggcccttcccccatggagcagaaaaactgaaccatcgggctggtttgccatttcccagaaccacgtaatgatgtgctccccagtaggttggtcctgtggcaagggccatagcagattactttgtgtcccaggttgggggcaaaggtctgctgtcccttaccctgtctacctgtatcctgatggtcgtatcacatccttgtgttagaagagtatacatgatggggtgatgagaatgtgcatatttattcagtttgtgcacggctgctggtaagcagcgtgtccacagagccaactcctataggagttgtttcaacagtccattcaatttgttcagtcagccccactgctgtagggttgtacggcaggtgaaaatgccagtggatatccagggcctctgcctattcttgtactttatatctggtaaagtacgagccctagtcattgttaattttttttttttttttgagatggagtttcgctcttgttgcccagactggagcgcaatggcgcgatctcggctcactgcaacctccgcctcctgagttcaagcaattctcctgcctcagcctcctgagtagctgggattacaggtgtgtaccaccacacctggctaattttttgtatttttagtagagacaggtttcactatgttgggcaggctggtctcaaactcctgacctcaggtgatccacccgcctcagcctcccaaagtggtgggattacaggcgtgagccactgtgtctggcccattgtcactattgatggagacgctgtaggctgcacacatctgttctggtccttttatggtggcatgcttgctgggttatgctcgttgtagccctgtgcaggtttctgcacaagttaaggcatagtggcagccatccaataggggcaaagatcctatgtagtctacctgccaccattgtgctgggctctggccctgggtgatctttctggtatcaggtggcaagggcctggggtgttcctgtgcaygggtaagacattgctgacagatgtgtactgtgtctttgtatcatagtggcaggctccaattctttgctatggcccaaagggtaagttgtcccctatgtcctgtcttcttttgtaaccagttgaccacatcgtctgtggggactcccttgaggagacgaatgcaggttaatttgtctgcctgttgatttccaggttggtgtagatgcagtgtggggatccacatggtagatcattttatgcatcccccagatgcaatggggaatgtccttctacatgtcagggcaccaaaggaggtgacctgctactgtctagtcctgtgcttcccattgtagtagccacatggtgagtccctttacattggattaggtaaaagtaatctagagattatttaaattatatgggaggatgtacataggctacatgcaaatactgtgccattttatataagaggcttgagctgtccttagattttggtatcttaggggtcctggaaccgataccccatagatactaagggatgactgtatcctatcagacttttccaaagtacacacacacacacacacacacacacacacamgcacgcacacacatgtaatcagatgcattgttggcagtattgatgaagacaatatttattgatatatcgtgctgtggaaatcagggagaaatgtgtactggagaatcacaattttccttaaggaatgtcatgccggatgcctgttaacttcagacagcccacctgtgagtacacaggactgctgggtctggcttatagaggaggaccatcctggcagcttgcagctcagctcattggctgctatgtccttggcctgtatcatcaatccagatcctgtcagtggatggctggatggctatgcctgctcaagtgcaaggattgcctcgtgacaagctgtttgtgtaccaggcctggtcagtcattgggcggtcagacattgggccctgtctatcctgtatgaaggagagcatctgtggaggctcagcagcctccctaaaagactatgtgacagttgttacatagatgacagggccaagcactgaatggagctctgagctcaaggggctattaatgtgctcctttgttgcaggtatgtaagccatttggccacagtctgtgtctgggcattcccagacttcagtttctggaagataccctttagccaacctgctttggggtactggctgcatactagcatcaggaccccttttgtaatgtcctctacttgttgtaaggcataatgtatagcacagagttgttgttccatcacactgtatctaactgcaccctttttccgtagctgggaccagaatcctaaaggcgcatatgtatgtctctgcctttgccacgggcctcacccaaacccctcaaggtaactggctacatctagttcacaggctgtctctgcacctgaactcacaaggcttgtatttatttcactgtgacttcagctggttcaaaggcctcatccttcttcgtgrattagtctcagtgggcccccttcttgactaaacagtataggggtctaaggagttggrccaaatgaggaataaaatgatgcccataccctaggagtcctaagaagatttatagctgctttggtgtcacacgatgtgagtaggcctgcaccctatccataatggcagactcaagtatttggctgataagcctggactctggatttttgtctgtgtttatagctcatcctgtttgccagatgaggcagcaaggtgtgagggcgcagtttgaaagctggaaaaagactcagaagttagcacgatatcatcactgtaatggaaaatgtgtaccccttccaggacctccatggctatataaatatccctggggcaagatggtaaaagtctattgttcttcccaggtgaatgcaaattggtcttgactctctgcggcaatggggatgctgaagaaggcattggttaaatcartaacagagtggtagtggtatgtgtccagtgcctctcccrccctctttagaagggaggtgatattgggaacatgtgcatacrttggggggactgccttacttaattcccagtaatctagtgtcattgtccatgtcccatcaggcttccacatgggccgtacatggctgttgtatgggctgtgcactggccttgtaatgcctccytgggctaactccttaacaatccctgtggtttcattatgtccccccagcaggcagtattgcctcagtgctactacttgctgtgtggggttggcaactakactggtgtccatttcgcattccccttggtcacatgcttcaccactctcagtcagaactccccagcagttgtttggagggtcaagcctgataagatatccattctcaagatgtattccaagatgggagctatacatactaaatagggttttggtggyagtctctcaacttgtaatactcagacagttcaacctttctgatccccatccataaccatcttttgccattttagccccttggaaccaacgaatgtcaccatatatgaaagtgcatttggctctagtatccactagggcacgcacagtgtgtttattcttaggcgaccaatatatagttagttctacatgtggcctctggtccccaggtaccctggccaccattactcttatcagggttctggggccttggctttcatccagtctaacagggttgacacttgctatccctctgcaggaagggtggcgggctgaacctgaggctccttagtgaagcactcttctggtgtgagcttctgccacagtctgaccagaacagcattaggctgtttatctgttttcatagtagctgttcctgccactaccaggttgtgccacatttgttggtcagtcaccctgatgggccccttggccrtctcctttcctttggcgcccttgtctttcatcccagcagcacgtaccctttgcctatgcagtttctccatttctcataagttggtggctgcttgggccacctgagacactggctgtcctactagggggctctgggtagacactagcacaccataccattggttgagtgcagactaagatggtgtctttcatgttggcagtgaaaagctctttgttggaccttggtgatgttcagcatagatagcatgtttcatccctaatttccagatgatgtcctgcaattcctccatagtctgccatcacaaaggagatatggggatactgccctcatctggccacgcttcattgcagcccacaaccacccagctaaggaggggcatggcctgatcctcattgttggcaccatagaggtgctgcctcagggctgggtggcatgcgatgtatgccattccactcatcttgagtctggagagtataacaccctccatccccgtgtcccatagacagagaagccacctctcaatcaactgtctctcttcctgaacccaccttctgcccagctccactagttccatagtggtgtagtgctgcattgtggtatgctaccatctttcaggcagagacaagttttgtgggtctactccctgcaggcaccattggtctgactttatcttggtagagagaacaggacctctatgggcttatcccagtcctcactctgctcctcactagagctctccactgggtccctggacttaggaagatttagtcatatagtcctaacttggcatgggagctggcgacccttcaaacaggctacctgacaagctgggatttccattttgtcatcctgtttctgcaggtaggacagtagggtctctgatgttttaggttgagctagtctggcatctctttctactcatagttcttcctataacagacaacccctggcctgtgctgggagctcagcctcagtggctgctgggagcacagtcaagaatggccagccattgtggctgccacagctcaggcatctaacttttgcttagttagatccacccccctgcaacagctcttccagacccttcggtgtttttggggtgttctgtactcatacattgggtcccatccatcaaggatagtggcttttgggcaccacataaatgtgatggtcagcccgggacccccccttggatttcccctttcctgatcttacggtctcggtgctcatgaaatttttctccaccttcctgctgggttcaccagttgtggtactgagtccgtgttaacttctgtaaggatggcaccaggttcaagaggcaaaagagacctggagctagcaaacaagacatagggttttattagggagaactaacatacagggacagtccagtggtggtggactagacaggagaacctcaactgcttgcaaaaagcatgcagcttatatagcacttttatttggcaccctccgtgcagcagccttcacgtggcaaccctcctttcttaagttattgctctcaggtgcatttgccatacacccactcccaccgtaatggcattaatccattcctgaggattaatgttgttacggtctcatggcctaatcgcctcccagtggtcctacctcttaatacmataaaaatatcaattaaatttcaacatgagttgtggaagggacattcaaaccattgcagttattttagagctttagttcagaaatacaaatgcaataacttttacctccaaatcattgactcatagttgtctaatttagtaggctttgaagaccctgcctttagtctttttgaccttttatctggactgatatatgtagggaaagaggctcaagaaggaaaaacagttaggaaaagaaaacttggaagagatatttaggaatctttgaatatcttactgttggtggagaaaatcgtttttctttcattttatttgatcattaccacaatttctaggttataggaatcacagttgggagagactgcaggttatgtagactatcaaggcaaatacaaacattcttttggtacattttgctctaggactgggtctcactctgtctagtttctgtgaagctgcttctagcgtcacagggattagtgggcctggtcgtagaaatggattacctagggatcaaaaagcagaagtatcagtagatagctttgcttctttcattgcataaggtggtaatgaagagtctggattgctgtgtaggtgttgctctgtaggacttgccatgttcagcatgccttactagagactttttgactttctaatacattttatgcactctagaaggctctggaatttttgctgtccagaaatacactgtctgatgaaggaaagagatttgtaaacaactacaaatataatgataaactactcataaaaatgtaaaaatgtagtgacttctgtgaggaaagcaaatactgtggttaaatagaaaaaatgacatctaagaagaagcttagagtaggagttctacagtgagaaagtgagaaaaggaaaacattatttgattgaatcctcctaccaaccctgtgatagaagtatcagacagactcaagaaaggcctcagagcgagtatccagcagagctgggatttaaagccaaggtcatcttacttcaacttcatgctcttaattaaaactaataaaaggtggatcttgtttagaggggtataagactttataatttaattttagcgtatgatactaaggagagcatcagttgataaagtagaaaatatgcaggtgttgaactgatctattttcccctaatctagcaatgaatcagattatgaagagtagttttatttatgtatttatttattttgagatggagtcttgctctgtcgcccaggctggagtgcagtggcgtgatctcggctcactgcaagctccgcctatgaggagtagtttttaaaaagattagtgttctaattacagaatccagtagggaaaatatgtttggttttgtgtatactgtcccaaatactagtgtatgttgtattatgtagtatcattttcttaactttatatagcagaataaaatttgaaaacagtatgctggaatttttgcaagagaattttctaatgaggcagggtggtatagtgtagaataggttttgagagttggacagacttgcttttaaaatcaggcttgtgatcttagacaggttctatgccttatctgagcctcagttttctccatttgtaaattgaggagattggagtagatgatattttagtgtcataatgcattatgacattccctggacgtaagggagaacaagaaaaaaatggaagaaaaagaaggataggaagaattagaaaaaggaaagggagaaagaaggtaaagaaaaagccctaagcctcttcaggcctcatcggctattttcagtgstcttctcttttgtatctgtgtgaatgacttacacttatgtagttagggttttcccatggtgttcttagaaacagtgctataaagcagactaatgttggttgtgaagtgcactgcattttctcattggaacagttttataatttctgactaaagacagagtaaattaccagtttgattagtagtgtgacttagaaagctgaaacaattgggaaactataagcatttgaagtagtaggactatgttccaagtgctatagaataggcataagtgtatcccacttatcgaacataacagcagcattcctgtttactatgatgtgtgcattgagcatagggaaaaacattcattctgcatggtagatttgaactactctcttagctttaaataaaaagaattggacatttggtgttgcattccacctcaggttacagcagttattagggaataatttgagttgctctcagtcctttgaaataactgcctacacaagtttgaactcacatctgttttttgttgttgttgttgttgttaaacatgataagtttccttgggcaggtgcaagcagtcacaatcattacactgatcttagaattacccagaaagttagaataattgtttttttaaagagtcatggtaatatcttaatatttggaggcaatattaatgacttctggtatattataggtgctcaataagtatttgattagttgaagaataatttgagaaatatgtgtgaaatctaggagacataattattaccctatacacccttgataaaggaatagtgtttattaattttagagttgagcttagttttgtttgtaaacaccttgggaatcatctctttttttccactctttgttgccttcagaaatctctgctttgcgctgaggaaagaactctgaagtggttattcctgcctttataagtagcaatgagcaagttatatgttctgtgtaatcttcaaaaatgtaggacagtgaggctgctttaaataactggttttagtccatttttgccttcccactgacagatttccaagctttggctctgatacggcctttaactacatttgtttaaaacaagtgcttttcaggaggtgttttcattgttcaccagttgtgctatgtttaaatggagtgcttgtaaatggccactggcatatatgggtagttaaggcatcttgaccagattcgtgagtttgacactaagagactccatctccagatgtatttctgggtatgtaggttaaatctatctctttctattatttattcttccccacggaattcaggtttgtttcacatgtttttaattcaggaccaatcacttagagcaaagagtcttaaacattattatatgagaatcacctgtagaatttactaaactmggttactgaatccccctgacaagagtttctgattcagtaggtctgagctggtgcctgagaatgctaacaagttcccaggtgatgctaatgctggtgctaatgcggctgatctggagaccacactttgagagctattgacctatagggcattagttcctaaacctcattatgcatcaggctcacctgggaaactacacattcactcatgctcacagtcacattcccactcataattaagtgtttaagggagttaggaagctggaggcaggatctataatgttttccaagtgattttgaagcagccagtcttgcccttgtctgtgaytggacatttgattcgctgatttaggcaagtggttctccaacctatgtaagaagcatttgtagagctcgtgaaaacacagttctggggtctatcctgctgattcctstaggtccagaaggtccaagtggggccccagatttgcatttctaacaagcttgcaggtatgtcattgctgctggtccaagaactgtactttgagaatcactgatctagggcaaccaactacccagtttttggagattctctaactgatttaaataactggattaaatttagggattgaaattctttgaccgtctctaatagtgttgttgcgtttcctcccagaagttttttgtgatagtaatgtgctcttccaaactatcatttaactttgccactcaagagaaaatgaatgtcttaagtttttcagttatgtataatggttccgaataaaactttaaaagtggcaaataattctgaaaaaaagtcacaagtaaaacagttaattaacaattcagaatacaagtaagagtacagacatgtgtatttcctagttaagattgtggacctgcatgtttgtgctttttatatgttgtgtctctgatgattttccctcttctggactgccgcatagtgaaggaagctctgtactttttaacaaaagttgtgcacgtatgtctagtaatggcatgaattgaagtgattcagaatttcttagaacatagtgagctatgcttcctgattgtttctgtaatctaaaggttattgtttgtaggatatgaatacaaaacctctgtagtgtttgtgtagattgtacatgccttttcagaggatagaaggtttacaatccatactttgtgagagtgataatgcgtcttttacagtgtgcttactctcaacatctctaatcttttattccaggttactaagtattttccatatcttttaactttgttcccataatgaatatgaaaattggaagcactacaataggaagtgttgctttcaacccttagatctcacattatctgagcagataacaacgtttggtgtttgtgattgggtgtgaagcttattttcaaaagttatattttctttataattaattttttagctagagtgtggtttgatatgtcgtgacttgtccaaagagctaatgttttgtagttcacctttttaaagcaaagagcagctgcattttgaaatgttttatctcaaatgggcaagttgtttacaagctagactctaacacatcctgacatttagtgtctgtgtttgtattcctgctgggattaggctgcctttctaattaattagttgcatagccttttattaattccctcaaaatttataatgttttaaattaacaacatagataagcatactgcattttttgggaaaacatgaaatrttaattatgtagcagtgacataagtttcgtaaactctgttgaatgttagaagatgcttacaacaatgttttccaaatatagggatttattataaacttatccttctaaggctgcctgtgccatttcaggagagtgaatataaatagatcttgatttcttcaagaagtggacttagtcattttgtttatggtgaaaggaagtatttgctttgcgtctctaagaattgtctttagcatccttgttaattacacatcatttcaacatgttcttaccaaattctcaggccttgataaggtagcataacagaacaggaagaattaaaactcatatttaaataattattttgttattacagcacttaaatctgtctagtagcaatacygaatctaataattgtaactttttctgagatggaaaattttatctcttgtccagtgttctgagatatttttagctcatttgtccctccacccccaactagcttactttaacagggatttatggagcatctgctatgtatgtaatagtccaactcttatgaaaggttctgtttctaatattttttactattttttcaattctgtcaacgttgttttctaagttagaattaaaatattgatactgtagaaatttgatattttaaaataaagtccagggaaataatgggacttattgcaaagcttatggtgagctctacattcagatgctatcattatactttatcagctgataaacattgagcaagctrttcaacctcttgggttttayatcctcaccagctaagtagggataacactatatggttttaagagttcttatgaggtttagtaatatagcctggcagcagtggtgatggtttatataggcccttgataagtgtcacttaatttctccttttcttctttmgcctctggaaaattgatatttaaacattttctaaaaattgtattttacgtatatttatgcatttctctggtagaagcttgtttggattttggcaatttttctgatatgaagtgttcttgattatcctagtataaaagatagggaamtctggcagaatcctttgctttgctaaagtagtgattttcactgaatctgaatcagtaaaaatcttgccygtcagtaagaatatgcagactagagatatggcttgtttttgggtagcctccttgacagattttctttctttttgagacggagtcttacgctttttgcccaggccggagtgcagtggcgcagtcttggctcactgcaacctctgcctcctgggttcaaatgattctccttcctcagactcctgmgtagctgggattacaggcatgcactacaacgcctggctaatttttgtatttttaatagagacggggttccaccatgttgaccagtttggtcctgaattcctgacctcaagtgatctgctcacttcagcctcccaaagtgctgggattacaagcatgaaccactgttctggctgacagattttcttgctgaactttgggtcatcccagatgtgagttcgctgtaggcgtgtcatagagcaacagtagtaggaatacaagttaaattgatgtatatgtcatgataatcagtccaattcagtggtccccaacctttctggcaccagggaccggttttgtggaagacagtttttccatggacctggggtgagagggtggggatgatatccggatgaaactgttccacctcagatcatcaggcattagattctcataaggagcagacaacctatttccctcacgtgcacaattcacagtggagttcacactcctaggagaattaatgctactgctgayctgataggaggcggagctcaggtagtaatgcttgctcgcctgctgcccacctcctgctgtgaagcccagtycctaataggctagtaccagcccatgggccattggttggggacccctgctctaattaatgcattttacaagggacgtattattgtagctagataaataagcagtaattttgcagcatatttcataaggcaatgaattttctcctctgttttataattctaaaatgtagttatagaatgttatatttgtgatattgggatttgtcctactgtgtaaatattatggatattatatagagatggaattatttttatcagtgaagtgggtattttagtattacttttgctactcatttgagatgactggaactgaatggtttgtttcagaaaaagaggtggtagttttgattctgtttaagctctaaatgacatatactatttactttgctagtagaagattttctgggttgttttgccaagactataaaaatataaaacttgaggaaaggttttctttctaattaaaacaatcacaaaaataaaaccaggctatctaaataaaagttatttctgagagttattcttgattcttttttctcttactctttttttatctaatcctgtcagctctgttttcatacttattcagaatttgacctcttaaaaaaattaactactttcactgctataccacagttcacaccatcatcagctcttgtctggactattgaaataccttcttcctgcctactgtttctttttcacctctcatctatctttattttttacattgtctaacttggaagactttgaattataggttttgaagatgaggacaggtctaggttagagatatggacttgggagttgttagtagttaacatggtgaagctgtagaaagaatgaaatcactaacagaaggtgagtagagttccttcactcattgagccaggtactgcactagatggtggggctacctcaatgaataagatagacttgggctctctcctcatgaaactaagactcacagggaaatggaacagtatataagataagtacaatacagtgtgttgggtgttatgtgaatgatcagggtgcattcagaatgctaatacagtagaaaggtcttgggaaatactgtcattcaaaggttgggttgttaaaaaatatttggtataggaaactgaggagtggctagagagatgggaagagaacccaaagaagtggtgactcagatgaaatgaggtaagcactcagtgaggaaataatgggtattggttcacactcattgagtacttggattatgtcaaccactgtttgaagcaccttgtatgtactracacatttcttcctcacagcagctctctgaggttctctttattttgtagttgaggaaacttatgtcagattaaggaaatttcccaagatcacacaggtaataaatagtggaactaggatcaacagtgttgatcacagtagagaccacagttacataaagtgcttagttccctacttgggaggtcatgggagtgtggaagagagacattctagtggtgtcttgtgcctagctgctggattgcaataaattgaagggtgattgattgagagttgaagaagcagatatagtgattgtcaatttcttttttagttttgttgatgtattattattaatatttagagtttttatgctttccataaaagagggataaatatagttagtcctccctccttgtcatccctccctgtctccagtaaaaaccaaatctaactatatttctttattattttcctggttactcttctcttacctgggccctgacttagtctacccagctgtgaatcttcagcttctcttggcatacaaattgtactctaatcaccttttttcaaataacaaaaacaaaaacaaaactcagtattttagtaaggttgttaagccaggtaggtaaataatgaaatatgaaaaatttgaaaatggaaactgtatttagggcagtttgaaacctaggactggtgaagtgaattaatcttgatgttttacaactataggttggtgcaaaagtaattgcggctgggcatagtggctcacacctgtaatcccagcacttcgggaggctgaggcgggtggaccacttgaggtcaggagttcgagaccagtgtggccaacatggtgaaaccccgtctctactaaaaatgcaaaaattagccgggtgtggtggcacatgcctgtagtcccagctgcttgggaggctgaggcacaagaattgcttgaacccaggaggaggaagttgcagtcagccaaaatcatggcactgcacttcagcctgggcaacagagcaagactgtctcaaaaaaaaaaaaaaaagtaattgcaaaaactgcaactagaatagaataatcgactactctttcagagataatttagtacattcccttatttcacagatgaggagagactatgtgatacatttaaactcaagcagttagtgagaaataagccttggctyaaggttcagatctggagacaaatgtgccttccacagtgccattacctttaaaagcaacttttgaaagtgatagagggtttggaatagactggctcctttgatcagtttaagttacagcagtcacttataatataaataaggtgagaactacaataacctttaaggatattctatttgattttttaaaaatttatttattaatgggcagtgagaaatgaaactttcctagtggtacagcaagtgatacttagcaccttgtctatacttaatacagagttgagggagaataaagactccaaataaaacaaattttttagagttctgatattttgaggaaagtacattttaaaaaaaggagacttagatttttgttatacttgctttgttttcatatatgtgagtatatcattagcaaattttatgctcaacttttagaatttaaatatgagatccagatgtccaagttttatgttaccttttcatataattaagtttctgtaggcaggtagtaattctaaaagggattgttaacttctctgatcagtttaattttattgttagtttctaatgaaggagcttaattgtgatctcaaaaataacatataacttagcaagcactgagtataaaattgtaggattttataaacatggggacaagatgatgtttgttgtttgcatctggagcagatggttttgaagagcatgggtttagaataattgctcttgtccagaattggttatattgaaatattgatgtagagcttgaggtggagcaagtcatatacaagtcatacgttggaaacagtgtgttgacatttggctctctaaagcattttgccttttcttcccttcaaggtatcttgttttccagtcttaaaaattttaagagcactggaaaataaaataatgaaaagaagatgatacattttttgttgaattagccacacctcttttttatttcaaaattgtgtttcttaacatagcagtattgcttctgcatttgcttacatttttaaaaaattaactccaaagttagtgagaagaggaaatgttgatggcttactttcaaccatattccttgatgtacatgtgtccatttgttcttctagttaattgtcttcaggtttctaaaaatatatgtatttttaaaaatttaatctttcattatgggttccagtatggccttattagaaatggtgatggccaataatttaaacttagcatcatagaattttaagttatttaaatttgaataattagacaaaatacattttaatcttttcatttaataaatgaggtaactgatggccaaaagggctaagtcttatttaaagttgtgcctgagctagttaatggcagacctagagccatggaggattggttgcattagtattatagctccaaggatctttaatttctgtaagctcttgataatatatttaacatttaattcatacaaattctgtttttcaacttacatgttattttcaagaatagcatttgttgtgtaaaataggatacgtttatatagagtccagaatcaatacttcagagtgggaaagaatctgaaggcctgtggcaggggtctccaggatctctyacgtttttatagcttttgcaaatcagtaaacttacctattgttcttttctcctttctaacaatscaccatactttatatcctcacatacctacaaacgaagtaatagagttggatgtaggtttatttaaacatgttctttcatatgtataagactgaactctggagacttaggattttatcttttattattctatagggcctcctaatctctaaagygctatgctcattcttgtctctatttatatgctgttccccctgcttggaatagtcggctgcctctttggccccaattccyattttatcaggwtaacatcgattcacttttcagggctaattacttgaacttagatatatgtttcagtttttcatttgtgaaataaaggaatgtactaaatgatttctgtgagagtcattaggtaaactaatccttcctgaaactgagttcgatgttcctgacgtgtttttgtgccactttgttctttccatgtcacagtacttggcatagtttataataactacgcgttatgatgtatctctcctattagactgttagctgtgagagattgatttgccttcttgtgtaccctcatatgtaagagctcagtacaattgtttaatgaagtaattatgtctaggaggttcttgttgaatattttgagtgaatagatgagttaatattgaaaagagtgcccatgaaagagtaactcctgtggtcaatgaatatatcttctcagtggctttatgatataataatactttaattgctttcctttaacatgaattgtaactgaattggcaagaaatacaagaacaggggttccattactgagaactatttttaaaaaatattttcaaaaccagttcggtgcagtggctcacacctgcaatcctagcactttgggaggccaggccaggagaataatttgaggccaggagtttgagaccagcctgggcaatgtagcaagrctctgtctctaagagaaataaaattagccggtggtggtagtgtgtgtctgtagtcctagctacttgggaggctgaagtgggaggattgcttgagtctaggagttgaggctgcagtcagctatgattgtaccactgcactccagcctgggtaatagagcaagaccttgtctcttaaaaaaaaaatcagagtaacggcatgtaaaaaatgctgttctctctcctcaagttttgtttttcttctttagtcaccctgcctttcataccaaccatattcgtttgtataaaatattctggcaaatcaaaactctttgtgaatactttaaatcatataatctatattttgtattytagtatattttgcacactagtcagcttataaatatgtcctgcaatgattctgagcctgatcaggatttctgtatagaaaattcccaaaactgtttttattatttttttaaagaggtagggtcttgcagtattgccgagactggtcttaaactcgtggcctcaagtgatcctcccaccttggcctcctgaagtgctgggattataggtgtgagtcactgcattcagccccaaaaccttttttatggatttattttcctagatcatcatgtttttaattattctgattagaaagtactctaaataaagatattttcctgttttagtaataaaatattaaggaataaacttcattgtatatgtacatatggatacttagaactgagttttttcattttattaaaatttttttaaattaatagactttttttagagcagttttaggtttacagaagaataaagcagaaagtacagataatttccatgtaacttcccttttttccagcttctcccattattactgtcttgagttagtgtggtacctttgttataattgatgagctaatattgatacaatgatatttcattttaaactgcagtttataatttctaaaactaccatccctcaatgttatttaaaccagctctgtgttgttgctttatttatagtttttttttacttgcgccacactttttacatacttttttaaaataaacttctttctcaatgtattgcatgtatacataagagagcataagctaaaatatccatgtgttttccaaagtgaacacacttgtgtaaccaccactcagatcaagatacagagcattactagcttcctggtacctctctcagaccctttcccagccctacatgctcacctcaacccaaaaggcaaccactctcctggcttcgaatgccatagatcagttttgcctgttttgccttctcttctttcacttgttttatggtttgggagcttcatcattttattctgcatagcaggagttcatttttattgctgaattygattgtttaagtattatgagtaatgccatgaacattcttgcacatgccttttgctgcacaaatgtatgcatttctgtctattatttgtctaagagtggaattattgggttataggattcttgttactaaatactgccaaaacgtttttgtagtgattttaccaatttacctttctacctgttgtgcgtgaaaattccagtttcttctcgtgggtgctgacatggagtttatagcagtatttcattgtggttttagttccctgatgactgagtctgagtactttttatatttgaattgaccatttagatgtctttctttgtgatgtgcctgtcaagtatctattcaatttttctgtagggttactttttaaaaatatattgatttgtggaagttattaatatagcttagttgtgagacctttgttagatatatgtattttaaatatcttctactctgtggcttacatttttattctctgtagtatctttttgaggaacagaaagtttataattatatatttattataatatatattgatataaaggatccagttcatcagtcttttycttcgtggctggtgatttttgtagctagcttaagaaatctyggtcaaatctactgttaggtatattttctcttaccttcttgatgcttttattgtttttcctttcatgttgctatctttaattgcttcactttttttcatatagatgtgttataccagttattgaaatgaccatcaatttctgccttgcttctgtgttacctttgttgtacataaatcaagggtttgtgttcattttagattctctgctctgcctcaatggtcttttatccttgtccacaatactgaaatgtcttcaatactttcagccttataaaaagtcataatttctggagggtaagtgatatttttttaaaaaaatggtcatcaaaattttcttgactattgttggcactttgcattcccatagaagttttaaaatcaatgtgtcgggttcttccttctccccacmcagtaaactggcttgcattttgattggaattattaagtctttcaatcaatttggagagatttgggaagttaataccttgtaatccatgaacttcttagattccttcattttattttagattttccttaatttccctccaggtagtttggtagttttatgtgaaaagtcttgcatactgttaattagatttattcttaggtactttggttttttgaatgcacttatgaatggcattttgtaaagtttcacttgtaattattttatgttagtatagtcacggactgcataacgatgttttagtcaaggatgaatggtatatactacagtggctctgtaagattataatggasctgaaaaattcctatcatccagtgacatcataaccattgtaaagtagtagtgtaattagtattattatttttaaatttggtgtagcctaagtggatagtgtttacagtagagtatagtaatgtcctgggccttcacatttgctcagcacatactcactgacttacccagagcaacttccagtcctataagcctcattcatggtaagtgcccacacaggtataacattttttaatcttttatactatatttttactgtaccttttctttttctatgtttagatacacaaatacttaccattgtgttatagttacctatggtactgagtatagtaacatgccttacaggtttgtagccttgctgtatagtaggccataccatctagattttcataagtagactctttgatgtttgcrcaatgataaratcacataaagacacatctctcagaatgtatccctgtcattaagcaatgcatggctgtatctagaaaaagtaaaaaaaaaatttttttttttttttgagacggaatctcactttgtcacccaggctggagtgcagtggcacgatctttgtaaatcttttatactgtatttttactgtaccttttctttttctatgtttaggtatacaaataccattgtgttacggttacctacagtattgagtatagtaacttgctgcacaggtttgtagcttagaagcaataggctataccatatagcctagatgtatagtaggccataccatctagatttgtataagtatactctataatgtttgcacaatgacaaaatcgcataaagacacatctcttagaacgtatccctgtcattaagcaacgcatgtctgtatctagaagaagtaaaaaaaaatttttttttgagacggagtcttgctttgtcacccaggctggagtgcagtggcactatctcagctcactgcaacctctgcctcccgggttcaagcaattcttgtgcctcagcctcccaagtagcttagtagrgacagggtttcactatgttggcaaggctggtcatgaactcctgacctcaagtgatccacttgctttggcctcccaatagaaaaagtaattttttttgtattgactgtgtctacctaccttgccaaatgcacttattaattttaatagtgtgggccaggcacagtggcttatacctataactccagcacattgggaggccaaggtgggaggatcccttaagcccaggagcttgagacgagcctgggcaacatagtgggacaccatctctacagaaaatttacagaatagctgagcgtggtggtatgcacctgtagtcccagctacttgtgaggctgaggtaggaggattacttgagtgtgggaggttgaggctataatgagctgagattgcaccactacactccagactgggtgacagagtgagaccctgtctcaaaaaaaccacaaaaaacaaaattttagtagtgtgtatgtaagttcttttgagttttttatctatcaattatgttatagttttctatgtatacatttcaaataatgagttttaaattttattttgttcaactctacacctattctttgtcttccttgacttactatactacataggacctctgacagtatttaatagaagtggtaacaatagtaatccttatctcattcttgatttaatagaaagtttacaaactgttacttaatattaagaattttttttgttgtatgcgtgataaggaggtttgtatctattcctagcttttaaaaaaatataattaatgatattttatcacatttctacatttattgagatagtcatatgaactctttattctattaatgggaagaatgatgttgattgatttttaaatgttacatgaatctggcattcctgtaatagagccaagttgtcacaattttgtaattctttttaatgtattgatcttttggctgatgttttgtttaagatatttgcacctatgttcatgagagattgacctgtaattttttttccttgtaatgtccctttaagatttgaggagcaagattatgctacccttgtgaatcaagttgggaattattttttctctggaacaattttttaaaaattaatgtcatattcatccttaagtatttggtgacatttatcagtgaagccatctgtacttagaattttctctgtaggaaaggttttaattatagatttaatttctttaatatctattgaaatattcaaattgtatagtttgtttgtatattagttttggtaaatttttttcccctagaaacttgttcattttatctacatttcaaattatttggcataaagttattcctactatcctcttatctttttaatggcagtaggttttgtaatgatgtctgctttttcattcctagtattggaaatgtgtctcttctctcattttcagacaaccaacctttggctttactggttactttttttaattgtgcatttgttttcttcattatttccctccttcttttttcttttaggtttaatttcttctttttctaatttcttaagatgaatgcctcactgactgtcagtctttttttttttttatctacattaagcctaccagtgtccccttcagtactgcagtagcagcatcctacagattttcatattatatttgtattattattcagttgaaaaaattcagttttcattgtgattttttttgagccatgagttatttagaaatgaattaactgattttcaaatatttgtgtatttcttagcatttttttgttactgattttgttattcattctcctgaggtcagagaactatactttatgatttcaatccttgagttacatggagagttgctttgtgtcctagcatagggtcagttttggtagatattccaggtatgctggaaaacagagttattttattattttgatgttgttttttaatatataccaattaggataagtgagttaactttgtttttcgtatcttctggtatcttctatatattctttttaaaaattttggctaataagggaagtatgttaaaacctgcaggcaaggtctgtttctccatttagttctgtttacttttgttttatgtattttgaattttgttatcaggcatgtattaatttagaattttgtatattcttggtgaattgacccttttattaccccgagtgtctggtgatgcctcttacttaatgcctatttgatagtagatataggtgcrctgttatccttccatgtatatttcattctgtgtatatttgcatagtattccttttattcttttactttcaacctttgtatattcttatatttcagatacatcacttgtatgcagggtaaattggggttttatttttttaatccatctgctgttgtcattgtttaaattcaagtacttaatacatttatatttagggtaatatcttaaaatacttaggtttaatgtasttccttatttgccccacttgtatgttttttttcctgttttttttttcattcttttggaataggcaagtatttttattatttcatcctcttcccattgtctttttagttaaacattttaacttggcctttagtgaatatcctatgtttgtctccttggcttattaggggctagtatgcattgcaaacattgcaacagatgtttacttattatttgggtacattaagttgtgctatgtttattacaraatcagtctttgtactttacttttttggagacagggtctcacctgtcacccaagtttagtgactgagtgcagcagcatgatgatggctcactgcggtcttgacttcctgggctcaaacagtcattgcgtgtagctaggactataggcacatgccacgaagcctggctaatttttgaaatttttttagagatgaagacacacagtgttgcccaggctagtctcggactcctggatgcaagctctccgcccgtctcagcctcccaaagtgttgggattacaagtgtgagccaccgtgcccaacttgtactttactattttttaacttttgaaaaattccatgtttctcttgcctttgttttcctcctgtgagttactattttctttctatgttcagaggagtggagattttatccagcttaaattctgtagtttgtattagaaataatagagattttgttattttataaatatgtttatattataatattaaatatacttttaaaaaccacatattgcctgtgttttctagaccccttccttaaatgaaaataatgtatcatttagtgtcagattttatgtttgcatgatattaaaaaaaagtggcaggaaaattactagaccattttccctgtttcagtttttctgtctcagtagggtgatgtatctggtccaaattagaaatattggcaagtattgccagatactatctggcattgaagtattttgattacatccatttatgttagatattttaggaacagcttaaattttcccaggccacaaggtactgtttgatacaacatggcactgcatagatactcctcaacttatgatggggttatgtcctgaaaaaactagtgagtcaaaatatgtgtgtggctgacttggaactgtagcttgctgtggctgcccagcgttgcaagaaaattactgaattcatattgcttttgtaccattgtaaagtggaaaactcttttttttttgagacggagttttgctattattgcccaggctggagtgcaatggtgcgatctcggctcaccgcagcctctgcctcctgggttcaagcgattctcctgcctcagcctcccaagcagctaggattacaggcatgcaccaccacacccggctaattttgtatttttagtagagacgtggtttctccatgttggtcaggctggtctcgaactcttgatctcaggtgatccgcttgccttggcctccyaaagtggtgggattacaggcatgagccaccacacctggccataaagttgaaaagtcttaagttgaatcctaagtcagggactgtctttatcactgaatattttttaatgcttctgctccatttaactaatgaggatgtcgagtagtaaatcgacccaatttatcatcgtcttagtccagtttctgctgctataacaaaataccacatacttggtaatttacaaagaacagaaatttatttctcacagttctggaggctggaaagtccaagatcaaggtgctggcaggtttgggctcagtctctttgcatccaagatggtgccttgaatgccatattctctaaaggrgaggaacgttgtgtcctcacatagcagaagggtaagaaaaagggcaagcctttcttatagctgtattaatccattcatgaggctggagacacctctcattaggcctcacctcccatcagtgtgtcattagggattaagttttaacatgagttttggaggagacaaaaacattcataccatagcaaacataaacatgtcaagaattgtaaagggtctgagattttactctacttttactctattctaacaaattttgtgagtggctgcagaagagtcaaaggaaagaatattgcagcaacataattagctagagtagcagcatttgcaccagttcctgagcctcagttttcacggagtgatacagagggctacctgacacctgagcctttataggcttgcatcacagtaggggagccttgaattgtagaacctgaatcttttataatggacagtaagcatgtctatcctttgctttggagagagacactttcttttcctgcataccaacatcctttaaaagatagtcttgaacagaggcagtcagtgattttactctcaagcagaagtgcaagagatgtgaagaaccatctttcagcattttggaaggcagataaagcaagtgggtatttgtaagatgtcctaaagaagtgacttgctgtctttaggaagcaggggatctatttttggwgtatgtttgtactattcactgctttttcttggtagagaaagatactcaaccctctgttttgtggagttttgtatcttctttttattaatgcttctgtttatatataaaagttcaaataagtgaaaacaaaatgatggagtggtatcattttaatttagtaaaaatgtattgaggtatagtgttttgaacaagaaaggttaaaaaatcatgggagctagctggtgttccaggataactttagatattcagactggatttctgagagatctctgagattaaactccttcaaagtggaattttattaaacactcttaacacaaagagcatatagtgacttactgtcttctagactaaaggtcgtcacagatcaaagggctctaaatctcacagcctgatggagaggacattcactcttgtcaatgtttaaatttcaagcaaatagcaaagacaaagaacttagtatctaacttctcaagtcagcatggtatctttgaatttattttggatctctctaaatttgactttgttgactatcttcctggctgctttagtaccttttattctacgtcatcctagtttttctttcccttttaaaacatcgtttctttttatgctattcaattgatgggctttcctaagattgagccttctacacttattcctccatccctgacccctcactagcctccccttttagatctctcccttgctataatatcaaatcttacatgtatgcacatcactctgaagtttgcttcrctcttgtatttcaaaatcacatttccaactgccacctgaatgtttgcttgcaggtgttttcccagtaccttaaaactttgtaattctagtttgaatgtatttaccaaaagggcaggggcaaaagcatgttttaattttaatattttactcttttaaaagaagttccccaaacaaattattttgataaatctttttggctttttttatggatgttgttttgtaaattctattttatatttgtaaataatgctttctcatattaagtatttgtcatattttcattgccaaaactaagtgcttggatttttacatttattcttcacattcttccacctctcttccaacctctcatcccctcccctacaaggacaaaatgttttaaatgctgtaatcttgcatggggtttgggttttttaatatttttattggtgataattctgtcacaggatccttagggtgtcacttttccagccagaaacctctgtggccggtggcacctctgcccgagttatatcctcgggcccactgggcttgttctgcccacttggtccagcaggctgtacttggcttgtgctattgacctggatcctacacctgccaagggtgagccaggcgcagagcagtgaagggggtgtgagtgagcccgaggtccggccactgcacacagccaggcatgctggctgcagtggagtggacagccccaggtgcaggcacaggcaccggctctgtgtgaggatgtggctggaccaggcataccacaagtgttttccaccgtgggcaccaggtaacgtggtggtacctggaagcttggagatgttggaaacagcagagccccaaagagagtgtcacagctctggtatcacagctctgatcacagcccttgcatctgggctccccagagggccacagctcctcttcttctcattgcccaaaatgtggtgaccagtgggcgtgtttcagtcctgtttgtgttacagctctttcagtcctgccatttggaaggtyctgagttcttgtscagcctttaggaagaatgaggtatgtggacagctggagggtgagcaaggcagagaggagcttcattgagcaagagaacagctctcaggagacctgaagtgggtaggtccttctgccatcaggtcgtcctgatgagcgtccagctctcagcagagaggatacctggagggggtagctgctgtccacaggcaggccatcctcacaaatgtctagctttccgcagagaggacacctggagtgggtagctcctttctgcaggtaggtcatcctgatgagtgtcctgctgtcagtggagaggagacccagagtgggtagcttctttctgtaggcaggttgtcccagtgcatgtccagctctcagtggagaggagaccagaatgggtagctcctatctggcatcccagctagtgtccagttctcagcggagaggagacccagagtgagtagctcctgtcctcaagctggtcagcctgatgagtgtccagctctcagcagagaggagacctggagtgggtggctcctttctgcaggcaggttgccccaacgagtgtctacttctcagcggagaggagacccggagtgggtagctcctttccataggcagggtgtcccagtgaatgtcctgctcttagtggtgaggagacccagggtgggtagctccttctcacagctggtagtcctgacatcccagtgagtctggctgagtcgggtttttatgggcttcagaagggaggaagtgcatgctgattggtccatgggtggccatgggcaggcccagaaaaagcaccataagttcttggtctcagctgcagactctacccagctctgacagcctgccctccatgcttcaggctgtccctggcttaaaggtggggcttcaccagggactcactcctttctgcccaggagcctctctgcctcctgctgccatcaatcatgtcgtccatggtgctggggctgttcatgctgaggggcgcttgcaggactgcgccaagmcaccctcagcctccctcacatactcattggcacccaaagtctggaggggaccaaggtggaagggagctggactgtcagtrccaccttgagcacatgaacacctaggtgggtcatgacagtggcttggctcagccttaactttggtctgaaatcagagcaggcaaaaagtttttctgggactggggagaggccaggcagtagaagcaggcacttcggagcctgttggggcagggggtgcttcctgggttctcgagagtggagggatacctgggtccacagccatggctgggcagctgcagctgtgcctgggtgagtggggctcacaccccaccaacttggaaaagagcagggctcctgcctgttcccagctcccactggcttcgtggagtatgcagccctggccacgcctcccccactgcagccagtgtcttcactgttgccactccagatgggccaccggagccatcaattcagtctgtatttatgaaggaaaagacaaatcttgtgttactttcctctctttataggtctctgtgccttgcggagaatcctgaaaaaacagcctaacctccctgatgtcaaggtggctggactggtgaagattactctgaaggatttcttgcaggcaatgaatgatatcagacccagtgccatgagggaaatagcaattgatgtcccaaatgtaagtcatttatgtcccacactagctacactgtttgaattaaactctgaaaaaaatttagagttcagggagactgacttcctaggctaaactttaaaaaaatatttttcttaattgaaagttttattgagatagctgtaaattcagtgcagttatacgaagtaatgtagggagattctgtgtatcctatacccagtttcctccagtggcaacattttgcaaaactgaagtacaggctgggtgcagtggctcatggctgcaatcccagcactttgggaggctgaggtgggcggatcacttgagcccaggagtttgagaccagcctggttaacatggtaaaaccccatctctacaaaaagtacaaattagttgagtgtggtggtgtacacctgtagtcccagctacagctgaggtgggaggatcatctgagccctggggaatgttgaggctgcagtgagccatggttrtgccactgcacttcagcctgggtgacagagcgagaccctgtctcaaaaacaaaaaacaaaacacccaaaaaactatattacaatactaaaaccaggatacccctattgatacaatccattgatcttactcatattttttcagttttacttgtgtgtatgtgtttatttagttttatacaattttatctcatgaaaaggtttgcrtattcatcacagatactaagtaattccatcaccacaaagatccctcatgttgtcttttataatcacacccacctcattcctcccctcatttctaaatttttatttcagaacctttatataaatggaatcatactgtatacaaccttttggaattagcttttttcacatatgagtaagatcttttgtctttctgtgtaccttaacttatttcagtaggcataatgttccccagattcatccatgttattataaatgacagtattttcttctttttataaggccaaataatattccattatgccacatttctttgtaccattataccacattttctttctctgttcatctgttgagggacacttagattgattccctatcttggatgttgtgaatartgctgtagtgaacatgagagtgcagatatcgctttgagatacttcatttccttttgatatgtacccagtagtaggattgctgaatcttttggtaacttaatattttgaggaaccaccataccatttttccataatgtctgtaccactttacattcccaccaacagtgtacaagggtttctttttctccatatccttggcaacacttatctttcatctttttggtaatggccttcctaacagatgtgaggtgatatctcattatagttttgatttgtattaccctgatgattagtggtattgaacatattttcatataccagttagccatttgtacgtcttcttttaacaaatgttactcagatcctttgcccatttttaatcagattgtttgtttttttttgcttttgagttgtttgagtttcttaatatatattttagtattttggatagyagccccttacctcatatatggttcacacatattttctcccattccataggttgtctctttactctgtttcctttgctgtgcagaactttctggtttgatgcagtcctgtttgtcagtttttgtttttcttgcctctgcttttggagtgtatccaaaaattcattgccctggacccatgccataaggcttttccttatgttttcttctagtagttttacagttctagatattatgtttaaatatttaatccattttgaactgattttttgtatgtggtgtgagaagactggccagtttcatgtgtggacatacagtttatcatatggatatcatgtggatatacagttttcctgacaccattttttaaagagattgtgctttcgtcattgcgtgttcttcggtacctttgyagatcaattgactgtacatgcgtggatttatttctgggctctctatttgtttcatttatttatatgtctgtttttatgccagtatattgctgtcttgattatcatagctttgtagtatattttgaaatcagatagtgtgatgcctacagcttttttttttttttttgcttgagattactttgactatatggtgacttttatgtttccttatgaattttagggttgcttttcatattttagagaaaaatgmcattggaattttggtagtggttacattaaatctgtagacaattttgggtagtatgaatattttaatagtgttaatttttaaaattcatgaacattagacattattctatgtatttgtgtcttctatttcatcagtattttatagttttcagtgtacaggtctttcaccgtcttggttaagttttttcggtatatttaaaaaatactattgtaaatgggattttctttttttaattttttggatagttgttagagtatagaaatgctactgacttttgttgtcgattttgtatcctgccaatttactgaattcatttattggttttaatcttttttttttggtggaatatttagggtttcctttatataagattatgtcatctgcaaacagacaatttttttcttctttttcaattcggatgctttttatttctttttcttgcctaatttccctggctatgactttcagtactatattaaatagaagttgcgagagtgagcattttgtcttgctcttcatcktagaggaaaagtttttagcttttcattgttgggtatgatgttagccgtgagcttgtcatacatatagcgttatgatgttgagatacattctgtctaatgtattgagagtktttatcatgaaaggatgttgaattttgtcaaatgctttttctgtatctattgatatgattttatgatttttattcttcgtccttttaaggtggcgtatcatgtttattgatttgcatatgttgaaccagcagccttgcatcctagggatgaatctcattggatcatggtgtatgatccttttaatgtgctattgaatttggtttgcaaatattttgttgagaatatttccatctatgttcaccaaggatattggcctgtaattttctattcttacagcattcttgtatcacattaatgctggcctcataaagtgagtttggaagtgttccttcctcttcagtttattggaagttttgtgaattctactaagaatttaaagaagtgatgctaatgcttgagaagcataacttctcgggtcttggagttttctttgttagggagctttttgattattggtttattcccctcactcattattggcctgttcagattttctttatgattcatttttggtaggttgtatgtttctgggaatttctttctttcttcttggttggccaaattgttgccatgtaattgttcatattagtctcttatgattgtatttttgtggtatcaattgtagtgtctcctgtttcatttctcagtttatttactttaatcttcttcttttttttttttttttttttttgagacggagtctcgctctgttacccaggctggagtgcaatggcaccatcttggctcackgcaacctccgcctcctgggttcaagtgattctcctgcctcaacctcctgagtagctgggattacaggcacccgccacaacgcccagctaatttttgtatttttagtagagacggggtttcaccatgttggtcaggctggtctcaaactcctgacctcatgatccgcccacctcagcctcccaaagtgctaggattacaggtgtgagcaccrcgcccagcctactttaatcttctttcttttttttatagtagtctaggcaaagatttgtcaattttgcttatcttttgaaaaaacaactaatgttgatctttttatattcttacattgatcttttaaattatttttctagtctccatttcatttatttctgctctgatctttagtatttccttccttctgctaactctgaacttattttgttctttttctatttctttgttgtgtaaaattaggttgttcatttgagatatttcttttttcttaatataggtatttattgctataaactttcctcatagaactacttttgctgtatcaaagttttggtatgttgtgtttctatttccatttgtcttaagacttttttttatttttcttttgatttcatctttgacccattgattgttcaggagtatgttgtttaatttccagatatttgtggattttccaatttttttttcctgttattcttttctggtttgtatgattatggacagaaaagatacgtgatatgattttagtcttcttaaactttttagacttgttttgtggtctaagatatgatctatccttcagaatgtgtcatgtgcacttgaaaagaatatgtatttgagagccccatagatggttcacatcacaggactctgtacrgacaacccccagtaccaacccagagctgggtagacttgctgggtggctagacctagaagacagacaacaatcactgcagttaggctcacaggaagacacatccataggaaaagtggggagagtactacatcaacggaatatcccatgggacaaagggattcgaacaacaaccttcagccctagaccttcttctgacagagcctacccaatgagaaagagccagaaaaccaaccctggtaacatgccaaaacaaggctcttcaacacccctcaaaaatcacactagggatgtgtttccatttgtgtcgtgtatttctttcagttgtgttttgtagttttccttgtagaggtctttcgactccttggttaggtgtattcctaagtatttttttttgcagctattgtaaaagggttgagttattgatttgatactctgcttggttgctgttggtgtatagaaagctactgatttgtatacattagtcttgtatctggaaactttgctgaatgctttcaacagttctaggagctttactcctaaggaggagtccttagggttttcaaggtaaatgatcatatcgtcagcagtgacagtttttcctctttactgatttggatgcctttcatttctttctattgtctgattgctctggctaggacttccaatactatgatgaagaggagtggtgagagtgagcatccttgtcttgttccagttctcagaggaatgttttcaacttttcccccattcagtattacattggctgtgggtttgtcatagatggcttttattacattaaggtatgtcccatgtataccagttttgctgacagttttaatcataaagggatgctgaattttgttgagtactttttctgcatctgttgagatgattgtgtgattgtgtttttaattctgtttatgtggtgtatcacatttattgacttgcatatgttaaaccatccctgcatccctggtatgaaacccacttgatcatkgtggattatctttttagtatgttgttggatttggttagctagtagttttttaagtaaggattttagcwtcagtgttcatcaaggatattggtctgtagttttctttttttggttatatccttttctggttttggtagtagggtgatgctggcttcataaaatgacttagggagggttccttctttctctgtcttgtggagtagtgtcaaaaggattgaaggattggtaccagttcttctttgaatgtctrgtagaattccgctgtgaatccatctagtcttggacttctttttgttggaaaattttttttttcttttttttttttttgagacggagtagttttgctcttgttgmccagactggagtgcaatggygcaatctcggctcatygcaacctctgcctctcagattcaagcgattctcctccctcagcctcccaagtagctgggtgggattataagcatgtgccatcacgcctggctaatttcgtatttttagtagagatggggtttctccatgttggtcaggcttgtctctaactcttgacctcaagtgatccaccggcctcggcctctgaatgtgctgggattataggtgtgagccaccgtgcctggctggtaatttttaaattaccatttcaatctcactggttgttattggtctgttcagggtactaattcttcctgatttaagctaggagggttgtatttttccaggaatttattcatctcttctaggttttctaatttatgtgcatacaggtgttcatagtagccttgaatgatcttttgtatttcagtggtatcagttgtaatatctcctgttttgtttcttagtgaggttatttagattttctctcttcttttcttggttaatctttctaattgtctattttatcttttcaaagaatcagctttttgtttcatttatcttttgtatttttttttttcaattttatttctttctgctctgatcttggtaatttcctttcttctgcttggtttggggttcggtttgttcttgtttctctaattccttgaggtgtgaccttagaatgtcagtttgtgctctttcagaccttccaatgtaggtgctttgggctatgaactttcctcttagcactgcctttgctgtatcccagaggttttgatagactgtatcattattgtcattcagttcgaagaattttttaattttcatcttgattttgtttttgacccarcgctcattcaggagcaggttatttaattttcatgtatttgcatggttctgaaggttccttttggagtcggtttccaattttgtcccatggtggtctgagagagtgcttgatataatttcaattttcttaaatttattgaggctcgttttatggcctatcacgtggtctgttttggagaaagttccatgtgctgttgaatagaaggtgtattctgcaattgttggatgaaatgttctgtgtatatcagttaagtccatttgttccaaggtatagttgaaatccatggtttctttgttgactttccgtcttgatgacctgtctagtgctgtcagtggagtactgaagtcccgtactattattgtgttgctgtctatctcatttcttaggtctcttagtaattgttttatacatttgggaactccaatgttaggtgcatattattytaagtgaagtaactcaggaatggaaaaacaaacatcatatgttctcactgatatgtgggagctaaggtatgaggacacaaagtcataagaatataatggacttcagggacttggcgggaagaatgggaggggggtgagggataaaagactacaaataaggtgcagtgtacactgctcgggtgatgactgcaccaaaatgtcacaaatcaccactaaggaacttactcatgtaaccaaataccacctgtacccccaataacttgtggaaaaattaaaaatactaataattaaaaaaagagaaaataacgtgtattctgcggccattggttgtagtgttctgtatatgtctgttaggtccatttagtctatagtgctcttcaagtctgctgtttccttattgattttctatcttgatgatttgccattgttgaaagtgggttattgaagtctcttactgttcctgtatagctgtatgttactcccttcggttcttttaaaattttctttatgtatttagatgctccagtgttcagtgcatatatatttacaatcactatatccagttaatgaattgactcttatcattatatratgaccttgtctttttttgacagtttttgacttagtctattttgtctaatataagtatagccacccctgctctattttgattgctatttgcatgaaaattgctatgaaatagcatgattgctatttatgcaaatagcaatcaaaatagagctgaagactctattttgaaagtcttcagactctttaagaacacatatagaatactttcacttcagctttaacaatgcatatagaatactttaaattaaaatctttaaattagagtctcttatgggtagcataattttkaatcttgttgtttaatccattcagccactctgtcttttgactggagaatttaatgttccatttgaagtaattattgataggtaagggcttactagagctattttattgttttctgttttgtagtacctttgttcctttcttcttctcttgctgtcttcctttgtgatgtgattttttttttttagtgatattctttgattcttttctctttatcctttgtgtatctattacatgatttttctttgtgattactctgaggcttacataaaacaccttctagttgaaacagtctattttaagctgttaataacttaacattggtcccacacacagactctactctttaatttctcctgcccccatattttatgttactgatgtcacgttttgcatcttttatatgttgtgtatcccctaacaaattattgtggctattgctatttgtaatttttttttaacttttacacttgtagctaaaaatgatttatgtgctagtactatactattacagtattctgggtttgtattcttacctttacagggggttttgtactttcatatgctttcatattagttagcatcctttcattttaacttgatgaactggctctagtggtgctgaatacccacatttttatttggttatgtctttattgctctcttattttttaaggccagccttttctggtatagtattctttgttggcagttttttttttccctttttcttttagcactttcaatatatcatcttactctctcctggcccgcaatggattgtctgagaaatctggtcgtagtctgatgatggtttccttatttgtaatgagttgcttttttcttgctgctttcaaaatttgttgacttttgagaatatgattataacatatcttggtgaagctctctttgttttaatctatttggagttctttaggctttatggatttagatttgaatccataaagcctaaagaactccaaatacactaaaacaaattatattcatttccctctccagatttgggaaattttctgtcattctttcttttttttttttttttgagacagaatctcactctgtcaccaggctggagggtagtagtgtgatcttggctcactgcaacctctgactccctggttcaagggattctcctgcctcagcctcctgagtagctggcattacaggcacacgccaccacaccaagctaatttctgtatttttagtagagacggagtttcatatgtggccaggatggtcttgatttcctgacctygtgatccacccgcctcagcctcctaaagtgctggggttacaggcctgagccaccgtgcccagcccattatttctttaagtaaattttctgcccctttctctgcttcttctgggtctgttgtaatgtgtacactggttcgcttaatgttgcgttctaagtccctgttaggcttttttcactcttcattcttttttctttttgtttttgtgacaagataatttcagaagatctgtgtttgagtttgctgattcttctgttgtattgtctgctgttgaagttttccattgaatatttaattcactcattgaattcttcagttccagaatttctgtttggttcttttttatactctctatctctttcttgaattcttcatttttttcatgcattgttttcctggattcatgttatttgaattctcttgtagctaagatgattattttttatacttatctggcagtttatgtatcatcagtcgtttagtgtctgctactggtgcttaattttgttcctttggtgtcctgtttctctaattattagtgatttttgtggacttgtgttattgtctgtgcatgtgaaaaagtaaacaacacttcttgtctttacagattggtttctgtagggaaagcccttcactagtcagcttgtctagtagttcttggtaggctgtcttgctgctggagtccttgggtatcttggtttgttgtctgggtcagcaggtggatggtcttggtgtctaggtccaaggagggcagtcttagtgctgggatggggctggagcctgaggccacagggacagttctggagcctctgtccactggggctgacctggagcctgtgtctatgggggtgatcctgaaggctgagttcatggatgccacctggcactgaggtgggccttgaattcaggaccatagtggtgggtctagagcctgagaccagcctgggtctacagwggctggttcggaatttggggctgcaggtccaagcctggctcttgtgtaggcctagagcctaagtctgcagggatccatcctgggctgtgggggctgaycttgggctgggatagggcaagtactggaatctgtggggagagctggatgcttatgtcatccttcttccatgtggacagtatttctctccacattgtgctgccagaggttgggggtgggatgaagcatttagtgagaaactttacttcctagattcttcaatgcatgttttcttatttatttattattttttgagacgaaatctctctttgttgcccaggctagagtgcagtggtgcgacacggctcactgcagcttcagtctcctgagtttagttgatcctcccacctcagtcacctgaatagctaggactacaggtgtacgccaccacacccagctaattttttgttttactttattttttgtagacrtgggttttctctgtgttgcccagagtagtcatgaattcctaggctcaagcagtcttctcacctgggcatcccaaattgccgggattacagatgtgagctactgtgcctggcctgtttccttatttttgttctccacccaggtactctaatmtctcacttggattccttagctgttgtgaaggtattttcaagtgtgggcaattgttcaagctgatatttctgtgaggaaagagcagtagaaaactcctattctgccacctttccatcatcagtttcatcacagttgtactctttcttgcaaaaactctaccattagaattatttgaaaacttagagccttgttagagagtctggcctagttgyatcctttacctcactgtgtataggcgtttcagtatccatagttctcttggtcattaactaatgtttttaaattgttagctaaaaataaaacaaaaaacaaaacaaaggaaactaaaatgatattagataaatgaagtagacaatgtggaatgataaggatttgttttcaattttttttttttaaagaggcaggagctctctctgtcttccakgctggagtgcaatggtgcagtcctagctcacttcactgtagcgtcaaatttctctgctcaaacgatcctcctgactcagccttctgagcagttggaatagcaggcacatgccattgcaccttattaaattttttattttttgtagagacgaggtcttgctttgttgcgcagactggtctggaactcgtggcttcaaatgatcctcctgcctcagcctcccaaagtgctaaaattgccggcgcaagccaccatgctggacctgttttcccttttaaaagtgactatattcctcgaacaatgtgttttgtggtcatataagttttgggattgttggtttaaataaaaccaatagtttcttttctgctggactcctcagagtcttttaatatgcaaatatttatcattatgaagtgatcaaaaggatttcttatggaaacttagttgccatggcttggggagcagcgactttttgtattttgcaatgtgaatgcaataaatgaccacaagttctttccatcactgtgtgtttgcccttttgtgtgcagttttgtactcctatgataaaagaaatggaatcagtttttgcaggctttaagtctgtgcctggccctgttactttctttggccagtgtgatgtcagcaatcatgatgcacacaggcttgaaagtgcttgaggcttgccttcccttgctgctcttttaaatcctaccttatctatattaagaaatatttactagcttcctggaggatgagagaccctgtggaacagaatgagcccccttagctgagaatccttctacccagctgtcctgccaattaccagacatgtgacatcatgctggactatcctgtcccaattgaagtttgtccacacccagttaactctcagaactgtcagaaataatatatgtctgttgttttaagtcgctaatttttggggtaattaactatcaaaagctaaaggatgcatatacttgttaactttttatataatgcagttgttttgyaaatttaggctgagaaacagtgctctatgggtaggaatattctctaaggacttattggtagcttaggttacttagtgtggttttgaattctttttgagacattttcaaatttactattgaattttaacttaatttccaaaaatttctatagcagaacatgctcatttaatgtaaataatttgacaaatggaattatgtaataatggatgattgatgttgggctagtagaaactttctctagaatcgatgttataaaaccttggctgattattatgagtttttttttatctgcaatatttatctgtattttattgcatactgttgcataaaataatgggtcaggtagatgcccagtcatcaaatgccacatgtcagaatttcaggtgatagttacaaactacatcaatcaaaaacactttctagtttaaaacaatttggaactacagaacatacagtaacattttgaatttaaaattactgccartggggaatgtgtttaaacagcatccactcttggaattgctaaactgatttattcatcataggaactggtactacaactgcatatttaattgctctaatgaaagattttttttctttattttcctgtaatacagtatttacaatccatggacttgtgccattttccatttggcactttattatttggcctaaggccatggtgtgctgtgatgttactcatgagctctggagtgattaacactggtgaaagtactttcttatactgcattttatgcttgcttcagataataaaaattttcctgagaagtcaacatttctgtaattagattcctaaaaattcagtttcctgatttctggcaattacatctacaaaaatttctccagattatttctgcagatggttaatacttattttggtatagaaaacctgtttcaaatggctagttaattatcaacatttaaaaaatagtatagtgggcatttagcatgttttcagaaaagattttagtgcataaagttaaaatttccaaatcacacttgcctagttatatttaagtttgcaagaaaggtgctaggatggaaatattgccagtgaaaatataaatgttaatacattactaattttaggagaccacaagtgttagccacttacttaaatgtaatgtttccttcttttggagcttctgaatggtgattacagtgacattaaggtcaaatgygttttctttacagcatgaatccttacaatctaggaatatgctaatattcattgtgaaattccaattttcttatccagagataacagctgttaacattttgttatagttcctgtaagatttgtgtgtgtgtgtgtgtgtgtgtgtgtgtgtgtgtrtrtgtgtgtgtgtgtgtatgtatattagagatggagtctcactctgtcgcctatgctggagtgcagcagcacgatctcagcttactgcagccttcacctaccaggttcaagtgattctcctgcctcagcctcccaagtagcttagagtacaggcacgtgccaccatgcctggctgatttttgtgctttttttttttagtagagatgaggttttaccatgttggccaggctggtctcgaactcctgacctcaggtgatctactctcttcagtctcctggagtactgggattacgggtgtgaaccacagcrcctagccgtctttgtatattttaatgtagttaatcttaagatatatgtagttttatattctgcttttttcacttaaaattatgtagtaaacattttacattagaatttgttggcaaaactttttaaatgactacaccaaagacttttatrtggataaactgtaattggtygatccttctttagtctcaaatatttaggcttttgtctatttttccataccattgttataaagatatttgtgtgtaaatctttgcatttatgatttttagaaataaaagtataagactaaaatgtattatttttaaagcttgtgacaaatatcaagcttttgttttcagaaaggttattctaatttatgatatatgacaaaaatttaaaattataacaaccttaagcaggaactcaattttcactttggttattttctttttacttttcactagagtttatttttttaacttttggaaagatctttattgtcagaaattgatattgaataatctttagataaatacagattttaaaaagaaaatgaaaaataattattaattatatatcttctcctttctataaaagtgttaaatttttagataaaagggtatagctgggccattacttttaatgkattttacagtacatgacagcaggttcttaccttttatttatatccttagtacttagcatatgaatagcacatagtagatacccaatcaatatttgttgagtgagtgaatgaataactgtaattttcatgaataaaccccatattaaatgataaatttcagatatatgtgaaaatgaatttctcatctttcttctttaccaaagtacaatagtctattattaacctcatgaagcacctttagattttccatattttataaagcagctgatttcttctatgatttttaatccatgttcagtgaatttaacatttttagaataaaaatgcctataatagtactgtgctatctactctggaaagatataaagaagtcctttatgttttctgcagaaacattttgctgcttttatctactattaaaaattcttattttagtaaggtaaacaaaaaatagtgcttttaatatttgtattcatatattatcrttgtgataagtttctctatgtacaccataacaattttcagtgataagtggcattcttaaccaaatatatacaaatggagtatcatcaagtttaattcttttatgcatctaaacctgcctctcctcacctccatgctttctctgtttcattttatgtagcattttaggttgttccttattatttggaagtaattcatctttatactttttgatcttgcctttggattctagttttcagaatttggacatttggttcacaatgagctaatgtataaaccattagagaggtagtactccattttcttgtgaacgcagttttgtaaagtgaactgcagccagagcctcaggactaattgtataacccaaaccccttagtaaactccgatccaggttaaacttagaggtcgttggctatcaaattgagtgtataccacatatcattagttaaataaacatttatttactcccattttaaaatgtagcagttttcttaattatatgaataatcaactgtctctttcactaattatatatttaaaatttactactatattttcacctggcaccttttcagatgagcctagaacatcagaatgtgacagtcagttgagtttcataggatgagctcattagcagtacatttctggtgcaaaggtttgagtgaagtagtttaattgrctataattatatttcattcttcatatccccttaggataattagaagaaattcattttagtttttattctttaaatacagtactgcattttatattttatttttttacaggctcaaagattgagggtttctatgatgctttattaaataaaagattgctttttttggaataaatagtataacctgtggaaatgctattaattccatattggttcttggcagggcttttaaatttggtttcttttgatttgcttcttgttgtctagacagaaaagtgtcttctatcactcccaagatcccagtctttcttgccagcttctcttgtgcatttttatagttttaagtaatagcaattgaacaggaaagcacatttgggaaagtagattactttttaccaggaaatagtgccagaatcaagattgtagttttaatctccttaaatatttcagaaggttaactctttcatttcacttttctttttataccttacttttgttgggcttttataaaggaggaaaaatgggagagatagcaaaagttactggaaggatcatcaatttctatcctcagctctgatcctgattaacttttggtgaaatcaaatagccttcctctcagactctaaatggaaaatttaatttgcaatttctgatggttatcttgttctgtatttagaaataatgttgaagttgtgatagaggcattatgctacgcttctttgtatatttgatcagtgctctttaaatacttcatgagtgtttgctacagttacatattttcagacagagtaaaggagataataattcgcataaagactagtacccactagtagggttaacgtggttcttttgtggtaccacacttcatcactttactatatacagatatgaagtaattgtatactcatttatctcgccctttagttcattggtcccattacttcatagtgtgatctttccaaaataaattactaatatagcttaaaatctatcagcctaactgcctattgatcatctctagtatgaaatctgtgctcattagcctccttttccacttgcatctcactttatgctctagtcttgttgaaccacttcatatttttgcacatgctgtcctcccatctgcctgaaaagttattttatgacctctcagttaccaaagatcctgtaatgtgtacacctcatgccttccatacacatggactccaaatacacatatatgctttgtggacataattgtgtcttgtgtacctttgtatccctagtgcttggcaaataaaaacaactaacttaattttagttgaatggctgagtggatattttgtgaagcagtttatggtagttcctattttttcagaaatagttcttttgcctttacatatgtattagtcaagattctcaagagaaacaaccaatgggatggatggatggatagatgggtggatggatggatgggtaggtaggtaaagaggtagctaggtagatagctaggtaggtaggcagatagatagatagatagatagatagatagatagatagatagatagatagataggagaggagatttattaggggaattggctcacacaattatggacgctgagaagtccctcataggctgcctgcaagctggagatgtagggaagcctgtagaaggtagtgtgactcagtccaagtcccagggtctcataatcaaggaagccagtggtgtaattctcagtgagactgaaggcctgagaacccagggggctgctggtataagtcccagagtccaaaggctggagaacgtagagtcccaatatccaaggacaggtaaagaagggtattctagttccaggaaaaagagcaaattttgcctttttactgccttttaattttgtctggactcttagctgattggatggtgcctgcccacattgagggctgatctttcctaatgagtccattgactcacaccattctctggaaacatcctcacagatacacccagaaataatgctttactagctattacatatccctttattcagtcaagttgacacctaaaattagccatcacaccaaatgtttttgttgggtaacagctttatttagatgtaattcacataccaaacaatttattcatttaaagggtacaattccatggtctttagtatatctatggaatcaagtaaccatctccacagtcaatttttaaagattttcaccacctaaaaagaaaccctgtgccctgtacttactacctcccaacctgcccatctcacttagataatcactttgatttgcctgttctgtacattttctataaatggaatcataaaatatgtggctctttgtgactggattattttatttagcataggttttccaggttcatgcatgttgcagcatgtatcagtatttaattttttttaactgccagatcatattccattgtgttgatatagcccatttgatttatcagttcatcagttgatggacaattgggttgtttctactttttggctattatgataatcctgctgtgaacattcatgtacaagttttcgtgtgaatacttgcttttaattctttaaggtacatatctggaagtggaattgctgagtcatatggtaactttgtgttttaaccttttgagggtcttctagatattttccaaagtatctgtaccattttacattcttaccagtaatatatasagagttcccattttttccacttctttgctaacacttgttattatttatctttttgattatagctatcctagtgggtgtaaagtattatctcattgtggttttgactttcatttcctaaatgactaatgatgttgagcatcttttcatttgcttattgaccatttctattgcatctgctttagggaaatgtctagtcagatcctttcccattcttaattcggtgatttgtctttgtattattgagttgtgacagttctttatgtattctagatatgattcctttatcagatatgttatttgcacatttatttttccagttagttgtctctttcactttcttgatagggtcctttgaagcacaaaagtttaaaaaaaatttttgattaagtccagtatctttttgttgttgttgttgaatgtacctttggtgtcacatttgaagaactgttgtcaaatccaagggctttaaggtttactctgttttttcttctaagagttttataattttaactcttacatttagatctttgattcatttttttaaattttattattattatactttaagttttaggatacatgtgcacaatgtgcaggttagttaaatatgtatacatgtgccatgctggtgtgctgcacccattaactcgtcatttagcattaggtatatctcctaatgctatccctccccmctcyccccaccccacaacagtccccagagtgtgatgttycccttcctgtgtccatgtgttctcattattcaattcccacctatgagtgagaacatgcggtgtttggttttttctccttgtgatagtttactgagaatgatgatttccagtttcatccatgtccttaaaaaggacatgaactcatcattttttatggctgcatagtattccatggtgtatatgtgccatattttcttaatcctgtctatcattgttggacatttgggttggttccaagtctttgctattgtgaatagtgccgcaataaacatatgtgtgcatgtgtctttatagcagcatgatttatagtcctttgggtgtatacccagtaatgggatggttgggtcaaatggtatttctagttctagatccctgaggaattgccacactgacttccacaatggttgaactggtttatagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgtcttttggctgcataaatgtcttcttttgagaagtgtctgttcatatcctttgcccacttgttgatggggttgtttgtttttttcttgtaaatttgtttgagttcattgtagattctggatattagccctttgtcagatgagtaggttgtgaaaattttctcccattttgtaggttgcctgctcactctgctggtaatttcttttgctgtgcagaagttctttggtttaattagatcccatttgtcaattttggcttttgttgccattgcttttggtgttttagacatgaagtccttgcccatgcctatgtcctgcatggtaatrcctaggttttcttctagggtttttatggttttaggtatagcgtttaagtctttaatccatcttgaattaatttttgtataaggtgtaaggaagggatccagtttcagctttctacatatggctagccagtttttccagcaccatttattaaatagggaatcctttccccattgcttgtttttctcaggtttgtcaaagatcagatagttgtagatakgtggcattatttctgagggctctgttctgttccattgatctatatctctgttttggtaccagcaccatgctgtttggttactgtagccttgtagtattgtttgaagtcaggtagcatgatgcctccagctttgttcttttggcttaggattgacttggcgatgcgggctcttttttggttccatatgaactttaaagtagttttctccaattctgtgaagaaagtcattggtagcttgatggggatggcattgaatctataaattaccttgggcagtatggccattttcacgatattgattcttcctacccatgagcatggaatgttcttccatttctttgtatctttatttccttgagcagtggtttgtagttctccttgaagaggtccttcacgtcccttgtaagttggattcctaggtattttattctctttgaagcaattgtgaatgggagttcactcatgatttggctctctgtttgtctgttatcggtgtataagaatgcttgtgatttttgtacattgattttgtatcctgggactttgctgaagttgcttatcagcttaaggaagttttgggctgagacagtggggttttctagatatacaatcatgttgtctgcaaacagggacaatttgacttcctcttttcctaactgaataccctttatttccttctcctgcctaattgccctgggcagaacttccaacactatgttgaataggagtgttgagagagggcatccctgtcttgtgccagttttcaaagggaatgcttccagtttttgtccattcagtatgatactggctgtgggtttgtcatagatagctcttattattttgagatacgtcccatcaatacctaatttattgagagtttttagcatgaaggttgctgaattttgtcaaaggccttttctgcatctattgagataatcatgtggtttttgtcwttggttctgtttatatgctggattacatttattgatttgcatatattgaaccagccttgcatcccagggatgaagcccrcttgatcatggtggataagctttttgatgtgctgctggattcggtttgccagtattttattgaggatttttgcatcaatgttcatcaaggagattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtgctgatatcccctttatcattttttattgcgtctatttgattcttctctctttttttctttattagtcttgctagcggtttatcaattttgttcatccttccaaaaaccagctcctggattcattaatgttttgaagggttttttgtgtgtctatttccttcagttctgctctgatcttagttatttcttgccttctgctagcttttgaatgtgtttgctgttgcttttctagttcttctaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgagtttcttaatcctgagttgtagtttgattgcactgtggtctgagagacagtttgttataatttctgttcttttacatttgctgaggagagctttacttccaactatgtggtcaattttggaataggtatggtgtggtgctgagaagaatgtatattctgttgatttggggtggagagttctgtagatgtctattaggtctgcttggtgcagagctgagttcaattcctgggtatccttgttaactttctgtcttgttgatctgtctaatgttgacagtggggtgttaaagtctcccattattactgtgtgggtgtctaagtctctttgtaggtcactcaggacttgctttatgaatctgggtgctcttgtaatgggttcatatatatttaggatagttagctcttcttgttgaattgatccctttaccattatgtaatggccttctttgtctcttttgatctttgttggtttaaagtctgttttatcagagactaggattgcaagccctgcctttttttgttttccatttgcttggtagatcttcctccatccttttattttgagcctgtgtgtgtctctgcatgtgagatgggtttcctgaatacagcacactgatgggtcttgactctttatccaatttgccagtctgtgtcttttaattggagcatttagtccatttacatttaaagttaatatcgttatgtgtgaatttgatcctgtcattatgatgttagctggttattttgctcattagttgatgcagtttcttcctagtctcaatggtctttacattttggcatgattttgcagcggctggtaccggttgtgcctttccatgtttagtgcttccttcaggagctcttttagggcaggcctggtggtgacaaaatctctcagcatttgcttgtctgtaaagtgttttatttctccttcacttatgaagcttagtttggctggatatgaaattctgggttgaaaattcttttctttaagaatgttgaatattggcctccactctcttctggcttgtagagtttctgccgagagatccgctgttagtctgatgggcttccctttgtgggtaacctgacctttctctctggctgcccttaacattttttccttcattttaactttggtgaatctgacaattatgtgtcttggagttgctcttctcgaggagtatctttgttttgttgtctgtatttcctgaatctgaatgttgtcctgccttgctggattggggaagttctcctggataatatcctgcagagtgttttccaacttggtttcattctccccatcactttcaggtacaccaatcagatgcagatttggtcttttcacatagtcccatatttcttggaggctttgttcatttctttttattcttttttctctaaacttcccttcttgcttcatttcattcatctcatcttccatcactgataccctttcttccagttgatcgcatcggctcctgaggcttctgcattcttcacgtagttctcgagccttggctttcagcttcatcagctcctttaagcacttctctatattggttattctagttatacattcgtctaaagttttttcaaagttttcaacttctttgcctttggtttgaatttcctcctgtagctcggagtagtttgatcatttgaagccttcttctctcaactcgtcaaagtcattctccgtccagctttgttctgttgctggtgaggagctgcgttcctttggaggaggagaggcgctctgctttttagagtttccagtttttctgctctgttttttccccatctttgtggttttatgtttgtttggtctttgatgatggtgatgtacaggtgggtttttggtgtggatgtcctttctgtttgttagttttccttctaacagacaggaccctcagctgcaggtctgttggagtttgctagargtccactccagaccctgtttgcctgggtatcagcagcgctgtctgcagaaccgygcattttcatgatctgcaaatgctgctgtctgatcatccctctggaagttttgtctcagaggagtacccggccgtgtgaggtgtcagtctgcccctactggggggtgccttccagttggggtgctcggtggtcaggggtcagggacccacttgaggaggcagtctgcctgttctcagatctccagctgcgtgctgggaaaaccactgctgtcctgaaagctgtcagacagggacatttaagtctgcagaggttactgctgtctttttgtttgtctgtgccctgcccccaaaggtggagcctacagaggcaggcaggcctccttgagctgtggtgggctccacccagttcaagcttcttggctgttttgtttacctaagcgagcctgagcaatggcaggcrccccttccccagcctcgctgccgccttgcagtttgatctcagactgctgtgctaggaatcagcgagactccgtgggcgtaggaccctctgagccaggtgcaggatgtaatctcctggtgcgccgtttcctaagcccgttggaaaagggcagtgttcaggtgggagtggcccaattttccaggtgccctctgttacccctttccttgaccaggaaagggaactccctgatcccttgcgcttcccgagtgaggaaatgcctcggcctgcttcggccggcacacggtgcactgcacccactgtcctgcgcccactgtctggcactccctagtgagatgaacccggtacctcagatgtaaatgcagaaatccctcatcttctgcgttgctcacgctgggagctgtagaccggagctgttcctattcagccatcttggctcctccccactattttgaatgttttctrtgttatcttttgagataatctagtgtttcttagtctgtcaatatgaattatattaattgattttcaatgtttgaatcagtcttgtagtcctggaatgaactccactggaatgtagtattccttttgcacattgctgaatactgtctactaatattttgttgaggatttttgcatatatgttcatgagaaatattgttctgtagttttcttagaatgtttttgtctgcttttgwtatcaggataatgttggcacggtgaaatgagttgggaagtattctctttagtttttatttgttggaagaaattgtgtagaattagtattatttttcccttatatgttctccattgaaatcatctgggtctggaattttcattatttggaaggcttatgtaaattttaatatttttactaaatctaggactattcagattatctgttttttttctcaagtgaattttggtagtttatattttttcaagaattctgtttcacctaagttgttgaatttatggccaaagagtcattcatagtatttccttatatttttaatatctgttggatcagtggtatgtccggtctttcatttttgatattggtaatgtgtgtttactttctcttttccttggctagaggtctgtcatttgtattgatcttttcaaattgcctttctttcttctttttttttctgagacagagtctcactctgttggccaggctggagtgcaatggcatgatcacagctcactgtgacctctgcctcctgggttcaagccattttcatgcctcagccacttgagtagctgggattacaggcatgcaccatcacgcctggctaatttttgtatttttagtagggaagggttttygccatgttagctggctaggctgttctcaaattcctggcctcaagtgatctgcccacctcagcctttcaaagtgctggaattacaggtgtgagccactgcgcccagccttgttttattggttttctgttttctattttatttatttctactctaatctttgttatttctttccttctgtttgctttatgctaaatttcttcttcttcctctagtttcttaaggtgggatgtgtggttactgattttagatctttcttcttttctaatctaggcattcaaagccataaacattcattaagcactgctttagcggcatsacacatatttgatatagtgtattttcatttccatttagttcagyatattttagaatttcccttggtacatctttaaattatcacagtctacctttaagtgttaytataccatgtgtacagtataagaaccttagaacaatatatttctattgttcccctcctggcctttgtgctattgttgtcatatgtttacttttgcatatattgtaaacttcaaaacatactgtcatcagttttgcactaaacagagtattttcttttgaagagtttaaatattaaggaaaagtgatatttatatgtactcaatgtagtcaccatttccagttctctttagtcttttgtgtagattcaagtttctatctggtatcatgttccttactcttgaagtgcttactttaacatttcctataatgcaggtgtcctggtcatgaacttcttcagtttttttttttttaatatctgaaaacgtattttgtttttattttagaaagctattttaactgaataaataattctaggttgacattcctccctccttgtgttctttaatggttttgctccactgtcttctgtcttgtattttttttgaaaagaaatctgctttcttcattttctttgtcttgtctatataacatgtcccccggccccacctcattgcttttaacattttatcattggttttaagcaatttggttatcatgtgccttggtagttttcttcatgtttcttgtgctttcggtttattcatcttgtatatttgagcttacagtgttagtcaaatttgaaaaaaaaaatttcttcaaatatttagtgtttgctctttcctctctcactggagactcaaattacacacatatatatggagattgtgtcttcttttttactttttttgtttggtttttggtaatctctatctagtgctgcacctaccagttcayagcctttttccccttttgaaatggctaatctgctgttaattccattcagtgccttttaatattgtggacattgtagttttcttctctagaagtttgatttttatcttcttaaaatgttatacttttctacttactgttttcaatgtttcctttatttgcacaaaggtaatgcatttataacttctaatgtccttgtctactaatcctatcatctgtgtactttttggatcagtttcaatttattggtttttctctttctccttacgggtatattttcctgtttctttgcatgcttgttattttttttgtttccatttgcaaagttattttcttttactctcttttttttttctttcttctctttttgtaaaaggaaaccatggtcttgggggctagagcggagttttgcatgcctggtaatttctgattgaattctagacattgtaaattttaccttgttgggaggtgggttttttaaatattcataagaattttagtatttataaaaatatttttgagtgtaattttgaggtgtggttaagtgttttggtaacagtttgatcctttttagtcttgtgtttaaattttctgaggtgagactaaggcagtgttttgaatagggttgatttttccactctattgaggtagggccctttttagtactctacctaatgccctatgaattatgagtttccactctggctattcggaggaggcactattcctggccctttgtgagctttgagtattatttgctccattctttttaggtgcttttctttggtcttgtgtgttttcttcacgtgtgaatatttggcagccacttttccgtcacacacagggttttctctttgtttgaatccccactccctctgtctctgtacaggggagctgttttattcttctttcttgcctattaaattctccatgcctatatnnnnnnnnnnnnnnnnnnnnnnnnnnnnnnnnnnnnnnnnnnnnnnnnnnnnnnnnnnnnnnnnnnnnnnncttctgcaaattttaaaggttttctccctgggaactttatttattatctccagtactctaccctgcaaactgtagccactttgactttcccatactcctagctctgtcttctcaactcagggagtttgtaggttctgcctaaggtttccattgctgtgacctgtgaactttttccagtcaataagttgggagcaatcatagggctcatcttattggtttcccttttctcaagggtcattgtctttgattcagatgttcagtgtcctgaaagttgatgctttatatattttgtttacttcttttagtttagtttttttgttttgttttttccagacatgtcttagtccatttagtattgctatagaatttagtattgctatagaggaatgcctcaggctggataatttataaagaaaagaggtttatttggctcatggttctgcaggctgtacgagaagcatggcaccagcatctctttctgctgaggcctatagtaagctttcacttgtgtagaaggtgaaggggagcttacatgtagagatcacacggcaagatgagcagcaagagagagatgccaggctcttttcagtcaccagttcttatgggaactaagagtgaaaacttactcactcctggagaatggcaccaagccattcatgagggatctgctgccacaatccagacagctctyacctaggccctacctccaatattggggatcaaatttcagtgagatttggcaggaccaaacaaaccatatccaaactatagcaagacagaaaggtaaataaatgttaccttttttactttatgatcagaaacaaaggtccttatttatccatttttgaaagtcccatatttaatgatttacagccatgccacagcataggacatattcacatgtcccgtgttaaaattgctgtctgaatttcatgtactctttagagaactgctttgcagttttaagtatacatttttaggaaaaaaaagcttattaagaatgaaatttcttctcgttttgatcctacagaaagaggaatgctctaaggtaaaatggggcatgatgctaaaatgggaaaagtagggtagattgatgaaacttaatctgaaaactagcagcagatgtttgagaactccatcataggcctgaaataaatttaaggataagtttaaaggtttggtataaagttttctttaatgtcctgggttgaatgtagatggagagtggggggaggtgtgagttctggagaactgttaatttgtttgtaattttattacctatctgtctgtgcatctgtcttcattggggtccccaagaccactctcaggcttgatgattcactagaaggactcactggacttggaagctgttacactcatggttatgatttgttaacactgaaaggatacagataaaaataagcaaagggaaaaggtgcatgggtaacgtccagaagaaaccaggtacacacttctagatgtccttttccagtggagtcacatgggaacacacttaattctcccagcaactatgtgtgacaacaggtgtgaagtcactaccaaacagagaagttcacttgagccttagtgtccagaattttactggaggttagtcacgttggtatactacagtgctggcgtgactgacctcagctatccagattccagtacttcccagggcaaaarcaagcattcaccataaatcacactgtcagtataaacttatctggtcagattggtacagcatggcccaaggtacatacatactgggatattgtgcctgatacttgtttttatatgcaccagtacatacctctctagtttactaactccatactttatttggattgaattagtttttcctctaatgtcctttgtctgtttgaggatcccttgtagattttcacattacatgtggtcatcatgtttctaggtttctctgggctgtgacaatttcttttcttatttttgatggccttgacgattttaaggtgtactggtcaggtcttttgtagaatgcttctcaatttgagtttggttgatgttttcttacggtttgactgggattgacggttttgggaggaaaaccagacatgaagttccaattttcatcacagtctaactaaggtataatatatattttgaacctttaattatctaatttaaaaatctcctggcccttcagaaatacttaatcagattttaggccattatggtgcttatatgccagatttgttctcagtggcttttcttatctgataacttttaattaataggcagccttctttgcagtggtgtcaagatcrctgtgcacaacttcatatctttctggagacaacagggaaaggaagccagaagggagaacagtaattggtcaagttgcagattagggaagctaaaattggtctcttttactagattagaatctggagtaaaactccagtctggcccttcagcataacttttccattattcacatatgcctctcttccttctacaagccaaattaaaatttagtattagggactccaaatgrtacaaactcattcattctctttaattgcctaactcctactcattcttcatattgttgcttaaatgtcagaccttttaggaagctatacttgacttagaggaccctcaaggcctgtcatgggctcttgtagtattccgtataattttttgtctagtccttaatttaagtattagtgtatgttttaatgtattttttttcccagactgtaagctccacaatgtagagaccgtgtcagttttattcatttttgtattcttagagccaggccaagcattcaaaacagmcatgcagtaatatgaatatatctgaatcaatgagtgaatacataaataattgagaaaatgaatggatattagatattaaaacctttaccaactctacttatagcagcctgactctagttaaccataaatacacacttgtaacgcatgggccccacacttaccctaagttataaaaatggtacaattaggtaatttctaccctaagacagtcagtttttgctcagcratctaaccacgtaggcttgcttacttctgagacttgcttgacctatctcattgaactcgctctgtgcctgagatacatgtccaatttctcaaggcaagttcttcttccagaattgtcttgtgacatactttgagccaattccctagttggttctgtaccagtaaactcatacccccagctattacatgtagcacattcaacattcagggacaaactttgatgtaagttaaactttttttttcttttctaaatattgcccattaagactgtgttttaaggattgttttctaatactttcttcactctttatcagaggtttgtcctcctaccttttgccttcaaaccaaaacatcagtaacagtcctctttccccaacatctttgttctctggccagcattgattattcttccccatgggggagcttactttctagtctatacctcaggacacagaatctgaactgcttttaaagtttgcttatatgagtttgctgagctttctgacccagagatatcttctgtctttgcctcgcatttaataaacatttggaacatcccttcagccagtcttggcagagtaggctttttatttccatgtatacaaaaactttattatcagctaaccatcaaaggaaatcagagaaaatggtttgaacttatgacccaactatttggacagattagggctaggaaatgtaatgcaaggcatgtatgtatagactttgtacacttttacatattggtttcactcgcgtccctgtgaagagaccaccaaacaaagactagggagggaccgacgtgttaaagaatgcctggacgtcaggcacctcagaccgtttgcccattttatgacaagaattatctagatcttgtaggatggaaaaatcgaaagtgccattttctggctatttggaaccactgtcaagtttatattggggtcaagcggtgttggagaagaaaataaaatgcttagattttagatcaggtgtgagctgaagaggttttaaggtcttgagaacacaggctaagggagaagaaggaggaatggagggtggaaggttgcctatagtgaaggagcaagtccagagaaaagagagggtagagacagagtgaaggggtggggggtgcttgcccccctggaaagtggagagaaaagagagggtagagacacagagagaaggggtgtggggtgcttgcttcccaggaaagtggagaaggggtgggtagagacatggagagaaggggtgggggttgcttgccccccaggaaagtggagaaggggtgggtagagacatggagagaaggggtgaggggtgcttgccccccaggaaagtggagaaggggtgtggggtgcttgccccccaggaaagtggagagaaggaagggtagagacatggagagaagcggtggggatgcttgccccccaggaaagtggagaaggggtgggtagagacatggagagaaggggtggggggcrcttgtcccccaggaaagtggagaaagggtgggaggtgcttgccccccaggaaagtggaaaaggggtagagacacagagagaaggggtgggggtgcttgtcccccaggaaagtggagaaggggtatggggtgcttgccccccaggaaagtggagagaaggaagggtagagacacggagagaaggggtgggggatgcttgccccccaggaaagtggagaaggggtggggagagacacagagagaaggggtgggtgagcagccaaagcaggtgtcyccacaattgacttgccaccaagggaatgtgggtgaatgaccaaggcaggcstccctgcggtgatcagacaccaatgaaatgtgggtgaataatcaggcaggcatccccgcagtgattaaacaccgagggaagactgtcttctcaagtctgtgaccggcgctggagttttcggtccacggataaaacgcatctcctttgtctctaccagaaaaggaaaggaactgaaattaagacaagggcgagactgaagtgtggcaccaagattgaaaggagaaagagattgagggttagtgagagaggttggagaagagagtaaagaggccgcttaccgactttaaaattggtgagatgttccttgggctggttagtctgaggaccagaggtcgtaggtggatctttctcatggagcaaagagcaggagaatagcggactgatctcccaaggcaggcccccctatccgagtcacggcaccaaatttcactcgtgtctgtgtgaagacaccaccaaacaggctttgtgtgagcaacaaggctgtttatttcacctgggtgtcggcgggctgagtccgaaaagagagtcagcaaagggagataggggtggggccgttttataggatttgggtaggtaaaggaaaattatagtcaaagggggttgttctctggctggcaggggtcagggggtcacagggtgctcagtgggggagcttttgagccaggatgaaccaggagaaggaatttcacaaggtaatgtcatcagttaaggcaggaacaggccattttcacttcttttgtgattcttcagttacttcaggccatctagatgtatatataggtgcaggtcacaggggatatgatggcttagcttgggcttagaggcctgacaattggtaacctttttcacctgaccacatgtatgggtttaatactaactctccaacttttttctttatttttattttattttactttaagttctaggatacgtgtacagaatgtgcaggttctcagcaaactaacacaggaacagaaaaccaaacactgcatgttctcactcataagtgggagttgaacaatgagaacacatggacacagggagggaaacatcacacaccagggcctgtcggggttggggggcaagggaagggagagcattaggacaaatacctaatgcatgtggggcttaaaacctagatgatgggttggtaggtgcagcaaatctccaacttttttctatattgcccatcttaacctcctaccagcttgtccctctgtcacttttaccccttctgttgttttacttgtaagataatacaagataaatatatgtctgcctattaatttatttctttaccaagcaccaaacatatgtaatatagaaggtactatgttaggaaggtcctagtcatacacacatatagaaaaaatagtttagttattaattactcatgcctcaaattatcaagaaaagtaatcaaaactcatttaaacatttttactattaaaaatgatttcttctagttttgggtcatttggttatgtagtattccatatgattgacttaaaattcacttaagaagcttgttaaacatatacttagctcctgggcttaggggtcaatcagtagaatcccctctgtcttccctctgtttttagtttccttgtttttagtttctatattttccatattcctttatctttcccagttctgctatgccatggtaagaattgcaggagttactaagcagttttcttaaatattcaaagcatttgctggtgattatagggaagttattcaaggaatttggtaaattagaaaaagcaaaatattttcatgatgtatgaagaattttgtaggcgagttttatgctgttgtcatatctgagtcttaatttttgttacttttttaagtttccattttttatgagttttttttcttatacttgttcatctgacaaaagtaggtagttttttaaaagctcattgtgtaaatggttaaccatttttaaggtgaattaagacatacatttttgtaatctaagggaagttacttggataatttattatatttataaggtttgacttcatgcatagccagatctgaggacagtgctaagtgtgattgtaatgtaattatattttagaaattgagctaagattttaatataaccattaaactgattattgaaatctatacagtttgaaaaaaaattacctttaagttgataatatttttcatgtttttttcagatacctatattttttaaacttgactaattcccatcttaatgtctttacttattaaatatgacatctatgaacatctggccctcttagctattatatgtttagtgaggttctcaatgttatttactaaagagcaacaaatcccaacaaatcaagagcaattagtggcccagttttggtgtatagtttcttatattctttctaatctagttttttagctttctgtactcccatctgtgaaattgttagatgttttcaacctaagcttgcttatggaaaatggaaataaaacagaaagaggggaaaggctgggagaaaagagaagcaaagacctctttgaayactcagcccttcccactcaccctgtgcatagcacttcacatttttacttgwctgcacaatctgtctgcttttcattggttttcagagtcctcgagtgatttttgtattttgtctgacatttttctttctttttttttttttttttaattgatcattcttgggtgtttctcacagagggggatttggcagggtcataggacaatagtggagggagggtcagcagataaacaagtgaacaaaggtctctggttttcctatgcagaggaccctgcggccttccgcagtgtttgtgtccctgggtacttgagattagggagtggtgatgactcttaacgagcatgctgccttcaagcatctgtttaacaaagcacatcttgcaccaccattattccatttaaccctgagtggacacagcacatgtttcagagagcacagggttgggggtagggtcaccgatcaacaggatcacaaggcagaagaatttttcttagtacagaacaaaatgaaaagtctcccgtgtctacctctttctacacagacatggcaaccatccgatttctcaatcctttccccgcctttctcccctttctattccacaaaaccgccattgtcatcatggcccgttatcaatgagctgttgggtacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccccccacctcctatatatatggggcggctggccgggcgaggggctgacccccccacctccctcccggacggggcggctggccgggcagggggctgatccccccacctccctcccggacggggcggctggccgggcagaggggctgacccccacctccctcccggatggggtggctgccgggcagagacgcccctcacttcccagacggggtggctgccgggtggaggggctcctcacttctcatatggggcggttgccaggcggagggtctcctcacttctcagacagggcggctgggcagagacgctcctcacctcccagacggggtcgcggccgggtagaggtgctcctcacatcccagacggggtggcggggcagaggcgctccccacatcttagacgatgggcggctgggcagagacgctcctcacttcctagatgggatggcggccgggtagaggtgctcctcacttcctagatgggatggcggccgggcagagacgctcctcactttccagactgggtagccaggcagaggggctcctcacgtcccagacgatgggcggccaggcagagacgctcctcacttcccagacggggtggcggccgggcagaggctgcaatcttggcactttgggaggccaaggcaggcggctgggaggtgaaggttgtagcgagctgagatcacgccactgcactccagcctgggcaccattgagcactgagtgaaccagactccgtctgcaatcccggcacctcgggacgccgaggctggcggatcactcgcagttcggagctggagaccagcccggccaacacagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagagggagagggagagcgagagcgagagcgagagcgagagcgagagctgacatttttctttttaatcaacgggagagagtctatagttgccttatggcaccatagtgaaactggaacttttgacttctttttttttttttttctttaaatcttcatagaatgtgtctttacagcatgggaaatttttttttttttttttttttgcttttcactatatacagctaatggcttttacttattttcatttagatctaagaacacattttaacagttactgcttcctaatcttgctttatctgtattaaagaagcatttggaaatttataattgttcttgaccttggaggttggttttctcaaccttttttttcctgcaatatgyagtatctttagtaatttggtacacttatgatttctaaacaaaatatgtgtcttttgaacattgttgaaaagttagtgtatgaccccacaaagaatttggaacaggtgccagcccaattgtgactgcctgacttcttgtccttacactgggagttgttagcatgaaaaaacaaaatgtcatggcattttctctaaaataatactttgaaaagaatttttgtccctggtggtaaaaaacttggcacccagcaagcaagaggatcttgactcatagatgtataaaaacattgtcagtgcccctggagctacggaattcctctctcatagtaatttttctaatgtctgtagctcagttcattaatttttattttgctgccttggaatttgtccataaaagtatttttttttctatttatttttaacctgatcatcaagttccttggcttctatgggtgtacagtttgaatttttgttgttgttgttttattttgttttggggtgtttggctaggaagaactaactataggatgtttgtcagggacatgtkccttgggaaatttatctcactgctctgtgcttgtttgacagctgttcttgcacttctgactttaattcaaaaagttataaagccatatgtgagcagctgttcactgttttcattagggcaaaataagatcggatgcaaatattatcaggaatgatttaggttatattgtaaaaataatttagactatattgtaggaataattttacggtagttatgatatattgtaagttattaaaaagaaggttctagaattaaaaacaattttaagcataaagtactatttgttgaaagatgagaggtgttgaaagatgatatactgtctgaaggtaggatagtgaaacagctagcttttgaattcctcttctagttctaggattttatgatttcatggtagtgtttatccttctctacagactaacttttcccatgacttcctatgctttagaactcttctgtgtaataataagctttttttttttgagacagagtctcgctgtgtcacccaggctagagtgtagtggcatgctcttggctcactgcaacctcygcctcccaggttcaagcgagtctcctgcctcagcctcttgagtagctgggattactggcatgcaccaccacgcccagctaatttttttttttttttgtatttttagtagagatggggtttcaccatgttggccaggctttttaagctgattcatatttatttgtgaattattatcatagccatagaaagagttatcatttttttggctttcaggtactaaaatcaaaatgcaaaattggtttgcctttagtttaaagtgatcagaacaaaaaaaaatkaagataatttaatggcttatctttttcagtagtcctccagaatayaaactttataatcatctctcagacatttaaataaagtatctagtatttattaaatatttaccacatgccaggcaaagtacaattaatttaacatatgctctcctgtttaattctcacagtgatcctgagaccttagggtttattatccccatattatagaagaggaaaaagtttagagagttgaagtaaattacccaaagtcacatagtaagtactgggtctgagatttgaacccaagaccattttttttttttaccaagttctaaattttagaagatatttactatatcaaaaaagtatgaagttaaaaagaatcagaatgtaaaattgtgaatatgttaaaccatacatacacatgcacacatgtgtgtttgcatttggagaggctagaaggtcctacaccaaaatattaacaaggattacttttaggtattggcatacagataattcttacatccttctttataatttcttgtaggctatacttcttatatctgctattctcataatcaacaaggtgggaattgctgctatttttatattctaaaaacttgacatcttacatgtatgcaattttcaaatctgtcttcactgtcttatttgagaattataaagctgtttttcagtagcttttgtattaatttgtgtaaagacagatattttatatatttagagactctcttttaggatacttttcttatttctctttctagatttcagattttttggacattattgcactcatctttgtgcccctacagtctctaggacaaatcctgcacatagaagacatttcttaaaattgattgaatttatttcagtagtaaattttagccacagtacaatagttggaaagaataaacgaattacagttgtaataataaaggaaacttaggttaagaaaatttcctagatttgttaatcagtcatttctctaactttgtcacctagttctactaggtgaatgggtggttccctgacaacgttgggcacccatcaaggctttttttgtttagttttgtttttgtttttggctgaaccttttaactccccatctgcgtcatgcttttctttttttcttgaccacagcttctaggatcttagtctgcttccttgtcctcatgcttttatatatacatacaaacacaaacacacacacacacatgcacacagacacacacacgagtatgtcaaatgataaaagtaatgcagtttcactgtagaaaattttcgtaataccaaaaattattatggataatatagaaattgcttgtattcctatcactttaaaaataacaatttttgaaaatacatatatgtgtatgtggttttttttttttttctgagacggactttcactcttggcgttcaggctggagttcaatggcgcgatctcggctcagtgtaacctccgcctccctggttcaagtgattcccttgcctcagcctcccgagtagcggagttyccaggtgccggccactatgcctggctaatttttgtatttttagtagaggcggggtttcaccacgttggccaggctggtcttgaactcctgacctgtgtgtgtgttttaattgggattataatgtattaaaatctttatattctgcttttttattacataaattttcagaaaatataaaatatcttctaaaatttatttaatttctatatgattgtccattctttaagtattctataattcatttaatagttgtttgatgtttagcattgaggttgtttctaggttattttctgtcatacagagtgttgtgccatgaatctttgaagaagaaatctttttgtatttcctgaactgttttgggaggatagtctaggaagtaatattactaggtaaaatgtatgaacttctaaaatatgttgccaagtacatttaataaacattacgatttttttcttctaccagtgtgtgacagtgttgactcattgtctatcactggccttgagaagtccatattttactcttcgctaattttataagctgaaaacagcttttcactattttaatttggatgttttggctttgattagtagagagttgagctttttacccccatagtttgattttgcatttcttttttgtatcatccatttcctcttatattccatacttgtaacggtacctttcccaagctagttatttaagctttttttaaaaaaaaattttaatgatttttgaaatggactctttgagctttttttttttctttttttaccttttccctttttaagatttttattcttacctattaggaagacaacaaggtatatctaattacatgacaaacagtcttcaccaagaagccagaatcttaaatttatagctcactgttgccatctgagatataaatagaacttcagttactgtgtgttgctttccattaagtctacttccttgctcttcttaaaccccactactccttctttaatgatagcccttctacgaacacatggatcttaatagactataagaatcacttgattgatgtgtttcatttacattttagagaacttccataataaataaaagctctctcagtgtgtctcacagagagattatcccacaaagaaatgttcctctttgagcattttcttatatttcttcctgtcttcaaaataagtcagatcatttaatttattttaatcttttctgttaaatgccagtagtacaaagtctccatatagtcagcagtcctaaacagcccaggagaggggacctctataataatggaatgccagtaaccaaaacagcatggtacgggtaccaaaacagagatatagatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgagaaagaactctctccaccagttagtaatgaaatgcagaagtgaaactgagtatcctatacctataatatttccttctaactctttctttgccattgtcactaggagagttggcatgcaaaaacatcttgagagttgcacattttaataaattatttaccttttccacacaggccttgatagtcatataaattcagtcttgctcagagttgtccaatcttctggcttctcttgtccacattggaagaattatcgtctcgggccacacataaaatatactaacacgggctccgagcaagatggcagcctccgagccggttaggctacagcttcaatatgattacccactgccagctaccctgcactgtacggccttcctggcttctggttgacttgaacaggcgccgagttgtcacagatctcattagtctcatccgccagcgatttggcttccgttctgggggccctccgaggcctctacctggagcagggkttcctgccccccaccgagagcgcatgcctgatgagagacaatgactgcctcagagttaaattagaagagagaggagttgctgagaattctgtagtcatcagtaatggtgacagtactcatttatcacttagaaaagcaatgaagtgggcatttaagttagaggaggatgaagaaactaacccagattacaactattcaaagaagcattggaagaagcaagagtacaataacaataatgagaaggtcttggatctagaacgaaaagcggtcacagatcagactataagcaaaaaaaaaaaaaaagaaacaaaagaaaaaataaagcaacctgtggcacaacgggtgatgataacgaacagaccccccaaaaaaaatcaccaaagaaaaaggagaaatgtgaatatgaaaaaaaggccaggaatcccaagtcacctaaagtacaggcagtaaaagactgggccaattagagatgtagttctccaaaaggctctgctagaaacagccttgttaaaaccaaaaggaaaggtggtgtaagcgtttgctcaaacgagagtcccagttcctcctcggagtctgagtcttgtcatgaatcaatcatgatggtcccagcaaagtcactttggaggccagaaattcctcagagaaattaccaactaagtaatcaaaggaaggaccctctaccaaaagtacaactgcagacaaactggctacaaaatctggctttagccttaacccccagcaagggcaagacctctggaacatcatcttctagttcagattctggttcagagtcagaggtgaatgcttgatgtcatcgagcacccyggagtgtgctgtggatttctaaaagacagtaggcctttttgcaggaagaggttgtccaggccctgggctgtcatcacagactgcaggtgctactggatggaagcgttctgggttaaatggtggcagacaggctcctggtccttctcccagtgtgtctctccccagtttagaaagaggatggggtagaggagagaaccttttttcttggaagggagctaggggacggggaatgcgggggagaggtcgaggacaagggcatcctgtttcctgtgttgtaaatagaagcactgacaaccagagacaacagcaattaaataaagtggtaacaaattcatctactgttttccagaatccggtagagacacactagaaggactgtatggtctgttaccgctgttaacagctgcccctcaagttggagaaaagattgcatttaatctttggaactaacatccagttacactcttctgttgtctctgattacaaggaaaaatattaagccacaatccagagacacagcaagtagatacagaaattctttcatccttacctgccttgagagaacctgggaaatttgatttggtttatcacattgaaaatggaaccgaggtagtggagtatgctgtgatgcaggagagcaagatcactgtattttggggagagttgattgatccaagactgattattgaatctccgattaacacatcaagtacagaacctgtctgaatatgaccgctccatcttatagtttatgaatgtcttgtttgtgaaagtgactataacttgaacttttttttttaagaggatttgaaagttgtatgggtttttttgttatcttcactttactgcataggaaacaatmtacctcatcatttaaaatgacatgggtgtcggttttgtagacctttggtttttttgtcaggttcaatttcagttaacaaaatgtaaaacatgacattccctgcaaacgttgttgtataccaataygtatggtttcttctcttttttaaaagtttttgaccatcaagcagcagttgtcagtaggagtttataataccaagaatgtgctgcatatcttgtctcattaagttttaagtaacatttaaaamtattaaagcatgttacttgacctaattttatagcatttgagttgtcccattaaatggagcatctcrtaaatttcaagtattttatacttggcaatggttaagagttaaaaggtagttggatttgtcacagacaatgagttaaggaatcctttcacgtttttcccaactttaaaattaaggattctcagggccctgtgtagagcagtaaaaataagacctcgtgtatgtgtrkgtgtgtgtgtgtgtgtgtgtgtatgtgtgtctgtctgtctgtctggaggagaattgattggtgttccacttgggtgagagggttggctgtgagcctcagaccaggaaatgtgtcatcttgccaagcacctggctgagtgtgctggagtgaggatttgaacagaaacttccttttctgttattattcactacaaagcttaagtggccaaatatatactgtgaaaattggtttcttttaacaaaagatcagatccctccttcagctgtacacatttttaaataaaatcatatagaactaaaaaaaaatactaacacgaacgataggtgatgagctaaaaaaaattgcaaaaaaatctcataatattttaacagactttaccaatttgtgttggactgaaggttggccaagcttggtttagcttaagttatatggattatttgtacaacagaattgagttgatttctgcggtattttgaagagtgaaagtggttttttaaatttgtactgtacttatgttataaagcaatatgagtaatatactttatgtgtgagaccttacgtgctctaagaaatacttttgttaaggatttatatttatggtggagtattcgttacaacatggggtctatacatacttgtaaagaaattaaggatagagaatgcatcactcagaccccaatctttccattcatatagattgattagtcatcacatagtccatatttttctactatattcaagtcccagttgacaccttatgcatcatattccttagttcccaaacatgttcccttatttcttttcatgtaacttttaattactcatttgtccgagtctgaatcctgaatattaccctwgataccattttgtttcaccacccctctccaaatgtagctttaagtttttcctgtttctttttctactcccagaacccacaattatagctctgaagtatccttccagtgagttttcagtatctgcatgtgtttactctagctcaaggtgtgtttttttttctgatatttatgtcattaattgatctctctgatgaatcttgtcagagaaatcttccagaaggacatttcagaccatattgctttctagattaaaaaacttcaaagacttccaagaatgtacaaagaattctcttgaattccttcctctggtcttcagggccctatgctatgacttcaacttttctttatttccctccctcaaatattttttctcttttcctttttatacttctttccttctgagctttctgtcactttttggcctgtacctagccatttccctgttcttgcatttccaaatctcatctatccttcgagagttggcttttacgtttgtcttccagctagaagtagtcttttcttcctgggaactcccaatggccttttcagtttgttattgtacttagtatcctttctgttgaactgtggttgttcatggttactggttgttatagttagttctttaacgcatggattcctgtctcattattctatttcttgtgtacgttttctggtacacgtatattcttaagacatataaagagctgtcttgttctgggggtatttcttagttgagaaaaataaaaccttggggatactttatatgctaaagataaaaatgattgtgtgttctataaagatctacaaaaatatgcttggaagtagttttgctaaaaaacaggtataagaaattagatatatagatgagaccttggatgacttgactcaaaccactttcagacagatgaaacgtaacttctaaatctttctagaaggttagattttacgatatgctcaatcatttaaacagttatttatatgagacttacaagcagaattttttttttttttagtatttttacaatatgcagttcacattttatgtactcctaatttacttcttgttattcttggaattttttaaaggattttcctgattcttaaatggttctattcttttttgcagttcttctgttaatgayatgttttttatttttttttagttctctgtttgtcctggcaaaacttatatttggaaaatgttctatttttcaggtatcctggtcagatataggaggactggaaagtatcaaactgaagttgsaacaggctgtggaatggcccttaaaacatccagagtctttcattcgaatgggtattcagccacctaaaggagttcttctctatgggccacctgggtgctmtaaaacaatgatagcaaaggctttggccaatgagagtggactgaattttctagctataaaggtaggrtgttaaattttttaatcgctactctctcttggcctcccccaacccccattctctgactcctacctttaggagaacgaataaaggcatcttaaggagcagtgattcttttttttttatttgatgttgatggcaatataatatagggagatgagtgataagaaataaattcgtgcatgtaatcagcaaatcatggtagacattgggaagactgctttatttagtttcttgattctggtatttcttatatccatgtgtaacagaagctaatctttttttttgtttgtttctacatttttaattatagacttttgcttaaccaggacttaaagataaacatgacagtgaattcaatatttacatacctagaattttcaaatgaacaagacacttgttatggtacactaaattctttaaaaatacttttccattcagaaagtatatgtgcattgtttttattctgaaccacacacacattttatttgttcattgcttcgccccgattaactgggatagataatctttcatgatatgtagttgtacacttactttaggaccagatattaattttatgtaacattatgatatatccagatacttaatccacacatataaaactgtaaatccatttctgtggactgtatcacaaaaatatatacctaaatagattaactatcaattcatttcagaaaaggcacatgatcatctgttttgatattaccagggaattttttacataacagaatgcattttctttagcgtgatcttggctcactgcaagctccgcctcccaggttcatgccattctcctgcctcagcctcccgartagctgggactacaggtgcctggcaaattttttgtatttttagtagagacaggtttcactgtggtcttgatctcctgacctcatgatccgcctgcctcggcctcccaaagtgctgggattacaggcgtgagcgactgcgtcyggcccagaatgcattttctgtcttagaacattgaaatcattggcagtttgaaagcacaaaacttcagagtagtttgtcaacttttggctttacttaagatttttatagaatgatacttaggtgtgattaagctgtttgttctttaagaatcagtatcttcaacatattttttattttctggaagatattggagagtaaagatgggggaggagaccatttacagcatgatcacttatggggaatcacaactacagttttaaaggtttcaggtttatttgttatttttttgagacatggtctcactctgtggcctaggctgaagtatagtggtgtgattatagctcactgtaacctcaaattcctgggctcaagctattcttctgcctcagcctcctgagcagctaggactacaggtgtgagccatcacaccagctaactttttaacatttttgtagagacaggktctcactgtgttgcccaggctggtctcaaactcctggcctcaagcagccctcccaccttaccctcccaaagtgctgggattataggagtgagctgctgcaacacagcaaaggttgcggttttaagggttgaagtaatgagtgattttgtcacttcccaggacaacttgatttctccttggtccttgtccttttatcatgtggtaatggggatggctgtgtttactggcattttctagtctttttactctcatctccattttttctgttcttaccttgtatattctacaattgtatattcatagtattagaatttttcttgtctactggaaatctaaaatttatttaagaacctgtgagcgaagtcctcatcagataagttttcgacttaactcttaagagcacacttattttcttacaaactagtatcttactttttctgtgatccaaggtaataattttagatactactaagactgctttctggactatcctagaattacttagaaatatatttattatcttttttgaacataaacatttcataaccttagacaatttcatttttagtctttttttcactatgaggaaattgtaaatgattctttgaaaggtttaactttgtacactgctatataaaataaccaggcacacattcatttatttgagctttttcattagatttttaggtcacagacagaaaagccacatgatgttaacaaattatcttcatcaattgagttcataactcagagattattacatgtcctagttactaattttgatttagtgtggatttttattcagtttagaatttagtgtggttcgacagtattattcaatttttgaatctgtatggaggatatacttaatgaatgatgggtttttatttttcaaattgaatatcccttatcaaaatgctttggacctgaagtgtttagattttgaatttttttgcattttgaaatatttgcattatacttcccagttgagcatccctaatctgaaaatttggaatctaaaatgctaaagtgggcattttctttgagtgtcatgttggagctcaaaacgttttgaattttggagcattttggatttttagatttagggatactcaacatgtactattcgttcaactctcctataggtttaaaatttttttaaatacaaagttgggaatatgaaaataatttgyyttctactagcattttcattggtccttttattttcatctattcagtgtttgtgaggaaagttttaaagtaacaataccatacagcttatgtatgagaaaatggagccaaagaagttgggaattcatactctgttctytttttttttgagacagagtcttgttctatcgcccaggctggagtgcagtggcacgatctcagctcaccgcagttcccacctcccaggttcaagagattcttgtgcctcagcctcccgagtagctgggataacaggcaagcaccccaacgcccagctaattttttgtatttttagtagagacagggtttcaccatgttgcccaggctggtctcgaactcctgagctcaggcaatttgcccgcctcaccctcccaaagtgctaggattacaggcgtgagtcactgcacctggtcctgttctgtttaattttaacttcctgtttaaaaaacttggcaacttttgttcaacccaaatgtttggtttcaacctatatatttgttttctacaagctttaagtgttaaaagttagtttgaaattttgaaataacaaatcttacacattttgaaagtgatcagaaaaagtagacatacactagaattctctagccagttaggaaacacaagtattttaaacagattgaaaggaaaaactccctatcacttttcacaatggtagttastacttttaatcttcaagatattttgatagacttacacttcttcctctaagtttatgaaagaaccttttagcttcctctatgcatcttttctgaacagggattaaaagatacrtactgtactcagggtggagacttcagcttggcttgtgtgagctcttaatgccctctggcatatatatgtgtttttgtgtagattgtgacatttgacatactgtgtaagtttagtttgttatctgggmcagttacgtaaaatactttccagttgaaatttcctttctgcttctctcttgcttttgtctggagtgctacaatagattaattgccctgggatagctgcattgctttactatatgaagaactgtcactaattctgcaagaaatgtggttaggtctttgacagggattttcagcaaataattattctggtaaatacaggaatgtaatgagcttagtatatccttgactttttgggaaattttcttctctatacttgtctcagagaggaattgtataaaatagatttcatttccagaaaaacctgtggtttattcaaagtagtgcacaattcagagtacaggtgctccccaatttaagatggatttacttaagttttcgactttacaatggtgtgaaagtgatatgcactctgtggaaattatacttcgaattttaatccttttttttttcctctgagacgaagtctcactctgtcgcccaggctggaatgcagtggcgcgatctcggctcactgcaacctctgcctcccgggttcaagcaattctctgcctcagcctcccaagtatctggggttacaggctcccaagtatctggggttacaggcatccacgactatgcccgactaatttttgtatttttagtagagacggggtttcaccatgtaggccaggctggtgtcggactcccgaccttgtgatccacccgccttggcctcccaaagtgctgggattacaggtataagccaccacgccaggcccaaattttaatcttttactgagctagtgatatgcagtacagtactccctcatgatgcctggcagtaacagtgagccacagctccyggtcagccattgtgatcatgagtgtacacagccaacattctagaatgtactgtgttgccacgtcactttttccaactgtaggccagtgtaagcattctgagcatgtttaaggtgggctgatctaaaatatgatgttcagtaggttaggagtattcaatgctttatgacttaggatattttcaatttttgatgagtttatcaggacataacccccttgtaaatcaaggagcatctgtaattactatttgtcatttaactagatatattaatattctcttatcaaaggtacaagataatctgaaatttaaaaattccaaattcatctttaggcttctgttttttaatttttgcatgggaagctgcatagctcttttaattacagaatgctttaagattacaaataaggataatgattttaagaaggttaagtgacttttcgaaggtctaagtggtagtgatggcactgaaatttagtctcagaactttctgactcaagagtctgagctcttaaccactgtattatrtatatgctcttccatttccctttttgttttttttaaaaaaatagaactagtgtccaatggcttttttcattaattacacaaagttaccagggaagatagtttaagtagtttctgtagggtaggtttagagaagtggaaagatgtttctgggaactggtttgaaaaataattttgtttctctaggacaaagaaaacagaaaaataacatggctttggtctaggagtaaaagttaataggaaagggcaatcacagccaaagatacaggaaactgttcaatgaaatagaagtgcctggaaaaagactgatggtgggataatggggagcttaaaatttacctgttagtatataatttgtgcccttgatattgagtatgtcacgatgaaaagaacactaagctgggattcacattgcttggatttacttcctaaccttagcactttttagwtttgcagccttaagcaagttctgtaagtctcatttttttcatccagaaaagtataacatttgtacattataagctttggggagcattatgcttaaaaaggcaaatgaaaaagtttttggggggcataactccccactccttgagtgtgggcttctttccaaagaatttaatatcaaaagaggggaggggaagagctactgtacaatggtgaaacctgacaagccgtgccacagccagatgatcaaggttaacatcttcagtgataagtcatgttgacagtacagttgatgctttgaacaacacatttttttaatacatttttttttcagtatagttgcccttccttattgtaggttccacaaccaaacacagattgaaaatataatatttgtggtatatggaaactcccaaataaggagggctaactatgtgtcctcagattccacaggctgactacaggacttgagtatgtgtgcattttggtattcacagtggtcctggaaccagttcccgtagataactgataaatgactatatatacccttggataatgtggtkawaatagcactttacttctgttgtcttcctcctgagtgctcataacccctctccaaccatgagaaaaattttaggcaaacccacgttaaaagacattctgtaaaatcactgactagtactcctcaaaactgtgaaggttatcaaaaacaaggaaagtttgagaaactgtcaccaccaagacagtacccaagraagcatgatagctaaatgtaatgttacaatatcctgtgtaggatgctggaatgaaaaaaaaaaaaaaaggacattagggaaaaattaaggaaatctgaataactatggtctttagtttaataataatatctcaatctgggttcactgattgtaacaaatataccatgctaatatgagatagtaataataagggcaacagtgtacatgggtgggtgggcatatgcgagctgtttgtactatctgctcaattcttctgtaaatcttaaactttgctaaaaaataaaatatatttaaataaattttgaggtcagtataatagatctgggcatattgtagatgaagtaattgaagtttaaaaggctaactctgagttctgtactgcagtgaacaggatgcatggagtaaggcaaagaagagtcatgaagaagattgtggatttcatgggtgagggctttgatgacctctcctattcatagtccccctgcccataatgatagtggaaagttactgggaaaagccctgagaggaacttggctggggaacctgggtttggggctgccctgaacttgcctgtttcactgcacttctcagttgaagcctataaaggtgtgtgttagttctggccccaaacccagaccccaacactataaagaactctttctcttagtgttttggttattttttctttcaccttgggtgcagcttccagtttagtctcaccaggaactatgtcatttcatgccttttgtggatcctaagtctgtattctccttctataggtttattactgtttgggctcatctagagtctgaaaccttttgagtttctatttaatttcctttagagttttgtttttttttaactttaaaaattcccttgacttcagcaaatagtgttgtattatgtgccttatttgcttaaatcggcagttattaacatcaatattaaacaaagacatatacttagttttatccctgtttgaatgactattagggaataactaatagtaacctgttattcttgggacaagtggaatagttattgtgccattgtcagttttacaaggttatgaagaagttagatcagatttacttacatttgtcattatttgtacagtatactatgttaaagttgtggcatcatatgttaagactatatatatgttattttttttgagttgggcttttatcagttgataaagctgatatataaaaaaaagtcttgatgtgaaaatattccataaataacatttatctaaaagcagaaaatgacaataagaactataacaaaacctttagcatttggaatctaagaagacctagagagatttagaaaaagaaggataattttataaggaattttataagaaaaaggataattttaaacttataagaagtttaaaaataagcacattttattgttgggtttaattttttattcatggataaattagctgatgtagagaractagttttttctttctatctcaattcctttttgaatgaaatttagaggtgaaataaatattacaatgtcatgtctgtaatacttttaaaaatatttgtaaaagtttwacaattggaatagcaaaaataacaccttctgtgtgtcaggcactgtgcatagtaaacaaagatatattagatgggctcctcgttatgtatcaactcattatttagtgggagagatatttgactcaacaactaacatgaagaaacagttaacagaatctgcagctcttggttgttgattgtatgtgagaaatgagaaagaaaagcagtcaaaggtgataaaaatttttactgtcaatgactggcagatggaagtatcctaactccagggagaaaaggagaaacaggttggaggtgagagagaaaataccagtgttgagtttgaaaagcctttgggacaaaatgttgaatatgtcctaaaggcagttgtatatatggatttgtagctcaagaggatgattatttcgagagatgaaaatatggaaattgagatgaaaatgtggaaattggaaatcagtgtttgagattctgcagacaagtcagcaaaggagactgagagtgacaaaagtagtcattaatagcagaaggggatttcatgggcatgtaaatatgtgtaaatacacattttacaacttgcctaattgtagccagcatggtccctgcaatgtaagttctgaagaaatgtgtcatttttctttttcctgaatagaatgaatgaatttggggaaggattgtattatactttwtgagaggaacagctcgaattctgttctcttccctgccagcccctcttgcatttcagggtttttacttgcccacagcattcttgcctagtaattaaaacctattttcaaactctttgaagtgctttcccagaatggccttctgtatgtgctgatactgtactttttattaattttcaagttcctttactcacattacatatatgtaattctatcttatgtgagtttggatttttatgagcatattccataacatttaaccatagttaacacttaggttaacgtgccttccccagacactttagaacttataaaaacttcatttgaattgtaataactaaaagcaccaggcaggtgtcagacacatttaaaaagcccttgggaggactgaaaaaaacccagtagtgattaaaggggcaaaattgtaagaacatgaggtgtaaatgttatactcgagtttgtgactgatrtgatgtaaaataatgaagcacagtaaaaagataagtcaggtttacttctcactagattaatagaacagctggacaaatattttcacatgtgtttatgatatttttgttattttgtaaacttggatacttgaaatattggccatggaatgttaaaartaatgctattaaaaataactcaattaatggtacttattaatggcagtttttcttgatcattcttatcagtaaagcacatgctatctaggaggtaaaatatgtggcaagactaacatacattcttaaaagtaacataacttatgagcaaataygggactgagactatactatatatacctaaactctgtagttagatataaatggtctcttgtttataacgggtactaataaaattcttattttcaaattagcctatgctactatctattaagaaagaattatacttcacctttgccactcgatctgctcaccagaaatacatttgaatttgaattgctggtactgtgtaaaatcttgttttaaatttaaaaaattatttttagcagccagctttgtctagccccaaattaactttcatctaaaatcttaacgggacatttcatttctcttttaaggacttagaacaggacatcataattcttagaaagagtgctggtttggaaaccacaattctgcattcttatcatttctgccatttaactagctctaggacttttggcatattactcagcctctttgtactttgcctcagttttaggtgagtaggttagactaagtgactcctaaagcccttctgctaataacattctatgagtaggtcacagtacttgtactttaatctgttgcatatcttttgtgccaatggtggccaaatatttggggcagtttctctaactgtcaagtgtaatagttaaaagacttgtatcccagttctgccatttgctaagctgtgtgactttggacaaattacttcacctctttgcacttaatatttttttctgtaaaattgtagtaacagtgtacaactcagaagactgttgcaagcagtaaaagggataagacatagtaagcatatagaaagattccacaaaattagtacatgctgattgctgctctcttccatttttaagaaattgatgtatgtttgacctcaaatggagcaaaaatatgacatcacagcttatgattccttaagttttctgttagtagtaaagtgtaatatttatctttgaaactgaatatagacttttaaactctttgtaccaaaatacagtgatttttggcaacttaaacttcaagcttaaaataacctcccttggtaatgaaattgctgtgacttctcataaaactcgagaccaaygcaacatacgagttcagctacttgggttgcattttgcaggccatctaggtaagattcatcagtacatagtcctgtacaaagtcatattttctagggaccctgcagtcttttcattatgccttattagtaacacttgacttgaattattccaatgcgtattttcttcacagtgccagattttcaagttagagtttcaaatgtcttaattttttttctttctgttttgttttgttttggaggaagaagcattgtttcattcttatccacaggtcctgtagtccacctttctgtggcagtggagtgacccttcaattggttgaggctttatactatattttcacattttcaaacaaagtatcaagaatgtttacctgtatgttggatatttattaataaaccatattaatctttctattgataccaagatattgacattgtacttagcagagaaaaaaatcatgaaatgaccataatcttgtactttctaacattaatgcctaggttatcttcatcatctacagagaacaatgaccatttttccaggttctctaatctctttccttcagttaagccagataattaaaaagcagtatatatacattcagttacattgcctgaataaagaaatctcttcactggattattattttatgccatatccttggcttttgcagacaattgctgtaagaacaacagcaataatgtagagttggcatgatggtaattgcaataaaaacagtgaccccagcaatttcctttctgattattgtcaggccacagtttgcctaggtagttgctctaaactgaataaaatctgcatacaaatttcttaccacccctaacccctcaacaaaaacacactctgctgtttatctaaagcttgttttattgggtgggccctgatccttgttttagtgttcactttcttaattccttgtccacagtcccccttgtgtaaaacttaatttaccacatgtaaatgaaaagtactagttttgtttatttgactttatattatgttatgaataggcatttcttgctttgtactacaatcgtttttacagccctatactacaggcatttcttgctttgcagtctagtacaaagcaagtatagggctgtagtatagggctgtaaaaatgattgtgcaaggtgaaattatgcagaatgatcttaatcagtgggaaaaattacaagtgttacataacttttaaacattttgtcaaaacattaagaacgttcattcttggttataaatgttgaggcagtgcattttggctgtataacagatcccttgctagtttccctacctcttaacttatttctttgactagcccttcattcacacactgacagcctagtactccattttatgaggacacaacaatttatttactcatttttatgttaatgaatttttaagacrcttccaccttttatttttattgttgttataaacagtgctcagtaatattcttattcattttcttttgtatattggtaagagtttctgtagggtatacgtatctagaagaagttgttattgttattggacatgtacgcttcaacattactagatagtttgaaattgctttttttgtgtgtcattaattttttttgcttaatttgtatcaatcaattttttaaatattttgaagattgttcactccttagcaattatgtcattgacatttttgatgacttttgatcttatagacaaaagtgaactctttcaaattatatgagattaatctacatcagaggtcatagtctttagacataatctggcctgcagtgtattttggtccagctccctagctaagaatgaatttttcatttttaaagggatattaacaagaagaatatgtgacaaagactttatgtggcatatacagcccaaaatatttactctctggctctttatatttcgtctttttagatcccacaatacgtggaaaactgccttcaagtttatttacctcagtgacggctgtgggtgtaaacattgtgtcgctgttacatagtctaacctgtatctaaaaataagcttgtaaaattgatttggtattgtttctttttcttcaaaatccttagaagtatgagaacattttgcctcagcataattaatgtttcattgtttgtctttttttaagttaaatctgtttggtagttgcattatttaaaaaattgagatatggaagtattggtgattaaattgtaattatgaagtcactctgtagtatcttaagcttaacaataattttattgtggaaacatgattgcttacagtttaagtaccaatgtacaaataattgatatactaattataaataattactcatccaaaacactgtgccaagcaaatccttgtttacttatggatacataatcactttgtctatttgtgtattctgtggtttgtagatttcagtcagtgatgtaatgatattatctgtcttaaatgaaagataatatttttaattattactcttcttttttataattttttatttattattattattatttttgagacggagtcttgctctgtcacccaggctggagtgcagtggtgcaatctcagctcactgcaagctccacctcccgggttcacgccattcttctgcctcagcttcccaagtagctgggattacaggtgcccgccaccacgcccagctaattttttttttttttttttttttgtatttttagtagagacggsgtttcaccgtgttagccaggatagtctcgatctcctgacctcatgatccacccacctcggcctcccaaagtgctgggattacaggcgtgagccaccgcgcccggcctatgattattcttttcatgtatctgtctcctaattagcctcaaatattgatttttagactatgtataatctattactctgaaacagttttttggggtttttttgtttgtttgtttttgttgtttttttgagayggagtttcgctcttgttgtctaggctggagtgcaatggcgtgatctcggctcacagcaactgctgcctcccaggttcaagcgattctcctgcctgagtctcccaagcttggattacaggcatgtgctactactcccagctaattttgtatttttagtagagatgtggtttctccatgttggtcaggctggtcttgaactcctgaccttaggtgatccgcccacctcagcctcccaaagtgctgggattacaggcgtgwtccactgcatctggcctgaaacagtttttcaaaaagattaatcatcttgggttaatagaaaaaaatcaggcagaaagataaaactacttctgtcattacttaaggattcctgtgtttatgctattaggtatctccctcatcttaattgaatatgatgcaaggcagtgtccttggtggaagctggattctgtcagtctgaactttgagatgttcttcctatccctttcttatttttgctcttaacttttctaccctgattctcatatcttctaacctactcrtctrttaccatattatcatatttcaatatttttgaagcagcattgtgaaggtaattgtcttatttcaggctgctataacaaaataccatagactgggtggtttaaacaacagaaatctatttctcacaatcctggaggctgggaagtccaagatcaaagtgctggcagatgtggtgtcttcttagggtttgctgcttggctttcatgtggtcatcttgacatagcctcacatagtggaaagcagagagagagagagagatatcaagctctcctgtctcttcttataaggacactaatctcattcatgagggctccaccctcatgaactaattacttcccaagggccctgtcttctaatatcacattgtggattaggatttcagcatatgaatttgggagggacaaatttggtccatagcagcaccatacaaaaacagtattaaaggtggtctcgttttcatcaggcatgtttccaacttgaaagatttgttaatgtccataatttttgtctgtttgccatttctgttcttttcccttttctcctcttttcttttgcattcagtgcattttgatattgtatattatctcctctattatcttaatagctaagcctctttattttacttaaaaaaatacttgctcaagcatctatactatacatacttacattctgtcttcaaataacactgcaccactttatttatagtttaagttcttacatcaatatacttttgttttcttgtgctgtattctgtattttacctctaaatacacaataaactttatattgtagagttaaaacttttagtcagttacctcttaaagaaattaattgaaaaaagagctattctatatttattcatatatttgccgtttctaaccctcttcatttctttgtatagatctaggtttccatttgatataaattcccatcaagctttagaaattgttttaatatttcttgtagtggagatctactagtgacatatcctctcagcttctgtttgtctgataatatcttgtcctcacctttcatttttaaggatatgccattctagcttgacaggttttttcttgcagcacttgtcctccattgtcacttggcttgaattgtttctgataagaagtcagcagtagttctttgcttacagatatataatgtgttcttatattctcatttctcttaagactttctctttcttatcagtttttagtaatttgataatgatgcatcttgatgtagtttccttacttggatttcactgagcttttttggatctagttaatatttttaaaaatcaaatttgcctatgtttttgtcatcttcttccacttttttttcctgacttttcaattgtatatatgaggggacttcaaaaagttcatggaaaaatggaattaaaagataaaaaatataaactttatttctcaacataaggtccatcaagttcaagatacttttgtaagtgatgataccagtcatttagtctatccctaaagaactgagtgtcctgggaaattaatcatatcagtgttatattttttacattagtaattgaataaaaatgggtgccctttaaaaatttttaaagattaagaaacaaaaagaagtcagaagttgctaaatcaggattgtaagataaatgcctaatgatgtcccattgaaattcctgcaaaattgcccttgtttgatgagacaaataagcataaactttgtggtaaaggaggactctggtgaagctttcctgggcatttttgtgctaaagcttttgctcactttctcaaaacacttgcagtcagcagatattattattctttggaaagtcaacaggcaaaatatcttgagcattcagaaaaactgttgccatgacctttgctcttgaccagtccatgtttgctttgactggactacttctatctcttggtagccattgctttgattgtgctttgtcttcaagatcygtagagctgtgtttcatttcctgttacarttctttgaagcagtacgtcaaaatcttgatcccacttgtttacagttttgattgaaagctctgcccttgtatgcagctgatctgggcataaggattttggccctaatcatgtggaaagtttgcacaactttaatttttcagtcagaattgtttaacctgaaccaattgcrgtggctctggtggtgggtattgtttgtgctgttaatcatttatcttcttcaattagggaacaaacaagatgagttttttccttgcaaactgatgtggaaggtcagctgctggggkcttcatcttcaacatagtcttgttctttcagttatccatttgtaaactgctatctcattagggcattgtctcatgaacttttcataaagcatcaatagttttaccatttttctatccaagcttcaccataaatttgctkcttcttgcttcaattttaacaaaattcatgtggctctgacaaactgttttcaaactggtatcttacccttagtgcctcaaactggactctgttcagacatgttttaacaagttagtatgaatttattttggtgcaaaaataactgaaatccatgcataatttttaaaataatacatcttttacrtgaactttttgaagacccctcatatattaaacctcttaatattgttgttattaagggacctgtgtctctgaggatgtcatktttttttttgtcaatcttttttgtttctatgcttactttgaatggttgttctgtctccaaatttactgatttttttcttcagcttgtaagcttatttagtgcactttaaaatttccaatattatatcttttagctgtagaagcttcatttggttctttttatgttttctatcttttcctcataattttaatgttttccttaaaattcttttttgtcttcttctttttttaaaaatttcttttggccaggtcaataactgcatagtgttttcctgaaaatttttgaaaatatttacgatacctgtttttaagatcttgtttgccaattttatcacttcttttatttctatatctatttgtattgaactttttttctccaatrtttttatatttggatcaagtttttgtttatttctttaagatctctaaactttacagaaaatttgcaagaacagtcacaaacatttttttcttcaaccatttgaatttagttgctgccatatgccccatcacagctgaatacttcagtgcgtatttctacaaaaagcaaattctcttacataaccacagtgtaaccataaaattagaaatgagcattattattgtcactcaagttttgtcaggggtcccaataatttcctttatgacaaaataagttagtccagaatcatgtgttgcatttatttgtcacatccgtgaagatttcttcagttggtnnnnnnnnnnnnnnnnnnnnacatccgtgaagattcttcagttggtaacagtttcttcagtcttctttactttagtgaccttgacatttttgtagattgcagggtagttattgtgaacaaacatctctaaattgagatttgcatgacattccctcatgattagagttaggttattcttagaaaggatgctgcattcttctcattgcattctatcaggtgatacttgattttaacttgtcgtatttctagtgatgttaactttgattatggtggtgtcagccaggcttcttcattgtaaaattactctttttcctgttaagttaatattttgtgggaagttattttgggactatataaatatcctgttttggccgggcgaggtggttcatgcctgtaatcccagcactttgcggggctgagatgggtgggtgacctgaggtcaggagtttgagaccagcctggccaacatagtggaaccccgtctctactaaaaatacaaaaattagccaggcgtggtgacatatacctgtaatcccagctacctcaggaagctgaggcaggaggatcacttgaacctgggaagcagaggttgtagtgagtggagatygcaccactgccctccagcgtgggtgatagagtgagactccatctcaaaaaaaaaaaagaaagaaagaaaaagaaataaataccctatttcttaagagatttttaaatttatttcgtttttatgggatcataaattcctttctattcagtggtttatgatttctcagtatcactatttgtaytgatgtctcagttgcaccagtttggctagcaggccctcttttaagctgtcttttgtgtgctcttggcattaattaatcgcagatggaaagtcagttgtaactctgtgcagctttgacattttacatagctgagttaataaagtgcttagaacagttcatggcacatagtcaaggttcaatatatgttagtacttatgattgcaattatacattttttattttaatcattttggagtacagtatttttaatgagctacgyatttatttttgtattttttattggtgtatcatagttgtacatattttgcaggcacatgtgatattttgatgtgtatacaatatgtactgatcaaattgggataattggagtcttcatcacctcaaacattgawcttttcttggtttcgggaacattacaattctcctcttttagttatcttgaaatatgcagtaaattgttgttaactatgatgtctctactgtactactgaatactggtacttactccttctaactgtggttttgtacccattagccaattttttttcatctccctcctcctctcttccctcctcaggctctggtaaccaccattctacgctttaccaccatgagatccacatttttagcttgcacatatgagtgagaacataaagtatttgtcttttctgtgcctagcttattgcacttaacataatgacctctcattttatctgcgttgctgcagatgacaggatctcatttttttaatggctaaataataattgatgaacacttaggttgactccataccctggctgttgtaaatagtgctacaatagacataggagtgcagatatctcttggaaagactgctttcctttyttttggtagtaaacccagtagtggaattgctagatcatatggtagttctgtttttagttttttgaggaacctccccactgctttccgtaaatggctatactaatttacattcccatcgacagtgtacacatgatttcctttctctgcatcttctccagcatttcttatttttgtctttttgataataaccattctaacttgcataagataagagatcattgtggtcttgatttgcatttccatgatgattatgatgtcgaaattttttcatatagttattggccatctttcttttgcgcattttttttattggattatttatatttgctactgagttgtttgaattccttttgttattctggttattatttctttgctgaataggtaatttgctaatattttctctcattctgtagattgtctcttcactttcttaattgtttcctttgctgtgcagacactgttgaggtaatttgtctttttttttgcctttgttacctgtacttttgaggtcttgcccagaccactgttgtatagcatttcctcagtgatttccccaagttttcttctagtagtttcatagattcaggtcttatgtttaagtgctttttttttttttycttttgagacagggtctcactctgtcacccaggctggagtgcagtggtgtgatcttagcttacttcagccttgaactccagggttcaagcaatcttcctttcttagcctcctgagcagctaggaatacaggtgtgaaccactacacctatttttttaaattattattattgtagaggtggggtcttgatatgttgcgcaggctcaaacttctggcctcaagtgatcctcccacctctgcttcctgagttgctgggattacaggagtgagtcatgtgcctagccacatttaagcctttaatacattttgaattgatttttgtttgtggtgaaaaatgtggatttagtttcatccttctgcatatggatatttactttttccagtatcatttattagagactgttctttccccagtgtgtgttcttgatgcccttgtcgaaaatgagttgactgtaatgaatgtggatttatttctgggttctctcttttgtttcattggtctgtgtgcctgtttttatgccagtaccatgctgttttattactgtagctttgtagtataatttaaaataactttgttttatgcttccagcttcrttcttttagctcaggattgctttatctactcagggtcttgtgtggatccatatgaaatttaggattgctttttctatttctaccaaagaatgcccttggtattttgatagggattgagttaaatctgtagattgctttgggtagtgtagacattttaacaatacttattctaattcatgagcrtgggatatctgttcattttttatgtgtgtcctctttagttgttttcatcaatgttttatatagttttccttgtagagatctttgacttctttggtcaaagaaaatttattcctaggtttttgtttgtttgttttgaagttattgtaagtggaattgctttcttgagttctttttcaaattaattgctattggtgtatagaagtgctactgatttttgtatgttgattgtgtatctgggaatttactgagttcattagttctaagagtcttttggtggagtctttaggtttttctacatatgagattatgtcatctgcaaacaagcacaatttgacttcttccttttcaattcgaatgccctttatttctttctctttcctaattttggccaaaacttgcagtattatgttgaatagaagtggtgaaagtggacatctttgctttgtttcagatcttggtgtaaaggctttccatttttccctgttccatatgatagtagctatgggcttgtcatatatgccctttatcagattgaagtatgttccttcaataccctgtttattgaaggtttttatcatgaagggatgttgaattttacccagttttttcagcatctgttgaaatgatcctatggtttttgtccttgattctgttaatgcagtgttcaatgtttattgattcgcatatgttggttcatccttgcatccctgggatgaatcccacttgattgtggtgaatgatctttttaatgtattattgagtttggtttgctagtattttttgaagatttttaaatctgtgtttatcggggatattgatagttttttttatttgttttgtctttggttttgctgtcatggtaatgctgccttcattgaataaatttgaatgtattctcccttcattttttttgaaatattaataattagcagaatttatgttaattctttaaatgtttggtagaattcagcagagaagacatcaaatcctgtgcttttctttgatgggagactttttattgcttcaatcttcttgttattgcttttctgtttttttcatggttaagtcttggtaagttgtgtccaggaatttattcaattcttttagattttcccatttgttggagtatagttgttcataatagtttctaatgatcctttgtatttctgtagtatcagttgtaattttttctttctcttctctgattttatttatttaggtgttcttttttttaggtagtctagccaaagctttgttgattttatggtttcaaaaatcagcttttcatttgttgatcttttatttttttagtctgaatttcatttatttctgctctttattatttgttttcttgtagtaattttgggtttggtttgttcttgcttttctagttccttgaagtacattattagattgtttctttgaagtcttcatatttctttgatttgggtgtttaaggctttaaacttccctcttagtactgcttttgtgtatctgtagattctagtattttgtgatttatttcactggtttcaagaaattttaaaattttctttttttttggtggactcattgggcattcagaaatatgaactgtacagaaactgtacagtttccaaagttgttcttgttactgatttctagtttttgttgtggtggttgtggtcaaaaaagatgcttgatatgattttgactgttttgaatttgttgagatttattttgtggttaatgtatggtctatcctggataatgtgccatgtgctgataacaagaatgtgtatattctgcagcagttagatgaaatgttccgtaaatgtctgttaggtccacttggtgtatagtttaactccaatgtttgtttgttgattttttgcctgaactgtttgttgctcaaagtggggcattgcggtcccctgcaattattttattgcagtcattgcagtctgtctctctcgagagctattaatatttgctttatatatttgggtgctccactgttgggtgcatgtttttaattttgttatatcttcttgctgatttgacttttctaaatcattatataatgactttctttgtctctttttacaagttgtgacttaaaatctgttttatctgatataaatatagctactcctgcttttttttggtctccatttgcatggaatatcattttccattccttcactgttagtctatatgtgctgttagaggtgaagagagtttcttctaggcagcatatagttgtgtcttttttttttttttggagatggagtctcgctctttcgccctttcgcccagactggagtgcagtggcactctctcggctcactgcaacctctgcctcctgggtttaagcgattctcctgcctcagctttctgagtaactaggattacaggcacctgccaccacgcccagctaatttttttttagtagagatggggtttcaccaagttggtcaggttggtctcaaactcctgacctagcgatccatcccagcctcccaaagtgctgggattacaggtgtgagggtcttgttttttaatccattcagccactcttggtcttttttaactagagaatttagtctatttacattcaattttaatattgataggcaaggccttactttgaccatttcgatacattttttttttggtattatgtaactcttcttttcgtttccttctttcttactgtcttcttttgtggctgagtgatttttctctggtagcatgttttaatttgttcttttttatttttagtgtatatattatagtttttagctttgtaattaccttgagtcttataaaaatattatattaattatttcaaactggtaccaacttaactttgrttgcaagataagaaacaaatgaaaagaaaaatttgtacaccttaacttcctctcctccaacattttgaatttttgattttacaacttgctgtttttatattgcctcttaacaaattgtacttgtaattatttttaattgttttgtattttctttttactaaagatataagtgatttaagaaccatgattatcatattagtataacaataacgttaatgttcttttcttttggtttgaagaactctgattagccttttttataggacaggtctagtaataaatttcctcagcttttttttttttttttttttttggcctgggaaagtctttatctggcctttatttctgaaggatagttttgctgggtacacwattcttcgttaagttttttattttctttcagcattctgaataatttcactccctccaaccctaaggttcccactgaaaattctgctgccaagtgtattggatctcccttatatgttatttgtttcttttcctttgctgctttcaggatcctttatctttgatctgtgtgagtttaattataaatcttgggttgtttcttattttggagagggaaagttgagcctggttggtgacctttaaccttcatgtacctggatatttatatcttttcaagctttggaaagttttttgtatttctttgaataagctttctacccctttgtctttctcagtttttttctttcatttcagtaacctgaatatttgttcttttgatgttgtctcatagctcccataaaccrttcatttcttttcattccttttgcttttttctcctctgactgtgtattttcaaatagttgggcttcaagctcactgattctttcttccttttcatcagtcctgctgttgatattctctattccatttttcattttgctcattgtattttccagctccacaatttttgtttgattttgtttatgatttcagtatctctgttaaatttccctratacatttctgaatcgattccgtctgttttcttgaagttcattgagctctcttaaaacaggtattttgaattccttgtctgaaaggtcacatatctctatcactttagggttggcctctggtgcctcatgtccatttgttgagatcatattacccagaatcttcttgatgcttgtgaaattgcaggctgtctgtgcattgagggattaagtatttattttactcttcacagtcttcctttgtttgtgcctgtccttctttagagaccttccaagaattctaagccaactgagtattgtgtttcctgagcctgtgaccacttcagctatctaaacactaggagactgtattagggttctccagagggacagaactaataggattatgtgtatatgaaaaggagtttattaaggagaattgactcacatgatcacaagtgaaaatcccacagttggccatctataagctgaggagcaatgaaaccagtagtggctcagttcaagtcccaaagcctctaaggtagggaagctgacagtgtagccttcagtctgtggctgaaggcctgagagccaatggcaaaccactggtgtaggtctgagagtccaaagggtgaagaatctggagtttgatattcaagggcaggaagcatccagcacagatgaaagccagaagactcagcaagccggcttatttcatcttcttccacctgctttttctagccacactggcagcagattggatggtacccacccaaactgagggtggggctttgtcgcccagtccactgacccaagtgttaatctcctccggcaacatcctcatagacccaaccagaaacaatattttgcatccttcagtccaatcaagttgacaattaatatttaccatcacagagactctctgagcccaggcttgccacaaatctcacaggatctctttggttgatatggctttctggcccagatggacctggggtagacccaaggcagatactccggctgcgtggaaatgctggccagggatctgagtccagaagactgtcccaatcacccagatgagtgtgcctttcagcatatttctgcacaggcaggaygggctgctaactgcagtgagagggcctggagttgagactgggctgcgttgggatctgctgtgtgaaggagactggccccgacttatttgctcatatcagcatgcatcactcagctggtcattgcaaaagtgcttgactgtaacagggsggtctggtaytgagactgggctcccttggaatctgctgtgggatggaggttggtgttcttgtcacattggctcagatgggcatgtgtctcccagcaggtccgtacatagatgggatagctcccagactgcagcaggaggggctggagctaagactgggcccccttggactctgctgtagggacggatttggaaagcttgtcttgttggctcagagtggcatgcatctcccagcakgtctcagcacagataggatagttcctctactgcactgggcggggcttagactgggtctcctcaggatatgttgtgggatagaggctggtgagcatgtcggggaggatcagagtyccaggccatgagatttgtgtgaatctccccctggtttcttgtgtaagcaactataagctgggacctcagctagggaggcctggagcagtgtcacagttcaacttccaggttcactactgagaccagttatcagtgggctgatgagcttttctgccaaggcattagtgtgcatgatttctctgaaccctttggcagatgattttggttgcaggctcaaggtcaaatggggctatagtcaagccccttgagagacagggctacttctgggcttgaatgcaaaagcaagctcagtggagcagatcagtcacttgggtgttagtgtaccctctcaaagtgaccctcctgtgtcttagggtttcacaattgtggatggatggataattctttttattgtgggcatatatgagcaggttaccttctatttcgccatcttggtggtgtcactctatgaactacatacttaagagaaattgctacacagaatatattgagcatcctttttttttttatgaattaagtcattatcgtgaacatcaaaaatagtaatgttactttgggaggccgaggcaggcagatgacgaggtcaggagattgagaccatcctggctaacacagtgaaaccctgtctctactaaaagtacaaaaaattagccgggtgtggtggcgggcacctgtagtcccagctacttggaaggctgaggcaggagaatggtgtgaacccaggaggcggagcttgcagtgagccgagatagcgccactgcactccagcctgggtgacagtgcaagacttcatctcaaaaaaaaaattagtaatgttaagtcaaatttgaattattctacaccccactctcatcttcacattttgctatccacaacacattaattttatatttttaattgtttttgtggctatcttctcatttccnnnnnnnnnnnnnnnnnnnnttgcactcctttgccttaaacttgttcctcattatttttcccctttactattctaagcattttataactgttctctcgacttctggactcttaatattcctcctaaacatcgtttatactgtggccagaatcatctttcattaatacctctgttatcacttaactttcataaaacccttcctattgcttacacgataaaatctgaacccctgcctcccactttaagtagctttattgattgccacaatctccctgcaccctatgattcacgtgtagtaaattcttatatcagttctgttcaagtgtattcattgtatgtaatttaaaagtcaatgaactcagcgtaaagaccttaagagctcttctacaacaaagttcatatagtaacatctattttggctcatcagagacctttttgatttcttcctgggtcttgatgtatttcatatttttgaggatgtgaaataaatcaactgaggactaacctgaaatgttactttctctaggaacatttcttgactctaaggagtttcttctgtatgttttgatggtacctgtgcattgctctatcatagtacttgtcatacagtatgctaattttccttgtaatatggtgttttatatgaagccaaatacygcccataccagtttgggattagttaacattctgctagggtttgcctttgtgtttcagtcagtcagatttttaaaaattaatataaattgtttaggaaatacttaagtcagtgtcttgttacatcctcggaattggctggacccgtgatctgcatggaatagaatatgaatcttgttcaaagtaaggggtgtgtgtatgtgtttgtgcatgcatgcatgctcgtgcgcacacacagagagagggagagagagacacacacacatgtctcttgttcttcgggatgtatgaggaactgtgtcagaatagccagatgctcggagaaacatccccacaactgaggtcatctatcattatgggacaatttaattcataacttcttgtggtgactgtttatcttaagagagtagatatgtatgtggtaaaaaagaaagtctgctgtgtttcttacaatatttgatattctaggtacttgagaaataagaaatattaaagttcagaaatattaatgtcaaaaaatgtgcatcttcagatctggtaagtagacctgcttagagctagccagtggttaggcytgagaaatggctgttccatcttctgtgcctagcaccacatctgatatagtgtaaaaatgtggatagagttatagacagatgatgaataagttgttaaaatattatgattagtcacagcctttcctttgtattgatgtgtggtttttggaatgtagaatggctttaacttttaaggcacaaataacaaacagagaaaataagcatgctaaagggattaataagcagattttgtttattttctcttttgtgtatattttttctacttcattggaagaaatatacatgattgcatttataaagacactgaacagttgttttcttttcatgcaggggcctgaattaatgaataaatatgttggtgaatctgaaagagcagttagagaggtaagaaattgtgcctttagtggcactcagcacaggagaatcacacttctgtcctgtgcagcttcccttttgttttaggtaacagactttggcatttccgaagtcagatcttagtggtatttttttttcttcaggtaaatattattttattatttaaaaatgcagttttgatcatctgcaatacttcagttttgtttttaaacatcatattaccagcccttttaaaactatcattttttctgataataatagccagcatttctgttaaaatagttaatgctgttactaatagttaataatacctatcatttattgagctcttactgtttcaggcattgtgccaaatgctttgtgttctttttaaaattcaattattaaaataactttctgaggtaggtgtttattatctccattttatagatgtagaaatcgaggcttacagaagtgaagttaactgctgaaagtcacacagttactagtagtgcagctgggattttaactgaaattttctgattgcttaactgaattgcctccttcacacctatgtgaatatgtattgatagtcttgtctctttaagcactattgaaggggatacttttacatccattataaagttctgaacatctattacaaggtctatacaaagtgactgggcttgttgacttgtacctaataggtttggttctaaatatagttttaaaacaaaccaactacagaattttctagtgtttgctcatctttagcyaatgtggcactctttccaccagaccttccgaaaagcaagagcagtggcgccttccattattttctttgatgaactggatgccttagcagttgaaaggggcaggtaagaagtatttaatagcactgctattacataataatatgatgttacataataatagcaattatggtataaatagcattttgtatacaacttttatctattaatacatttggcctaaaaaagttttcagtttttgtaattttttcctcttayacccattaaattatttcatgtaattactgtatagtacttttatctatattggataaaaaccactgatacctgtctgggcatttgagttaatttttatagtttatatcaacacatacttcttagtattgtctatcaaaattagggttattgtaaacatataattaaaactgtaaacaaaactggattaatcataattacttcttgtagtagaacaaaattataaaatacgttacacagattttaaaattctctggaataaatgtttcctaaagtaaaattaaatagaatataaattagtattaatagttttgctccaaaatctcaggcagtaaagaggattatctatgatgtcatttcaaacaaatatatayacacacacacacacacacatcagaactgttcataagtatgtttttttcctctacaaatgtatagcggtcctttaatatgttctacaagtggttcatgttgggtaatgtaaattcatgtactttgtgcatagcttcttgatgtgtatattgattataaaatttttgctggtggtaattacagtgaagggtgaagacaacttacaggtgtcagtagtaagtgtgatatgaaacattgctgttatcatccttcttaattagagctgcctcatgtgatgagagtataaattgtcattaggaacctatcattaggaggtagactgctatattagtccattttcgtgctgctgataaagacatactcgagactgggtaatttataaagaaaaagaggtttaatggactcacagttccacgtggctaggagacctcacaatcatggtggaaggcgaaagacatctcttaggtggtgacaggcaagagagaatgagagccaagtgaaaggggaaaccccttataaaaccgtcagatcgggctgggcgccgtggctcacgcctgtaatcccagcactttggcaggccraggtgggcgaatcatttgaggtcaggagtttgagactagcctggcccacatggtgaaacgctgtctctactaaaaatatagaaattagctgggcgtggtggtggttgcctgtaattccagctacttgggaggctgaggcaggagaattgcttgagcccaggaggtggaggttgcggtgagctgagactgctccatcgcactccaccctgggcaacaagagcgaaactccatctcaaaaaacaaaacaaaacaaaaaatcagatctcgtgagactgattcactaccatgaaaacagtatgggggaaaccacccccatgattcagttaatctcccactgggtccctcccacaacgtgggaattatgggggctacaattcaagatgagatttgggtggagacacagccaaaccatatcattccgcccctggcccctccaaatctcatgtcttcacatttcagaatcattcatgccttctcaacagtccctcaaagtcttaactcatttcagcattaactcaaaagtccacagaccaaagtctcatctgagacaagtcaagtcccttccacctatgagcctataaaatcaaaagcaaatttgttacttcctaggtactatgggggtacaggcattggataaatacacccgttccaaatgggagaaattggtcaaaattaaagggctaaaggccccatgcaagtccaaaatccagcagggcagtcaaatcttttttttttcttttcttttttattttattttattttattttattttattttattttattattattatactttaagttttagggtacatgtgcacaatgtgcaggttagttacatatgtatacatatgccatactggtgtgctgcacccattaactcgtcatttagcattaggtatatctcctaaagccatccctcccccctcccccgaccccacaacagtcccccgagtgtgatgttccccttccggtgtccatgtgttctcattgttcaattcccacctatgagtgagaatatgcagtgtttggttttttgttcttgagatagtttactgagaatgatgatttccaatttcatccatgtccctacaaaggacatgaactcatcattttttatggctgcatagtattccatggtgtatctgtgccacattttcttaatcctgtctatcattgttggacatttgggttggttccaagtctttgctattgtgaatagtgccrcaataaacatacgtgtgcatgtgtctttatascagcatgatttatagtcctttgagtatatacycagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatttcattgtggttttgatttgcatttctctgatggccagtgatggtgagcattttttcatgtgttttttggctgcataaatgtctttttttgagaagtgtctgttcatgtcctttgcccactttttgatggggttgtttgtttttttcttgtaaagatagtcaaatcttaaagcttcaaaatgatctcctttgatccatgcctcacatccaggtccccctgatgcaagagaggggttcccatggtcttgggcagctctgcctctgtagcttggcagggtacagcctccctctggctgctttcacaggctggtgttgagtatctgcagcaacatggtgccacaggcacatggtgcaagctgtcagtaacctaccattttagggtgtggaggatcgtggctcttttctcacagctccactaggtggtgccccagtggggactctgtgtgggagctccaaccccacatttcccttccactctgtcctagcagaggttctcataagggccctgcccctgcagcacacctctgcctgaacatccagggatttccaacatcttctgaaatctaggcggaagttcccaaacctcaattctcgacttctgcacaaccgcaggctcaactccatgtggaagctgccaaggcttggggcttgyaccgtctgaagccatggcccaagctgtaccttgaccccttttagccatgcctggagcggctgggatgcagggcaccaagtcctgaggatgcactcagcagtggcagggggggccctggacctggcccagaaaaccatttttccctcctaggtttgcaggcctgtgatgggaggggctgcagggaaggtctctgatcttccctggagacattttccccattgtcttggcattakcatttggttccttgttacttaagcaaattactgcagctggcttgaatttctccccgggaaatgagtttttcttttctactgtatcttcaggctacaaaattccaaacttttatgccttgtcacatcttgactgctttgctgcttagaaatttcttccaccagatatcccaaataatctctctcatgttcaaagttctacagatctctagggcagggacaaaatgccaccagtctctttgtatagcaagagtaacatttactccagtttccaacatgttcctcattttcatctgagaccacctcagcctggattttattgttccatattgctgtcagcattttggtcaaagccacttaacacgtctctaggaagttccaaattttcccacatcttcctgtcttctgagccctccaagtctctaggaagttccaaactttcccacattttcctgttttcttctgagccctccaaactgtaccaaccttcacctgttactcagttctaaagttgcttccacattttcaggtatctttacagcagcaccccactctaccgttaccagtttactggattagtccatttttatactactatgaagaaatacccaagactggataatttataaagaaaaagaggtttaatgaactcattagttccacatcgctggggagcctcacaatcatggaggaaggtgaaggaggaacaaaggcatgtcttacgtggtggcaggcaagagagcttgtgcagggcaactcccctttataaaatcattagatcttgtgatgcttattcactaccacaataacagtgtgggggaaaccacctccatgattcgattacctccacctggccctgcccttgacacatggggattattacaattcaaggtgagacttggttggagacacagtcaaaccataccagctgccctgctttccacccccctcacatttggtattccatgaatacttaccagtctttttgctttgtgaagtgaagcactcaagcccttttattacttacgttttaagatggcacagagtgttacaaaactcaggtttacctaactacaagagaagaaaagccagagaattttgctgaagtagtgtgaccttccacagttatgtgacatcagagacatctggttttggaccctaaaaaggaacaggtgggagggatatcctgttaaatatgaaccagatgggaggtagaatatgtagcaaagttctcttaaaatgtctctgaaataaagtgatgtgagaaaccagacaaggcactttgtagtaatatcttgctttcwtaggagtttagctcagtaggaattaccagatacataagagatgctaatgatttgcagcttctagatgttatttcctctggtagtcttcatcaaattgaacttttcagagaacacatgtgtttagtgtatacctccctctctcaatggctcgtcatgtgttacttaatgaagggaggcagtttacatactgagaaattcagtcattagtcaatttcattgttatgtaaacatcatagagtatacttacttataaacctggatgatgtagccttctacactatataccatatggcctattgctagatagtataacaatcatctgcagtactttgattttgttttyaaacatcatattaccagcctttatttttatgaaataaagattttttttaaaactatcatttttttctgataataatggccagtatttctgttaacatagtcaatgttgttactgttacttaatcatacctatcaattattgagctcttactatgtaagatatatatagcaataagccatatggtatagcaataagtcatatggtatagcaataggctatattacctataccaggtagcctggtcctaggctactaacttatacagcatgttattgtactgaataccattgtaggtagtggtaacaaaatgcttagatttgtgtatataaacatacaaaagttagagtaaaaagacagtgctgtgatcttatggtaccagcttcatatatgtgattgccattgacccaaacttcattatgtggcacatgactgtagaaataaattctatgcaatttgttttgtacagaaacatttctggtcataatttatcaagttagttggcatttcggaaagcaaagatgaagttccattcaaggaaatagagtgctgatgggtcccaattaaagagttttggttgtactctatttgcactgaatcttatgtagtttgttttttgtaaccataaaactctcataaagtgactttctgttttcaggtcttcgtctttttttcctaattatatgatggatcaktattgcctataagtgattgttttatctaattagtttgctgttacttgaaatctaaaacaaaaggtattttgttcatttttttgttctttggctatttgaattgaacacaatggaaactgataaagaactactgatagatataccagaagtataaaattcccaagatactaaactaattttatgcattgttaaactactcatggaataggaaaacagagaaaaatttcataaattaggaggcatttctatgtaatattaggctgtaaacagtcactgatttaattcgtccaaagctatcatctgttttctatgataacattcagatcaaatcatataattagtcccaaagtgacaatgcataaagaagaatgtttctgggctgggcacagtggctcacacctgtaatcccagcactttgggaggccgaagtgggcggatcacgaggtcaggagatcaagatcatcctggctaagatggtgaaaccccgtctctactaaaaatacaaaaaattagctgggcgtggtggcagacgcctgtagtcccagttacttgggaggctaaggcaggagaatggcgtgaactcaggaggcggagcttgcagtgagctgagatcgcrccaytgcactccagcctgggtgacagagcgagactgtctcaaaaaaaaaaaagaagaagaagaaggtttcaagaatttagtttctaaattcaggatgtttcrcaattgagcaaagaatcatgatatttgctagtctttactgtcttgctcatgctaaatcaaattattttgactacttaaaattactgaaaagataagacatggtaattagccatgaagcagaggattgcagccagcacattgtaagtagagcatagatatactatttgcttgttagtcattgaagtctttgtatttcaaaaaaatcgtatatttcgtgcttatgaaagtatctaattataaccaatattttatctcttctttgccctgtttaatagattctttgggacttgaagaataaataagcctgatatttacttctcttctgtrtgttcatttaaattacggcacctttgaataagaatttttgtcatattttatattgtaagaggaaatgctgcatgattcttttttcaaagtattttactacatttgggaaaattaaaaatgctgttaagggtaacatagctctttggaaaatggataatatgatagggagtgagacgttgagggaggaaggggagttgaattatactgggctaataataatattagataacattcctttagtgcttmttacatactagaaactacttacattgctttacagtaaagaaaaactcacagaaaggtccctgcattaatgcaaagtaggatattatacaattggcagttgactctagtactttgtcttacctcctgactagcttacatttttacctttttcaaggttatgatgtggtgagtagagcaaactgggcagtaaattattagtcaaccttgtcttaggcaacaatcctgtcatcaaaagtgcagacatgtagggttggcccagtctcctctgactgacgaaatgagtactgactaacctgtagatttcccataacaacttctattgtccaggacatttcataggatcctaagatcctgaatcatactccttagctgacagtgattacttagtagtgccaaacttcaagtaggactagaacagatttggaactaggaacatattcctgaaacttagggtcattagctagagaggctcatcttttttacttaacttccaagtaatgtgactccttttgtttggaccccacttagtgtattaactcctaatcgttgtgtttaggtgctattctcatcttcctttcacaggtgagaaaacggggctgtagacacctaagtacctactcaagggcatgcatcactaataacagagcttgtatttgaatttagatatattgactatagagcagataccctgagccacttttttgttcaactacggtaccacatagcccaggattccaggtgtaggtagttaactaaccttcaagcttgtttnnnnnnnnnnnnnnnnnnnntgcgttggggataaaacagtgaacagtaacctagggacaggttccttaacctctctaagccttagtttcttcatctgtaaagtggagttaataatagtaaattctaggtttttggaagtaaatacatttatagcgcttaacataatacctggtatttaataactactagaaaagttcaatgtttcttcttagagtaatttttgcaagatattcttaaaataataatgatttccatataggttgaaatatagtaattgagattgaaatgaatctacctcgacagagtttatacactagtgaaagaaaactgattaaataaaacatttgggaattagaaaaaatattctacagttgacacacagtgtggcattttgtcactctaagatgccatcagttataagatacatcattattttatgtaacttactgaagaaatatgctgagaaaatggtgctgagaaatcaccaactacaggagacattctgacctgacaaatttaaaatatgaaaaaaaattatcctagatataggagaaaattttgttgtttaggagatagggaaatgatttattctgttttgtaacactaaagctttatataatgtattggggtattgttttatgactagaacataaaaacatgatcaaatatatttaaaaaaatgaaaaaggtgaagtgctcagttaaaagctgactggtatcttctgtgtggcactagagaatctatattaataactgcttctcctatagctgtttctgcatttatagtccagaattggtttccacttaagagtggttagggaaaaaaataaaaaagttctaagctagctttcattgaaaatgaagatctcaggcttagcggcattctgaaaagaggtctgcgttttaaaataataatcaggaaatgaggtaccctcttttaagcagcagcagcatatccagatttgaggtaaattcaatacattcatgatgttatgtactgtaaaggaaatttttgtaggcatcatttctctaaatgacacttttcaagaagggttataaattttttaatgtgatttttatggtggtttataaaatttcataaaatcatagaactttataaatggaaaagttcttagaagtcatctagtacaaccttttatttttcagaagaaacatgtaattcttttgtggcctagacaagactagaactcatgtcttctgatttaatgctctttgaactatactactgctgtttcatatattatcaggatttaggatagaaaaagtacatttatttcagggtaaaaattctcatgtatctaaatatttatgaagaatttttttatgttttaagaaactctagtagtcacaacttagatatttttagccactattatttttatgtccattttgaaagttactaaaatcaatggcatttttctggtaaacagttttttccaatttatacttaattgcctcacatataacatartttcatattggtaaattttaaatagtaaacagtaaacaaatgctgaggaaaacaaagcaagagacgaaatggaaaatgtgtaacagattttctcttataatagttttatgtggtatgagagttctatgagtttttttatttgtgttttgtctataagttgtaactaagtactatagcataatttttcaaaggcatgagatgagtttccttagagagatggcctgttgcagcattttactaggaactgggaattctttgttatgtgtaggacacatagatttcttgctgtagctatctcacctttaaaatcaaagtttgcttacattttacgtgtaccatgaaaattatcataagtaatgctttaactcagagcagtatatgttggctagccttcttttttggggtttcttacaagccaattttgactgtgggtgtgtgagattttaagaaaatgaggctgggcacggtgactcacacctgtaatcccagcactttgggaggctgaggcgggcggatcacgaggtcaggagatccagaccatcctggccagcatggygaaaccccatctctactaaaatacaaaaaattagcttggcatggtggcgcacacctgtagtcccagctactcgagaggctgaggcaggggaatcgcttgaacccgggaggtgtaggttgcagtgagccaagattgcaccactgtactccagcctgggcaacggggcgagactccatcccccccaaaaaaaagaaagagagaaaagaaaatgaacaaatttacatgcctaccatttggracttgttatgatatttaaaatgtatactaggaaaaaatattttaaaattaaaaatgagtatataagatgctggtatataatttgggtagggcattttattttattggaggagttaggaaattcatgtattctgtgaaaatttttagtactggaaaatagaatcagtataataattaccataatgggagtgaagtttcttaaagataggggtaagcacattttttttctgaaacagttcagttagtaaatgtagtctctgttactgctattcatctctgttgctatagtacaaaagcagcatggaaaatatataatcaaatgcgaaaacaattggttggtcagatttggtctgtgcctatagtttgcctaccccagttttaagataccgtaatatccctttgatctgtggtcstatatgtcttttgaatagsaataatttggaaagggggcttgacttttgaaaggaaaagaragttaatgctttgggaatgtctggcttatatattrgctgtacattttcccctattgtgttgcctatgtctagcagataataaagtcttatgaaatcatttcattatgttagtgattaagcatttgtatttaaactttttcatagagttgtttttgatttcctaggatgtcagttttatggtttttgtttcctactgaagctttgaaagtcagccaagaatatttctcagttcataaaacattttcactatgcttttctccagctagctttcaatgatctgtggaaataaagagcaaaggccgtatgggtaataggaatgcaaagaattattgtcacctaatcttcagcattaattacagccactgtttcatcctacaacaaagagcaaattggaaaagtttgagtttcactgccttttatttagaagtacctgattggaggtgtcaataaaacatttctaaatatgaatattttattaagagtaatcaartagctccacatagatgctacataataacagcatagaatcacaattttattaaaattcaaaagacttatgtatatattacctaaatttgctccctcattcatacctgccaacaagaatgaaatcttcaaggaagtgaaaatgtcttcattctcttacctcagatgtccaccacagtgcctagcaaagatgcacacagatagttttttgaataagggaatagaaactcagagaaactagagattatgatcactccactggttattcagagttcgacttagtgccacgtgtgaacaaattttcttttaaaatttgagacttgtaaaatttaaactgagactcttacataattttatctcctgcattaatgtttatagaagcatcatcatcttcatggtaaagaatcattggtaagctttggaataatttacctctcaaagaactccaaaaagaattactgaagtgctaagccgtgctaaaaacatttaatggtttttgaacacaataaatttaaaagtgggttcgactcacaaaactttgtcagtgtgccaagtatacagaaatgatagatattctttttaatatagctgttagcagccgtaattaaaggccaacaaaggatagcagcagtgatgagcattatccattttaggccagtgagaacacattttgaaaaagactgctgccatccatgatatattaattaatktgtagaaaggtctccatgttactctctgcacaaaaggccattcagtcacacttattttattgtagggtaatttaacagtctttttttgcgtaaacaagcacctaagtcagtaggttccaaatcctgtgtttctacaaccatacttagagcatataaatgatgatcctgtattatcaaggacaaatgctgtatagaatcctgtggcaccctcttcccaaacaaaagctgagttgactgggaatacacaaagaaggagtgtaggtagaaaaaaacagatgaagagaacttttggtatagattcaagaaaccaaagaaatacggattttctttttgttggcctatttcctgagccaagcatttctgcatctgagcacagaatcttacagtatgttgttaaaaatattttgtctattttagaaggatttacttaaatttatttttaattataaaaatatccgaaaagtataaacatattcttatctggaaattttagctatgtaaaataaataactacttgaggaatttgagaagctaagcaattactacatttgaacaactaaaacagttaagactgttaagactaaaacgtaaagtactctaattaccaatgtcttaacaatctcctagtaatacagcaacaaaatctctattaggagtgtattaaaggctgactgttctgggcatgmctcatagttatgaaggatttcagaggagcagttctgatcttagtattcgcttggtggttttcatggcaaaatttaaggaaatttgatactttgaaccatattgtaagtaaggctaagtaaggaactgactgttaatctggatgcatctgttgaccyatgctgtttgaagcttctgaaaatcttctaccagacatcacattcttgctcttttcagcaaatatttatgtatcacacacccgttagtttaatttataactttaaaagatttaaaaggtatcttcattatgccaattatagtgctgacacttacaatgactaaaaattaatatttaattaatttttataattataattattataatgccccaaactgctatctagtgacattttctttgtgctaagtactgtgctagatcctttatatgttttatttaattttgaggaagtgtcttagtccccttgggctgttataacagcataatttagtctgagtggcttagaaacaaaagtttgttagttctggaggttgtgaactccaagatcaaggtgctgtcatatttgatatctggtgagggctgcttccttctttatagaatgccatcttctcactgtgtcctcacgtagtgaaaggggcaaaggagcagtctgggggctttcttacaaggatactaattccatacatgagggctccaccttcatgacctaattacctcctagatatccaccttcagataccatcactttgggggttagatttcaacatatgcattttgggaagaggcaaatattcaatcaccaggcaagtatgatccttcgcatgttttgactgagaaaactgagcctcacagacaacaaacaaggtgaaaagttgccgtttgaacccaagcatattaaatatcaaagtcctttcccaaattcaaagcaaccttcccaatgagtactagtcaatgaaggtttattggttttctttgggttgttgtttcttacgattactatagatttttattttttattttactatttctagatctgtgatattaggaaaatggcacacgtttaaaagcatttaatctgcttaaatttctaggtagttggctgtcagaaagtaagtttgaactgacatattaattttccttattatttcttgtgttggattatgtttatgatatcagtgcctgcaggttcaggattgggaaacaattcttttcaaaaaattgcttttgtcaggtggtaaattgaactgtgagtttaagaatcacttgtttctcgggctgggtgtggtggctcacgcctgtaatcccagcactttgggaggccaaggcgggtggatcacctaaggtcaggagttggagaccaacctgaccaacatggagaaaccccgtctctactaaaaatacaaaattagccgggcgtggtggcgcatgcctgtaatcccagctactcgggaggctgaggcaggagaatcacttgaacccaggaggcggaggttgcgatgagccgagatggcgccattgcactccagcctggacaacaagagcgaaactccgtccccctccaaaaaaaaaaaaaagaatcacttgtttctcttattctgtgtttgaatcaaaactatacaaatgtaatgaatattgtctgtgttagtgtggaatttttactgggaaatcatggcaagatggaaaaatacatgcttttatgtcactctctatgttaacagtttatacaaatctgcagttacatagagcacatgcagcttatacatctgtataatagctgacaaaggtaacttgtgtgtctttctgcatttataggatatcttattaatctaaaataggttcctgctgaatgttgatcataatctaaaatctagtttatcatgtaggtgataagctagattactcaagacattattgattttggacatttatcaaatggtttttgctttcatatttttcaagttttgttgattattcattgttaaatatttcttcagtacagcttcctttcaactgtaataaataaggaacttttatttttcttctggagtactgattaaaagatggctgtagtagatatttcagctttaccatggcacattggtgtatttggcttacaaaatttttaaaaattatttatgatggaatgagtataggctctggaatcaagtaaatgtgcttttaaatcccaactcttttatttgctagttgtggaatcttaagccattcaacctttctgtctcagttttttaatggccctcacagcagtatttacctcacagcactattattgggattacttaactaatacctgtaatgcatgacacagagcaacttacacatgtgtcaactcttattaatacagtgtctgggaagtaggtattcaatgaacaatagataatcttcataattacttaatttcgcctcacagcactgtgtgggaagtcagaattctccattttcaaggctagaagtgaggcacaggtaaacttcctggtgtaaacataattatatactgagctttagtaatgctgtaaacaaatggtttatcagaaacaaggaggtttaattttgtttatgggaatcagagatcttttgaggagattatttttaaaacagcccaaaaaagtgagcaagaaaccttaagaaatccttgatgttgttagactctttaaatatttgtcaaaatgtaattgccagctgtataacatagctggaattttaaacatccataatttcccataattttaaacactagggaaaaatgcagtatgtgcaacacaatataattttgcttttctctagagttgtttttcaagaagtccagtctaacatggatttctttagttcaagagttttgtgatattggaaatgatttattcaaaatgcatttgtttatggaagaacaaacttctttcctagggatagagattgtattctataggtaaatttattactrtaatattaacctgttttatttggagtgatatgtaatgtttgtgttcacattttttaattgacaaaaattgtgtgtacaatgtgatgttttgctatatgtatacacataaaatgataacataaagctamctgacrtatctggcacctcacatatttgacactttttgtgtgatgaggacatttaaaatctactgtcttagcattttcaaatatgtaatacattattattaattatcataaccatgctgtatatcaaactttttaagatgtttaaaacatgaattcctattcttttttttttaaactgaaaaaaaatatggttaccttctccggcctatctccttttctttcttctttcacttaaggaaatgatgttaaaacattttagtttttttcataacttataaattgtatctttattacagatttttactttttgaaacagtaaaaatcattgacaaaaatgatgtttttaaaataattttattcttcatgaattataacttgttttatttgtatacatgcttaaaattcttaaaaatataaatttgtctctttttctatttttacaaaatatcaaggaactagaataatgttatcatcttcaaggtatwtatgcggtgaaaatgtaattcatactcctcccaaactttgctatggagagggggagtatttttagaaagaatctctttttatgtgtttgttcctgtccaaacttattttctctcaggtggttgtactcattactacttcttygtcaaagaaaactgactctttctcaagtatataggtttcttaatcttagtaatttattttgaaagaagttcacgtcggatttktcaggtcaactaaagaaaaggaaaggcaaaacagaatctaaaacatttagatgtattgttgacatttttaatgagtgagcatttacaggtgtgtatgcaaacaagtagtaccataacatttacagtttctgtttctaggataattcatatttaggactcagaaatgccctgtttgtacctgttttaatattagtcactgattgcagaagttattttgcatagatgacttttggaataaatcttaaatgtaaatggtggtcacagacagttatctttagttagaagtaattttattgccttcaacatttcagagttttgagtccattcttgatctctttgatttctttcaatagttttgggacattctcagatagtattttttttttttttttttttttttgaggcagagtctcgctctgttgcccaggctggagtgcagtggcrcgaacttggctcactgcagcctccacctcccaggttcaagcaattcaccctgcctctgcctcctgaatagctgggattacaggcgcacgccaccatgcctggctaattttcgtattttttaatagagacagagtttcagctgttggccaggctggtcttgaactcctgacctcaggtgatccatccatcttggccttccattctcataaggggactctatactttttttttaggcctttccactggattacatatgtcttttgcactctattctgtttccattcttttttttttttttttgtcactttgtgtattcatttggatgctttctagtaaccagtcttccattttaaraatcctctgttctgttttcactaatctcccattaagactatcttttgagttcttaatttttattatagtttttargtttaggatttccctttgatggttttctaatggattccaagtccctggtgaaattcaactttttaaaaattttgctgtagttcatgtggatttttgtttttactatattagcactatctcttgccagattgtattttaacttgtttcacagattgtaattcactaggatctctcctcttcttaagagaaaattaaaagggagatgggattaaagccaaatgatactctagaaagcctttttcaaaaaatttcttctttcatttatagaatttagggtttcgaggaatgggatgaatagagatgtctatgcttttgttgataacatggtattttgggyttttctcaattgttccatctcttttttgggggcggtgggaacggagtcttgctttgtcgcccaggctggagtgcagtggcgacatctcagttcactgcaacctctgcctcctgggttcaagcaattctcctgcctcagcctcccaagtagctgggattacaggtgcatgccaccatgcccggctaatttttgtattttttcagtagagacggggtttcaccatgttggccaggctggtctcgaactcctgactttgtgatccgcccaccttagcctcccaaagtgctgggattacaggcatgagccaccacgcccagcctgttttatcactttataatcattatttttactgtagcttacttaatgccttgtgttgagttgagcgtctaaagcaattaggatattggtaatgtttctgtttgtgaaatgatttacgcaatcttggcttactgtaaccttcgcctcccaggttcaagcgattctcctgcctcagcctctcgagtagctgggattacaggcgcctgccaccatatctggctaatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgggcatggtggctcacgcctgtaatcctagcacttagggaggctgaggcaggtggatcacctgaggtcaggtgtttgagaccagccggaccaacatggagaaaccccatctctactaaaaatacaaaattagctgggcgtggtggcacatgcctgtaatccaagctactggggaggttgaggcaggagaatcacttgaacccaggaggcagaggttgcagtgagccgagatcatgccattgcactccagcctgggcaacaagggcgaaactccatctctaaaaacaacaacaacaacaaaaaaaaaacaaaaaaaaaagaaagctccctgaactgggtgcagtggttcatgcctataatctcagcactttgggaggccacaggagttccagaccagcctgagcaacataagactcccatctctataaaaaatttaaaaaaattagccaggcacgatggcacaaacctatagttctagctacttgggaggctgaggcaagatcacttgagcccaagtgtttgaggctgcagtgagccatgatggcaccactgcactccagtctgggcgacagtgagaccctgtctcagattaaaaaggctgcatgaaaagttttttttttccttacctgtgatttaaaacaaattcaaaataaaaaacarttatacagttttagtttttccttattttctgatgagttctcatgtaaaaactgcttataataaagcttagatatgatattcttttaacttagttatctgttgatgtgtacagttatttatgtttgcaacattcatcctagggtttaagatataaaattattttttaattatatgatgaaaatttatgtacatttagattgcctttatttttatttttatttgttttttttagagatggggtgagtcagtctcttagcctttttttggggggtggggggtgataaacaagtaaacatagaagagattaccagtcagtatatattcagtgacattttatgtcttgggttagggatttttttcccctcttaaaggagactttttgcttttgacccccaaaagaaatcartgtagaaataaagataactgcaacactgtctttagccttattttgaactcagacctatctactgagtactatctactatctactgagctcaggtctatcttcagaatactcccatctagatgtttcagaagtaccacagatttatacttgttttctctttggtgcagttgttattctacccaagatcattttggggaaactcaagccctgtgctgtgtgtgtgtgtgtggtggtggtggggcgggggggttgtgtggtgtgtgcatgtgtgtaagtgaaatttttttttcctgttgttgtttttttttttttttttttgagacagagtctcactttgttgcccaggctggagtgcagtggcgcgatctcagctcactgcaagctccgcctcctgggttcacaccattgtcttgcctcagcctcctgggtagctagggctacaggcgtatgccaccacgcctggctaattttttgtatttttagtagagatggggtttcaccatgttggccaggatggtctcgatctcctgacctcgtgatctgcctgcctcggcctcccaaagtgctgggattacaggtgtgagccaccgtgcctggcccctttttttcctatcttaaaaccacttactggctctgttacctgcatgatgtctaagtcaagaactgtgaaagatctggggttttctacttgcaggctaacaagtagccttccacagttgcatggatactggcagaaaccatgaggctcatgggtcagaaacgaatgacttcattattcacagcacagcaagcagcaagaatatctgtatgtttgtatcagttcctcctttacactgcatccaaaagaggtgatgcatatgggccatatggatatctgcacatctggtaggttgcattacaggacaggaatcccactcttggttaactcagatcttttatcttgggcagtaagcttgcctgccctttgcccctgagggaggtagatgaattgtgtagcttctgaagctctaaccaaacctactctttgctctggagggggacgttgtttcttgtttttgttcttcaccattttaagtgtacaattcagtggtacttcagtatgtttacaatattatgcagccatcaccactaattccagaacatttccatcaccccagttagtgccttgctcataagactgaagaaatgtgaaagacccgtggagaattgtctcccaaaacacacattatttgtaagagaaaatcatatcttacacagattatattaatggcaaagtagcatgggagagggtcacagaagtgggttggacgattccgttaaaagcagggaacattctagttaaggcacttggataggcattgggtgagagttttcatgtcttttctgctagattgttcctgttttttttctctatgtgcacctgattttatgctttttttcatctagcacattatctttaatatatttgacattgaacatttgtttgttaaaccaccaaaaagtttcaaacaagagaaatctgttttgactgttggaaggcagagacagcacaagattagcctgttctgctgaagtcatagttcaaccttaatgaacgtcaaggaataaaagactgtacatatgaggtgtgtagtattagcgtgtttgtgaaatcatatacccagtagaacaaaacactgattttgctgcttttgaatgtgcacatattatttttgtgcattaataatagctagtcagtgtttggaactgagacttttgtctagaattgtatagaggtaaagagcatggatttacgyaggcttagtagaagaactaattttaaaataaatggtcacatcataagacytaagtcaggttatcaataaatatttataagtgtctgtaacttgcaaggccatgtcaggtaatgttcagcagtccccaacttcaatctagaatggagrtggctaccaaaaagtatctttggattcctaggacccacagagattgactcagtgggtttgattgttaccctggattcatgggtaacactaaatggttacccatgggtaatctaaagcacagctagatttctgaacctttatttcaggatagctgaaaaacatagagatgagacattaaagcccccagtcctctaacagctacctccgaccagttctttgtttagcataaggattaccttcacctaggaactttttgaagtgtccagtgccctcctttgtgctctgattttcttctgttttgcattgtttgagaagttatgttgttattactgtttttatgaggggaatggtgttaggaatgaggggttctctttctataacactccttgagggaatagggacagtcttctttaatcttctcatttctgtttcctaaagtagtgcctgccagctagtgtttattgaacaaataaattgaattgaatgaattgttatacattctaatgaaattattccccttatttttcttccagtcttcctcctgccatgccacaatgatctttgcctaacatgagataaaacttacttagctatttttttactgcttggtaaactcaagtaatacattcacactttccagtaagacacttggccatcttactaattcattgggagaaatagagagcatatatataactaaggataggatctgacattatttggatgtagctcctgttagaaggcaaagcaagcaataacatgcataaattagatgtggcatggcccaggattttgtcttttgatgaaagtaggccattcctttggaactgtttagttatgttccatgaactcctctaggtagggcacaaaaattagaagaattctgttttatctagtagtgtagtcaggttaacatttttttgttgatgtgtaaccctcgccaatgctaggagtataaccttcctattgataaatccagttgttattttttatttctttacttgactcgaaaatatttgacacagttaactccagctttttttttcttttccttcttttttttttttttttttttttgagatggagttttacccttgttgcccaggctggaatgcarkggcgaggtctcagctcactgcaacctmcgcttcctgggttcaagcgattctcctgcctcagcctcccgagtagctgggactacaggcgcccactaccacacccggctaawtttttgtatttttagtagagatggggtttcaccgtgttagccaggatggtctcgatcgcctgacttcgtgatccatgcgccttggcctcccaaagtgctgagattacatgcatgagccaccgcacctggccaactccaaccttcttgatacactatcccctttattccttggtttcctttcttcttctctgatacccgtaaaattcatatattgaagccctaaccccgaatgtgatggtatttagcgatgaagcctttgggagataattaggtttagatgaagtcgtaaggttagttcccacatgatgggattagtgcctttataacaggagatagcagagagctagcgctctctcaagtttgtgctctcactctctctctgccatctgaggacacagcgagaccgcagccacctgcaagccaataagagaactcttgctggaacttgcccattctggcatgctgaccttggacttccatctaccagaatgtgagaaaataatttctgttgtttaaactactgaatttatgttattttgctctggcagccccatctgactactgcacaccccttctcctttgcaaattcccctatcacttcctgtacctaaaatactggtgttagcattctcttcattatgcatttacctttcttctaactatgtattttttctcggtgatctatttccattctccaggtaccatctttatgacaaggactggtaaaatttgtatttccattttgtacctctttctaactctaaatatctaaatctccagttgtcccacaggacaacccaccatgtttacagttaaagtttttttcatccggtgactccatggagacattagtttatcagccctattgattgtatttccttaatatttctcacatatatccacttctgtctcttttgccatgattttaattcagacagctaactatccgtcctggatcgctccaacatttttctaattgactgacatcaataatactcttaaatttatttattttttctaaatagactttttttttttagagtagttttgggttcacaccaacattgagtggaaagtacagagtactcatatatactctgtcttcagaaacacacaacctccccagctgttaacatcctgtgggagagtgatacatttgttacaatctataaacctacaatgacacataattatcacccaaagtccataattaacattagggttaactcttggtattgtacattctgtgggtttggatgaatgtgtaataacatatatctaccatgatactgtcgtacagaatagttccactgcattaaaaatcctttgtgccatccctgttcatttctgcctcctctgtaaccaggtgttaacctggcaactgatccttttacagtctacgtagttttgcctcttttggaatatcctatacattcctatgcagtgttcctgtagttggaataatgcaatatgtagcttttccagattggcttctttcatgtagtagtatgcatttaatattcctccatgccttctcataacttgatagcttatttccttttagcacagaataatattccattgtctrgacctacctcagtttacccattaacctactgaaggacatcttggttgcttccaagttatgaagactgtgaataaagcttctgggaacatctgtgtgcaagttttttgtggatataagttttctattccttttgataaatatccaggaatgcaatagctggaacctgtggtaagagtatttttagttttctgagagtttatttttgsaacttccaaactgtcttcaagagtggttgtaccattttttaccccatcagcagtgaataaaagtttctgttgcttcacagcttcatcagcctttggtgttggcaactttcctgattttggccattctagtgggtgtgtaatggtatcttattgttttcatttgcagttccctaataatatatgatgttgaccatcttttcatatgcttattgtttgtgtattttctttggtgaagtgtttgttcagtttttggcctattttttaatctgcttgttttcttgttgagttttaagaattctttgtatgttttggataacagtctttatcacatgtgtctttcgtagacactttctcccagtctgtggcttgccttctcattttcttgatgtcgtcttttacagagcagaaggtttttgttttaataatggccagcttatcagttgttttatttgtggatgatgtcattgccattgtacctaaatagtcatttccatacccaaggtcatcttggttttctcttatgctgtcttctaggtgttttataatttgtgttttacatgtaggtctgtaatctactccgagtcagtttttggaagaagtgtaagggatgtgtctagattcattttttttgcatgtggatgtacacttgttccagcatcatttgttaaaaggaccatctttgctcccttgtattgcctttgctactatgccaaagattagccagctgtatttatgtgggtctatttctaggctctctgttctgytctgttggtactttttgtgtgtgtctctgtctctctctctcttttttcttttttttttttttttggtcactaccacactgttttgattactgtcgctttataggaagtcttgaatttggatagtgtcagtcctgcaactttgttcttttccttcaatattgaattagctattttggatcttttgcctctcagtataaactttataatgggtttgtcaatattcatagaataacttgttggggttttggttgggattgcattgaatctgtggatcaagttgaaaagaattgacatcttaacagtgttgagtcttcctttccatgagtgtggaatatctctccatttatttagattttcttcagttttctttcattggtgtttgtattttttctcatatagattttgtacacattttgttagagttataactcatttttttggggtgctaatataaatgataatgtgtttttaatttgaaacactttttaattgytgatatataagaatgcagttacttcataggttaaccttgtatcctgcaaccttgctataattgcttattagattcaggagtggttttgttgataatttcacactttttacatagatgatcacatcatctgcaaagacacttttatttcttcctcccctatctgtaccttttatttccctttcttatgtagtgtgatgttgaaaaggaatgggcagaagggtcatccttgccttgttcttaatcatagcagaaaagcttctaatttctcaccattaagtgtgatgttagctgtaggttttttgtagctgttccttaccaagttaaggaagttctgctctattcctggtttgctgagaggtgtttttttgtttgtttgtttttaccaataatgggtattggattttgtcaaatattttcttcatctatttatatgattatgagatttttttcttcagtctgttgatgagatggattaaattaattgatataatgttacatcagttgtaacatcaattgtaatgtaatgttttcaagtgttaaactagccttgggtacttggaataaatcccactttataatggtatataattattcttttttttttttttcttttttttttaagagacagggtctcactctgttgcacaagctggagtgtagtggcacaatcatagctcactgcattcttgaactctgggctaatgtaatcctcccacctcataattatttttacatgttgttagatttgatttggtaagattttgttgaggattgttgcatctatgtttatgggcaatatttgtctgtagttttctttttttgtgatatgttcgtttggttttggtattcgtctaattgtggcttcatagaatgaggaagtattcactctgcttctattttttaaaagagattagagaactggtgtaattttttccttaaatgtttggttgaattcaccaggaaacgatctgggttttgtgctttctgttttgaaaggttattaattatttatttaatttctttaactgacacaggcctrttcaatttgtttattcttgtgtgggttttggcagattgaagtttttaaggaatttattcatttcatctaggttwtcaaattttgggccataggatgtcttagttttttaaaattatccttttaatatatatagatctgtagtgatgtgtcctctgtcatatctgatattaggaatttatgtcttttctctttttttcgtagatagcctggctacaggcttattgattttattgattctctgaaaggaccaacttttagtttcattgtttttttctcttttgacttcctattttagatttcattgatttctgctctaatttttattatttctttcgttctgcttactttagcttgctcttctagttgcttaaggtgaaagcttagtattgattttagatcttctctaatatatactctcartactataagttttgctttaagtactgctttctctgcattgacaaattttgataagttctattttctttgyatatttatagacaatagaactttgataagttctatttatatatttatagatatatatctataaaactagtgtatatatgtaaatagtatatatatatgtgtgtgtgtgtgtgtgtgtrtrtrtatatatatataaagagagagagacagagacagagacagggtcttgctctgctgtccacacctcagtgcagtggtgygatcacagctcactaaggcctcaacctccctggctcgagtgatcctcctgtctcagcctcccaactagctacaactacagacatgcatcaccaagcttgactacatttattttattttttatggagatggggtctcactctgttgccaaggctggtctcaaactcctggcttcaagaaatccttccacctcggcctcccaaagttctgcgattacaggcgtgagctactgcacccggcctaaaaatattttaaaatttctcttgaagtttctttttttttcctttgtattacaagtgtgttgttcagtcttttaagtattttggaattttttttttttagctgtttgctgttgactttcagtttaattctattttggtctgaaagcagacattctatgatttcttttaaatttgttcatgtgtgttttatggacaagaatgtggtctatcttgatgaatattctgtctgagtttatgaagaatgtgttggctgttgctgtatgaattagtgtgtagatataagttatatccagttgaattgtgatttagttcaactatgttcttattgatttttttgcctgttggatctatttctaataaagtgatgttgaagttttcagctataatagcgtattcatctgcttctccttatagttctattagtttttgcctcacgttttgctgatttgttgttagatgcatacacgttaaggattgttctgtcttcttagacaatttacccttttatcattatataataccccttttggtctctgagaattttgcatgcttgaagtctactgtgtctggaatcaatatagctactccagctttctttggcttagtgttagcattgtatgtctctcttcattttttttacttttaagctatatttgtttttgttggtaaagtgggtttcttgtaggcaatatatagttaggtcttatttttttattcattcaatctctgttctttaattggtgcatttaggccgttgatgtgtaaagtgattattgatatagttggattaatatctacgatatttgttactgttttctattagtcgcctttgttcttcattcccatttcttcttctctttcatggctttaattgagcattttatgttattttattttatctcttttcttagactgttaagttttttgggtttttttgtttgtttgtttttcagttgttaccctaarttttgcaatatatttctactttcaaatagccctattcacttcacaggtagtgcaagtaccttataataaaaaaaattcctaagttatccttctcatgtcccttgtatcatttttgtcattcatttcacttgtccgtaaactataggtatcaaatacattgttgttattttgaacaagcttttsttagatcagttaaaagtaggaaaaattaaagtttttatcttctttatttcttctttctctttctttatatagatcaaaatttctgacctatattttcttctttctgaagaactttaaacatttcttgcaaggcaggtctactggcaacaaattccttatttttatttgagaaaaattttctccttcatttttgaaggatgtttttgcaggatataaaattatacattggtgggtttttttctctcaatagtttaaatatttcgcttcactttctttttgctcacatggtttctgaggagaagttaacgtaattcttgctcttctgtaagtaaggtggtccccacccctcgacatatgacttcttaaaggttttttaaaaatctttgattttctgcctatgtgtagctttttgtttgtttgtttgtttttacatttattctgctcagtgttcactggacttcctggatgtgtatctgacattaatttggggaaattctcagtgaatgtttcttcaaatattggttmtcttctttcttcttttggtgttgctattacacatgctacacctatttgcttcatagttcttagatattttgttctgtgtggttttattattttttttttaaatctagtccagtattttgttttcataaagttttccttatccttgcttttcagttttggaagtttgtatatacatatccgtaagtgcagagattctttcctcagctgtttccggttgactaatgagcccatcagatgtaatctctatttctgttacagtgtttttgatctctagcatttcttttttatagcatttctttttgattcttgcttagaatttccatcactctgcttacattactcatcttttcttacttgttgtctactttgtccattagaatccttaacatattaatcatagttttttaaaaattcctggtctgacacttctagtgtttctgccacatttgactttgcttttgatgtgtactcaatttcttcaaactgtgttatttctgtcttcgtaggccttgtaatctttctttgatagccagacatgatatatgggataaaatgaattgcagtaaatgaggctttagttatataatggtaaggtgttggggggagtatgggaaggagtgttccatggtcctgtgattaggtctgagtcttttagtgagtctatacccttggactgtgaacttcacaattttctccygttaggtgggacaggatggctagatggagctggagttttttattttcattctcccatgggaaaggctagagagggctgaagttgggtatttctcttcctctgggtcagttggtgtctaataaaacctcaataacataagctctgggaaaaaatattttctcttgaggagcaggcctttttaagaagagaatgctctagtgtatttcacaatgggtacttttccttcctcctgccagaagcacagggtaatttttctcagatcttcactgtgagaagctggtgtagttgctgaagataaaactcacaaatgtgtgagggaccccgctctatgactctcagacttgtcaaacactgaaccyccagcagtttgttaattgcatttccagttgtcctaccctggcactggctctcatggaggtttctctttgtgggtttccgctccagaaagttgtgattttctgtacctgggctgtctgtctctccaattttgggggcagtgatttgccctgtgaccttactaatatgatgtatctaagaagagttggtttttcagtttgttcagctttttacttgctgttaggacrgagcgaagacttccgagctcttaacgttctggaccagaaattggaacaatgctgtccttttattgtctcttctctacactgcaggcagccatggtgtttctcaaaaacacaaatctgattaggtcatgtctctagttgaaacatcccattaactgtagcataaaatccaaactccatgatttggataacaaggtctttgttttcagccttggtttatttttctgtactatcttttataatacattttcactttactgttatgctgagccattgtgcactttatccagtttttagtattctgtgttctctctctttccctcctttcaccctttgcttgcctgatacccaccaagtttttaggttttaccttagaaaccatctttcttatgacagcccaccttgactctcctgagacctgtccatattaccttcctgagttttttctggtatagaatcacaagtgattagcagagtagatacaattaaaggcctccgatgtaatttattggcagcctgaaatatttactatgcttgtagtaattatgaaagacctcctaaagcttttgccaactgtgtttmtacttgacagttaaactcccacgtggaaaagttatattatggagawtcttttgaaggatgttgatagtgtttggctctgtgtccccacccaactctcatgtcaaattgtaatccccgtakgttggaggagactcctggtgggaggtgattggatcatgggggcagatttccccctttcagttctcatgatagtgagtgagttctcatgagatctgatgatttaaacgtgtgtggcacttcccccttcgtgctctctctctctctcctcctgccatgtgaagaaagtccttgcttcctcttctccttcagccataattsttagtttcctgaggtctcccggtcatgcttgctgttaagtggaactgtgaatcaattaaacctgtactcttcataaattacccagtctcagtagttctttataacagtgtgagaacggtctaatacagatatagaatccatttgtttatagtgttcaatgtttattcttacgtagagtcaaaaaagcaaatttgtgtaccggcagagtagctacctgcaagaattagtgcccaaaacagttctcattgactttgcaagtactctttggtcccatatattttaaatactggagaaraccatgttaaattaataaattagcgttgtgatttgtatgacaacctcatgtgcatttgattagtgtgagttagaggctattctcctgtggatacactaagtcaaatttttgaacttataagtctaaatacttaactaaatactttaacttataagtctaaatactgtcatttagagatgctgattaccttattattaaatatattacatgatgattatactgaggtgtgyttctttgtcacaggtgctaacaaagttattgggtgtgtatctccttctactttacgtcctcttccacccaagtgcatctaattgaatttacatgtttaatacgcttacaatgctgtgttactctataattgtccactcagttgtttattacatatttatcaattccaaataggtcttggaggaaatccaagctattgctaatgagaattattttgcacattttgactgtgtgatacagggttttgttcattagtaggatctgttgagtttacttcttttttttttctttttttgggacagaatctcactctgttgcccaggctggagtgcagtggcgtgatctccgcccactgcaacctccacctcccaggttcaaggtattctcatgctgcggcctcctgagtagctgggattacatgtacatactaccacacctgactaatttttttattttttttagtagagacggggtttcgccatgttggccaggctggtcttgaactcctggcctcaagtgacccacctgcctcggcctcccaaaggttttacagacgtgagccactgcgcctggcccgagtttatttcttaaaaacttatatttagtaatttttttgtggtcaaaggacatgaagttaraggatagtgtgtttagaactggctttgtaatggacttggtacgtaaaccaaaggaaaaaaaactagcctgctttctttgcctgtttctcaagaaatcgggattgtggtgattacctaccttctgatgtgttttaaaaatattcttaatatttatgaagaaacatcagaaatatcctagttgctgkggatgcgtaatgagttttttatttcacatagactttaggtttcatgtgaggaatgggtttgcatcttactcagttttttattctaatttctgtcaacatatttaccatgtagaatataaacattgattgaacaattctctatgtatttgatgaactattttaaataatcttatatcttgttttccagtgcttttatttctgacatttatttaaatatttttgttttggaatgaaaatgaacatggttgatgatagaggaaaataaatgatttgaatacagtttgttttgagatatgataatgcagtaaataaagtctcaaatgcatacttcatatttgaaaatagacatgatttctcttgttatagactatagaacctttaaaaattaatagataatagtatttgaagataagtaaagatattttttaaaccrtactttcaaaatcagttctttaggtgctgggaatgtagccgatcgtgttttggctcagctcttaacagaaatggatgggattgaacagctaaaggatgtgaccattttggcagctactaaccgtccagataggatagacaaggtaagagagaaggcattgtggatattataaaatcaagaactggcttgtttgattttatcaggtttttgtttttgtcaaattactttctaatcagtatttcatttagaggatattgaagaatgtaaagcaggttcactgtggactggttaccatcttgtctgagtctggtaagacagaacattcttgcatacaagttatacaaagcaagtttaccacttctggataggcagcaagatacaacagaagcctaggattcattgcaagctagtctctcaaggttcaggaaaactgccctgggtgaatggaatcttgactgcatatgccccacttgcactgcagctgagggcctctggaaagcaccctgttccaggttttatacactgagtatgtgagactcactgggctaaagtgttggaggacatcctgtttttaggggaggactggagtagaacctgggctgttccagccggtccctccctgtctcaggatgttgcatttcctgcacatgctwcagttattcttgagagctacgatgggagagagagaacttggtcattccaagaccacccagagagctgtcctacaaaggatcttaaactaaaggaaatgaagagaacaaaggaaagcttttatttacatttttattgcttatgattcagtattaatgaaactatttcataactcttcaatatctactccccaatcttgtatcttacttttagcayatttctctagagaattgaagttttgaaattctttgtttcatctaatttattcttccagagttttcaacattttcatctatacgaaggtacattctagctatttagcaagtactagttagactccagttgccatcaacacaagaactttgaagaagtactgtcctaattgttgtttttaaagtaattagaataaaaataatggattmttctatttttttaagaagttagtcaggctgtcacattaaattaagtagtrtaggtgcaaaaccagtcyttttaaactattactaccactttttccctaggtcataatttaataaaggagttcrgtaatttaagttcctcatctatatctaatatgtaatattttataaggatttaagttgagtaaacatttgctctcagagcgtgaaccagtttctcttttttgttgttgctggcattattgccttgtgtatgactttatgagctactttcttcctgtgtacatatacacattctttcagttttaaaagatgtgatttttaaaaaagacccctttgaatgtaactattatgtggcaagaaagccttgctttggttaggtattttgctrtgtgataaagatcctttggtaaaattcaggaaagctttggaccttaaaaaatcattcccttcctgatgcagtattttattagaagrtaggtgagttctgagtatttatagaatctgggttggtgttaaggcatctctgaagtctatacaaagtataagactgtatcttaacaaggactgtaraaactgctgaaagagcccttaaagtttacctaattctgcctctggtttcacaaataaagggtgctgaatccagaaaaatctttctcctggtaagaattcattgtatttttatgatatttatttcctggtttccctgtggttaataagctctaaaatgtcttaggatttttgtcactacggcttaatctaatagtagccttctttggcttcctaatgttgggtgtcctcgatattagatatatttcttgaagtaggatgtaaggcttacagtaaacttaactgcatttttctaaatcaagctgtctgacttggcctgtttagtgcttgtattgttgttttctttctgtgtaacaaattaccacaaatttagcagcttcgcacccatttgttagttcacatttcttaggttagaatgtgggcacagcatgactagtttgtctgctcaggatttaaactaaagactgaaaacacagtgttggctagactgcattcgcattaggagctcatgtttctaaactcacatgattgtggcacagctcacttgtgattggggctgagaactaaagactgaatttccttacttgatgtcagctaggagccactcccagctcctagagactacccacattccttgccacacagccccctcctccatcagaaacagcaatggaaaactccattatgttttatccctgtcacacttcaaatttcctttkccaggaaatttgtccctttggagggctcatctaatgaggttagccttattgaggaaaaatctctggaccttgaagtcagttgattaaggatcctgcaaaagcccttcgcagtagcacctagattagcatttgattgaataagtgggagaagatatgtttctatcagggtgatacaggacaggccagccccagaattgggacatagcctaggagggttctttgctacccccaggaaagaattcaagaacttgctgggggtgttagacagcaatcttttattgattggtactgcccgttgtggtgcagggctaactcataagcagtgcacccagagttggcaaggtgtgggcttttggcaactgtatttatactcacttatgcccactttcatttacatgcaaattaaagggtgagttaacacaaattgattctatgaaagggtaacttctgggtcactgccatggaaacgggtggtaacttttgagtcattgccatgacatttgtcaactgccatggttctggtggcagtgtcttakgccaatgagcattgagcgcagctagagatcgcttttgttgccatctgctggctttggccagtttcttcactttgccccatgtggactagatcctgttttgttcagcagagtttttcaccagaaaacaagtcttgttggtctcctaccttattcccccctcagagattagaaactcctccttaatcttaaagggctgcagatgggcacaggtctatcttctgtaagtgctttctgctgattttataaacataggctctgcctagcatgggaggagtaaaaatctctggatacctgatctaaggagcccaacagcaggatattttcattttctgggtcagaagataagatgagttggaagccttgtgccagcatcatctttatgttgactttagaagatacaaactttagtaggaggttaaacaagaaaattacaattataaggaagagaaaacttaatgctcctatgcccacccacagcatcacattatttatctgtgtgtttgtgaaataatagctttaagtcttctagaggtttgtaagttatggtgtcttcctcttatgcctgcagcgacttrcaagaaacaggtttaatcctggacagctgtatccagctagtgattctctaatgtttgacagcagtggaggtccttaacaatacctgataggggtccttccattttgggttgtaattgatcatcaggggatctttctttttaagttcttagtaagactaagtctggttaaacagaggaactatttttttctttgtgggaaacggcaacactttattttcataattttgaaaggccttttgaacctggcctaaattccaagagccggggtggcatagtgaagtctgtccaaccccctatttcccatcatggcttgaattagttttttaggtttctgtaggatttcctttggccggggaacgtgtaagtcaaaagacttatagccaattaaacattttaggccagagaggaatggaggtggcttaaaacattttaagcaatataggagtcaaatattaaaagccaaaaataagattatatatcaagaaaaaccaagagcatcaaatcaagctatactgggggaaaagtgttcctgtagatctctaaggcaaaacactctagtatcaggccataacagcagtcagaaccagaggagaaacaagtyacaggagctgacaaaaaagctaaaggaaagagttacacaaatctgagaagctttcaaaagaaataaatcacagaattgaaaaagcaaaaattctggtaagttagcaaattaataccttaagaaaagctggctctaacacctagaccattttctagaaagtctaccacgaacagttttccttcagtcacagccagcttaatcacacacaaaactcccctcacaaattccctttcacaaaccccattatcacccacacagaccatccatgacatgtctggaccttgtgacctgtcctacaccatctccctctcaaacaaccagttactttactctaggacaagaatccaccatgcaaggtccctcatacaaaatcactttctttatatccctccccmcaaaaaaaaaaaaaaaaaaaaaawatatatatatatrtatatgtgtgtgtgtgtgtatatatatatatatcttttatccacactttcctcacatccctctttttattcattgattccctcttattttgaaccatggcctaaatgtgctgtatatattctgtagttatggtggggaaagtgccttcagtatttagtgataattataaaaaagtttaatatttaattcatttctctttcaggtagaactccctgtggaacatgaattttttttaactatacttttgttactactcagatgatatatactgtatcaaaagtgtatgyccttgtcaagttctctaaagtttgtgaaatacaagagaatatgcagtaaaattttaagtctgtttcctttccagatactttttctctgaagaactactgtggaacattacttatattgtttaatagtactataaagttgtttccacacttgtatgattagcacgtaatgttcaaactgtgccatgaatgtgctggtagaaacaaaacagttttaaggacaattaaaacaacaacatcctgttatgaagtaaagacacagtttttaccatctttattgtctggaagaaactgtagtaggaataaaagaggcgacgaagagttaaagtacattttatgtttttaggctaaaactgattaaaaaaaaaagatcattgtagggtcaaagaaattgatatatatagtgtaattttggctacattaaatccaggcatttggccttttaaattagctagcatattttacaatcttgttgcctcttaccccacaacctctatgttatgatgattttaggttagtatgttaaaacaaggagaattcctggactgtcacaggagtgaaattgatatcattatgttacccatgtgttgtgcatatttagtgtctctttttgacagtatttcagtttcatgtcttctggggagactaaagccaaagtttcttggggattctggtgttttagcaaagacagtgagacacatagctcaagaactgcgttattttactccttgctatgtcacatttacatgtcagactcatttgctgtgatgtagcacactaggctggtgaaataattgcttgtgatgtccctaartccccgaggcttttttctacctcctgcttagatagtgaagagaagttgaagttgmgtcctctagtgttcattttgcgtaagagtgataggatgcggtaggacagatgaagattaatgagattgtgtgatatcaagtaggctcattgtctttagattgattgctgatggtctggatttgcttagcatcaggagagtttagaaacaaacaactaatttattaatgatgcccaaataatagttaaatgcccaaacttttggaatttatgttgttcattgttaacaactgctgtgtggcccctttagaagtgtccagtccatgacattttatacatttgtsttgaatcttaaggaaaacatgatcatgtcttctttctcgggtgataagcatgcctcaaaatagttttaattctgtgaatatctttgaattcagtttatttgggtacttttagtacggatacctactatataacaagctcctaataagaactattaaattataagcattatccctagcgtataaacctagttttcttgtagtaggaaatttgaaggacttcaaaaattttactttaagccatctatggaaaagattgcccaattgagaaaaattgtgaaagatatgtagaagtcttaaataattttggtttcaggattattttctattgttgtgttagactcatggaggtagtaaattggcattaatttyccttacagtttttctggaagaggaaatrtgcttaatgagctaaataagacataacattttgttttcttacattgttgcaaattgaagttgggttttgttgtttgtttgttttgagatgcaggtctggctgtkttgccaggctgaagtgcagtgtctattcacagatcattaagttgtgcagccttaaacctttggactcaagcaatctcctgcctcagcctcccaagtagctaagattataggtgtgcaccacagcatccagcttaaaatttagttttctagaaagttttatgacatggggaaaagttaattaacaatatttaggaatgtccacaaataaaaagctaaatatacgtatctttcgatattcaaatgactrgtattccaaaaataccctcagaagaaaggctacaaatgtttcttcattctccatttttcctagttataactattgctcttctaatattactcttcttagctaagtcagaactaaaaaaaaaaaagctgcaaggactaattgacattaatagttcaaatgaatcataattctttactttcccaaaagtatttaaggaatggatgcctattaatctttcacattgtttatcaaaatgatgtgaatagtctttggtgagccatattaagattaaagctggaaagcstcctgtacggttgttttccaatttcagctttgccatctttacacaaractctcataagtgtttttgttattgttgctggattcttcttttgtttgtttttaaaactccaggtgttttaacttctatgacagttattattcttatcttctatggcagccccttccaagttttggctttggggatagagaattgggagagatcagagaagagagactggtgagaggttgtatgcatatgtgggtcttacttcatttcgatgttcataagataaagacgctttatctcaagggttggcagaccatggcctttaggccaaacgtgacccaccaactggttttgcatatcccattgtctaagaatagtgtttacatatttaaatgattaggaaaatactttaaaagtggttttttgtgacatatgaaaattatatgaaattcagctttcagtcctcataaataaagctttattagaacacatccacactaatttgattatgttttgtctgttactccttttgcactactgtagtagagtagttacagtacagacttatggcctataaagcctaaattatatactctagacctttgcagaaaaagtttcctgactcttgatttgtccttgtaagtttttagaagattagtagcctttaatgtctgttgttcatatatgaacctcacgtttttgtttctttttaaaaaagattattttaattgacataaaaattgtatctgtttatagagtacaacatgttgttttgataattgtgtattcattgtggaatggctagatcaagctatttaacatgtgcattacttcacatacttcttatttttttgtgatgaggacacttaaaaccaactctcttagtaatttttaagtatacaatatattgttaacgatagtcaccctacagtacaatagacctcttgaacttatttctcctgtttaactgaaggtttgtatcctttgaccaatwtcttcccaactcccttagacctccaggccctgataaccaccattctactttctgcttttgtgagttcractttttaagactccacatataagcaagatcatgcactatttgcctttctttgtctggcttatttcacttagcataatgtcctccaggttgatccatattgtcacaaatgacaggatttccttttaataaaggttgaataggattaccttctgtatacataccacattttctttatccgcttattcttcgatgcatacttaggttgattccatgacttggatattgtgaataatgctgcagtgaacatggagtgcagatgtctcttggacatactgatttcatttcctttggatatatactcaatagtggaattgctggatcataagatagttttattttaaattttttaggaacttccacactattttctctaatatctgaagtaatttatgttcctaccaacagtgtacaaggggtctcttttctccacatcctcaccaacatttatctttcatgtttttgacaatagctattctaacaggtatgaaatggtatctcattgtggttttcattggcatttctctgatgattagtgatgttgagcacttaaaaaatatacctgttggctatttgtatgtcttctgagaaatgtctattcaggtcttttgcccattttttaatcargtcatttgttgctgttgagttccttataaattttggtattttagattttaacaccttatcaggtttggtttacaaacatattctctcattttataggttgtctcttcactatgttgaatgtttcctttgctgtgcagaggctttttagcttcatgtaatcccattagtctattttttcttttgttgtctgtgcttttgaggtcatgttcaaaaaattattgtccaggccagtgtcatggaacattttccctataacttctttcagtagtttttcagttttagctctttattcgtctttaattcattttgagttgaatgagccacagagtttttttttttaaagattgtttaaaatgtttaacacrtacgttttctgaagatacattataagtcgtatttgagtaaaaaatataatactgaacttaaataatagtagggaggctgaattaacttatttcaagcatacaccatcccctcttgaaagctctcttaatctttaattttttaaaatacattttcttccactaaatacttattttttccaactgactccckaaaactcataaatctacaattgttattacatgagtaatgtaaatatttattcatgccacctgaatcttaaagttccattggttattagctttttgtagttatgagttgtatgccctttttagtatttagcaacattgggattttcaggcttagatttctaaattttgaaagattctgtgtttagatatatttgtttagtaaataatatttgatgttgtcaacgtgaattgaagtatgtttaatattagagaaagtaataccataataaaatacatgttgctgtcaatacccaaggtctaaaagaaattkgktttttcaagactggagaggacatagaaggctccatggtctagatgacccatctgatacactgacacctgttgtaaaatcccaacccatcatttcttcatcctttgcttattcacccacactgatggggaactattaattcacgaaatagaccatttcatttttgtgtcagactattargaagttctttaatcygatgaacaagcagctgtttgtctccctaaaccctctatacctctacctgattttattccaaagtctgtaaagarcagtttttaatccttcttctatatggtgttcctttattttttaaaactgttagttatcttgtctttacactttatctcactaaccagtcttttgtttttcaggcttgacattttggattatttcatatgccattstttttccgtctaaagcattctcatctttttcttgtgaactatttgtcctttttgctctgaagttgtaacatccaccaacaaatatatattgattggttgtgttctatcagtacacaacttagtgagactcctgctgcctctaccctgaataccttgcttctcctaatgcattccaggattttgttagctttgttgtcagctgcacattgagattgctattgaataaagtcatcaggarcaacaacaaaggtgaaaagcccaggtctttcttcaaagtctgctaaataatagttttcacgccttgggcttgtgcagttaatttgatttaagtttcagcaactgaggcacaatatataccagatatagaagttatcctccaaaattagctcctctaagtttctcctacttttcacatgattcccagatattcttttctttaagtccaagtgatttcccaattatttccatggctatggctacaaaggctttaggccataggaatagaggaatttattcttactaaattcatcttattagatttgattaatcttcccaacttgtcaactgtgggatcttgtttctgtcattctctatgtatttctttattcattgatagcaaaggcactatatatcttaaataccaagaagaatttatatagctttctttttgaaaaattgtttaaagtatctagttcaagatccccaatctaggtgaacttcatggaacatttaattgacatggagataattaggggatgttctgaagagttaccaaagagaactcctaaagagaaactagatggttgagattatttatggaggaagaacagatgaaagtaaaattctgctattaagaatactatctgggtaaagaaatgctttctgctttctttggtggaaatagataagagtgagcagacttatattcattcattgaaattcagataaattcataaccaaagttttattatatatatactgataaggtgaagagttcaacactaatctagtttgaactccatagatatttaaaaccagctattttaatttcttttagctttaagacaatgctgaaatatgtacttaattttctgaatactttgctctttatagttgccgtttcatgaatttgtgatattagacttattgtatgaggagttttgtatttttcttctttgaactttttgcttatagtgctttgggcacagaccttcccaaaccttagtatttctggatgaattttttgagagtgcacaacattggaaaggagcttttgcataatgccagcaatgtagctgaggaaatgggtctggaggaaaatgagatttgacacctgtaacagaggataaatatgataggggccagagtgccttatacagagtgtgataggaaagctcaaaactaacagaaacaagcaatggaagagtaaaggcagacagatggttgcagagatcttagtttctgatgctagctgtgttattaacagactgtgtattatttgaaataatttatcctcactgagcatctgtttctgtacctgtgaaaaatgtactagataatctttgatatatcattcaagctctacaattatcttcttttgtgacacagagacagacaagaatagagattatcaatgttatataaaaggatgttacttaccaaacaagtttctgaggtttttgttttttgttttctgttttgtttctttttaggtaccaccttcccagactttcttgttactgtaacgtttatttcttcaaacagatcataaagcaagcagatattatccaggtgtgcaaaagtgattaaccatgtgattttcagaaaaaaaaaaaaaaaaagaaaaagcaatcaatcagcctttaaggctgttgttgtgtaataaaaaccttgcttgacagttgaagtacaccttaactttttcatttaaaatttattactctttgaaaaaggagaacttgttgagcagcatattttcttttttcacagatgtctgattagcctgcaatattttggttctatttaatatacttttaactattttttaatgaatatgaatgtaaaaataatgttgagttagaatagaaatatctaactgtatgattaaagttgaatcacttataaattkgaaaaagcttcttgtcttctattgttaatgctcctagaatctcatgtttgagaacgaatgttcagtgtagccaaaacctaaatctgggrctatatgttgaatgttttaaagtcactagtagaagggcaatttggtggctaattttaaagtacataaagagtattaacaataatgaagtgtcattttgttcctggcattctgtgtgtgtgtgtgtgtgtgtgtgtgtgtgtgtgtgtgtgtggtgtcaaaaaagtatctgaaggggcctgtaatagaaaacctagttcctttatgatatacacaatctagcttgaaattttratgcattaaattcataaaacatgaagagtttaagctttgcaacacttaattgacacatgcgtcagaataagtttggaaaaaaatgaaccttcatacattttgacttctctgttttctatttgataactttggtattgcagttactcttttttgacacaagatggtgatgttcacctgaaatgtttcctgagtacaggctctactgcgtttagaggctcccccttatttatccaaagagcagcttaaagaaatgaatgaaactggctttgctttaagagataatagttgaagaaaagcaagagagtgtgtcctcttttataactgatttaacaaataatgattcaaatttaagtgtgggtttgtgtgagttgaggactggggagcggagagcactgggaaaaaggaaagttgaacagtggagaattagcagtcattaggtatgcagtatgcattaagtctatgctatgtgttttacatatgatgtctagttaattttagtcaaatatgagcactttacatgtattttacacaayactagtgcattccttgtttaattgtgcaagtttaraagtacggtgtgtgtttgttctttcttaaaaaaattatgacgtatcatcagccagtgtagtagctttattcataatttaagtgatactgtttcatttttaaaaatacacaagtttcttacatatagttaaatatatatttaacatagtatccgacaatctcagtcctaggtatttacccaagaaaaatgaataaattgtccagcaaagacctgtttgtaatgtttatagcaactttatttataacacctaaacaacccaaatgtctacctacgtgaatgaataaataagttgcaacatgtccatayrgtgaaatactactcagtcatgaaaaggaacaaattattgatatatgcaaagatggataaatttcaaaagcattatgctaagtaaaaatagtcagatataaaagactatacactatactgacattgtgaggattgcagggacagaaatcagttcggggatctgagggaggaaatttcaccacagagcagcaatgggaaactttttggaatgatgtagatattctrtatcttggctgtagtggtgattacaggactgcatatacagggatacctcgttatattgtggtttattgcactttgcaagtagtgtattttttataaattgagtatttgtggtaaccctgcaagtccattggtgccatttttccaacagcatattctcacttcacattttggtgatttttgtaatatttcaatcttcctcattattattattatgttatcttgatctgagatcagtgatatttaacattattattgtaattgttttaggacaccataaaccacacccatgtaagacarcaaacctaataaataaacgttttgtgttctggttgctccaacagccagccatttttctgtctcttttcctctctttgggcctccctactccctgagacacaacagtactgaaattatgccaaagaataaccctacaatgatttccagatgttcagattaaaggtagagtctcacatctgtcacattaatcaaatgctagaaatgattaagtttcatgagaatggcatgtcaaaagctgagagaggccaaaagctaggcctctttcaccaaatgtttagccaagttgtaaatgctaaggaaaagttcttgaaggaaattaaaagtgctacttcagtgaacacrtgaatgataagaaagcaaaacagccttattactgatatggagaaagttttagtgatctggatagaagatcaaaccaactacagcattctcttaagccaaagcctaatccagagcaaagccctaatgctcttcaattctgtgaaggcggagaaaggtcaggaarctgcagaagaaaagttggcagctagcagaacttgggtcattaagtttaaggaaagaagctatctgcataacataaaaatgtaaagtgaagcagcaagtgctgatgtagaagccgtagccagttatacagaaaatctagctaagataattaatgaaggtggttaactaaacaacagatttttaatgtagcaaaaacagccttatattagaagaagatggtaatctaggactttcatagctagagaagagaaattaatgcctggcttcacgcttcaaaggatagggtgactctgttgttaggggctaatgcagctggtgactacgtggaagccagtgctcatttaccattctgaaaatcctagggttctgaacagttatgttaagtctactctgcctgtgctcgatcaatggaaaaacaaagcctggttgacagcacatctgtttacggcacagttttctcaatatttgaagctcactgtcgatacctattgctgaggaaaaaaaaagattccttttgagatgttactgttcattgacaatgcacatggttactcaaggctctgatggaaatgcacaaggagaattaaygtttttgtgtctgctaaaacagtatctattctgcagcctatggatgaaggagtaataytgactttcaagtcttatgatataagaaatacgtttcttaaggctattgctgctgtaatagtagatatgggcaaagtaaacctccttgaaaggagtcaccattctagatgccatgaagatcattcatgatttatgggaggaggtgaaaatacgtcaactttaacaggagtctagaagaagttgattccagccctcagggataattttgagggcttcaagacatcagtggaggaagtaactacagataaggtagatacagcaaaagagctagaattagaagtggagtgtgaagttgggactgaattgctgcaatctcatgaacaaattagaatggatgaggagttatttsttatggctgagcaaataaagtgatttcttgagatggaatctactggtgaagatgctgtgaatattgttgaaatggtaactgaggatttagtatatcgtgtaagtttagttgttaaaacagcagggtttgagaggattgactccatctttaaaagaagttctactgtggtttaccctatcaaatagcattacatgctacaaagatatctttcatgaaaggaagagtcagtygatgtggcatactttattgttgtctttttttttagaaattgccacagccaccccagcctgcagcaactaccaccctgatcagttagctgtcatcaacatcaaggcaagactttccaccagcaaaaagattataacttgctgaaggcttagataatcatttgcatttttagcaataaaggatttttaaattaaggtatatatatttttcccccatacatattggtattgcatacttagtagactatcatatactgtaaacatagcttttatatatattggtaaattagaaattcttgtcacttgctttattgtgatattagctttattgcaatattagctttattgtagtggtctggaactgaacctgcagtatcttggaggtatgcctgtatttgtcagaacccttctagctgtaaaagtaaagagattgaattttacaatatgtggggtatacccaaaccaccctaaaaaaaattgtttaattcggaacacaaaggaaaatgtcagctttatacttcagcaacagtttcttttcacttggaggtaaggcctcctgcttctccgctcttttaccaacctttgactatcttttacaacccatttacacagacctgcattgttattgcctcagtgggctcagaactacctcagcaaagaaggggacttggagtgttgcttcaccagctggaaacctccatggccagtggctccttctgcctgagtactgctcgcacccactgagcttgttctgcccactcagcccagcaggctgcactctgctystgctactggccttaatcccacacctgccaagggcgagcgaggcgtggagcggtgagggttgtgtgggcaagtgagcccaggttcctgccactatgcacagtcaggcacacaagctgctgcatggggtgggcagctccasrcactgataacaggtgctggctccatgcaaggctgtggctggaccagatgtactgcacacatcttccactctgtgcacccgtgactggacgaggggaacacagtggtgcccagaagcttggagaagccaggaaccagagccccaaagagggtgtcacagccctgcctcagggagcccctaggtctgggctccccagagggctgcaactcttctccttctcatcaccctcaatgtggcaagtcagggttgggggtgtttttcagctttstttgtgttactgctctttcagtccctccrtttggtgggtcctgagttcttgtcccgtgtccaggaccagtgaggtatgtggacaactggagggtgagcaaggtggaaaggactttaattgaacaacagaacagctctcaggagacccaacataggtagctcctttctgcagctagtagtcctgaagtctctccaagtctggctgagtccaggggattttatgggctcagaagggacagagtgcatgctgattggtccatgggtggccatgggcaggcccagtgaaagcaccctaagttctcactctgggccgaggtctccacatggaactggcagcccagcccccaggcttcaggctgtccatgtcttgaaggtggggtttcaccagggacccayccctttgcacccaggagcctgtctgccttctgtcaccaggaatgtgccatccatggcccccaggctgtttgtgccaaggagtgcctgaagccctatggcaaaccaccctcagccctcctcagcctccctcccatgctcaccagtgcccaaagtccagaggggttcaaggtggctgggggctggcatctcagtgtctccctgagcacaggcacacccagttgagttgtgacagcacccaggcttggccacaactttgctctgcccagagcctgcgccacaatcggagtggccagggagcaggagcagtcacttctgagcctgcaggggcaggagggcttcccaggcccccaagaacacaaggatgcctgggtgcagagtcacggctggacaactgcagtgagccccgccctcccaactcagtaggggccagggctcctgcccgttcgcagccttgacggcttggcagagcttgcaactctagccgcacctacccagtrcagcgggcgtcctcacagccgcgctccagacgggccgctgctgccatcattactcccaagtttcgggtcagaaataagtagaattttagtgctggagagattcttagagaatttgatttcttaataaaaatttggctaactagatattttacatgtaaatcttttagagaatttattcagcaacaaaaatcagttatgtgtrtattgacagtttctaatctaattttcataaatataactaaaattatgaaaatgtacttaaaaaaaaaagctagattatactcctgtctcctagaagggacagtgcaggtaaaccagaccagtgccttgtatcaataattatgtttcataccaagtaataatgtttacctttttgttatgccagtacaatttatggcctaaaagttacatgttgtttctgtttacatcaagatatttgatgacagacttagtcagaggtatgttttgttatgaaaaagacaatgataagccagttgtaaaacgagtgccttttggaaatcttgattccggaacttttttttttgtattagagtacaaaaaagaatatttgtcataggattttataaaagtatagtatattctatctaagtagaaagttgaagaaaatagaatgctaatgttggagaaggtgagcaaaattatatttttatgaatgtttaggatattttgggaatttctaagagttcagcctctttaattctatagtttggggcttaacgcatttttttttaaatatgtgtgtttttttagaggctagtagaggcctgacattttgagtttaacaactttataaggtttattcttaaattctgtatcagacttaatgtctttgaattgtgtatttaataatttgatgtccttttgctactgcatttataaaccagaattcagtctttgatgattgcattatattactaagtgatttgggtaaagacagaggggaaaaagagaaagagggaagatggaggagggtagagggaggttgaagtggtatatgtgtgtcggttgttgtatttatgttttatctttgcttgttagacaattagaattgaagttaaacactaggaaatagatgataagtttatctctatactcccaggaaaatttaacattagaattaaggcatttagctaaactaagccaagattggaaaactactgtgctctatgcctgtgtttagaaataaagttttattggaacacagccacattcattttttttctcttgtgagtgctttcacactgcaatgggagagttgaatagtgctatatagacggtatggctgacaagctgaaaatgtgtaccatctggccctttattactaattataatatggcttatagaaaggtattagtaattgttagaactaagaaatactcatatgatagatctctcttatctgaagcaataataatattgagcctcataggaaaagattatatcaatcatctgacactgtaggtgctccaacccattttctcactctgattctccatacctccttttatgctactcagctgtttttttctgagtgcttattagtgtagtgtagtgaatattattaccacatagtttacttatacacagtatttattattgtctgtctcccattgctctaatgcaagggaagcatttttgtctattttgagcaaggatttttgtcgtatttactggtatattcaggtacctggaacacatagtagcagttagtatgaaataaacctgccttcttattaactatattaatcaatttagaaagcatcagcttttcacttgctggctatattttgctaattcaaaatgcaaataatttgctgagctaaattgkatatcttttaatttgttttctctgttcttcattgagaaagttagtattttctgtttttaacttctcactttagctacatgtagttttttcttgggggtgataygtgtttagtagaaggtagttcagtaatatatttactgaatagcaaaacgaacactaagattaaagctcatgttaactactctgatggccttgaggaagtaatgctgagagtttaatcaccattaagtaattaagaataatttctcataaaagttctcttccttccagttatattcatgactgtgttttggtgatagttgattgccctgcttacatagttgcaaaattggtaaggagaacagtattctgcagccaagtttccatgagttgatatttcacattcacatttgtgacctaaacctgtattctggcagacagtgagaaaagccaaatgttctcgtaagcagcaaggattttcttcatggaaaacaaagaagtaaaaatgtaatccaagcaaaactatcatgtatatactgaattttataggtatatctacagaaaattaatatttgcttttatgcattttattacaagtttattttgttaggtattatatttgaagtaaaaaataaaatacaaaattgaatacataaagggaaatcagaaaaacccagaaatattactctaagataataacaattattaccacttttatttgagcacatgcactataccaggcacagcacaccgtgctttatgtayataatctgtaactctcctgacaaccctgcaaagtagtacctctgtttacattttgaagatgagaaaattactgctcaaagagattaaatagcttgccatgattcaggaactagtaagtaatgaaggcagtattgtaaggcaggactttctgtctccccagataccttattctttatcccgtagcatgtcatttttctccagtattgtcatgatgtgtcatcagatgactatactttttatccatactttatttaaaaattttatgtgttagaaaacttatactctagacatttaaaatttaaattttcataacatagtatgcttctgaawaacctgagaagaatgttacacaaaaggagatggcttgctgattccgtggagtaataaatgcctacctgttttcattttgaagttgaagccattgcttctaattttaagccaacctgtatttttttttcattttacctttcacatcttcataacatgtatttggccttatatagctgtgaaaattgattgtacaaattggtttgagcatatgagacctatgaacacttgtattctgacttagcatagagttttatattttctgagtagcatagacccatatatttttggacacccctcgtattttacatttaatagaatgatgaacatgattcattaagcctttctttgatgaaagacagaaaccacagagcaatgaagatattggcatttctgataaagtttgtatattaaagtcttatggtagcctatgaaaaagagcttgtttggaaaaattgagagattcaagttttgtattatacttaagttttgtcacttcatcaaatgcctccctttctatgtcttatcatgaatttatttttttccctttaatagtagatcaaatatagatagccaggaaagagtaaaaggtcagttatggtamtatagtgaagatgtttcattcatactttaatattatacaagtattagttttgtattawacttcttcttcttcttcttcttcttattcttattattattattattttgagacagagactcaccctgtcgcccaggatggggtgcaatggcatgatctctgctcattgcaacttctgccttctgggttcaagtcattcttctgcctcagccttctgagtagctgggattacaggcatgtgccaatttttgtatttttgtgaagacagggtttcaccatgttggccaggctggtcttgaactcctgacctcaggtgatccgcctgcctcagcctcccaaagtgctgggattacaggtgtgagccaccgcacccagctatacttactattttagaagaactttatgaacactattaataataaaattgctttaaattattatctattgagtgaatgaatggctggctgactgaatgaatgcatacattcagaactctggactccaaaatcttttagagtctccctttgagtggaaactactcttccttgattttggaaatgttaaattaaaagatagcttaatattggtgttgctcctttctataattgtcaaaaagaagttatagtgtcctcataaagacaaataaggagataaagaaaaacaaaaataattgagttaaattgttaatttttgtttgttttatgtgatcctcagattcttgggattaaaattcaagcagggatgcagtcttcttttgagttacatgttagagtctgtgacattagcattctctatctcaagcagaaatgctaccaaaatggttcttgatttaaggatgtgatttcttttatagtcagtatttttaacatatcacatttgagtcttttaaaacttaactgcttccttctttcacatatcagtttctmttccatcagagagaatagtgatatggaatcattttgtctgaatggttggctaaaagtacatacygtagaaggtagaaacttaaatacaggataatgaattttttttatatctgattcccattagcattgacattttttttttctgtttccagaccataaaagcttcttccaaaagtatccacaggcacagaagctctgtttagatttttcctatgtgctttcttttcttgatattttgatttttttccaaaatgagtttgctgtttacttttgatgaagtaaatatctatataaaatctgaagatttttatttcttggatttggagggcaatttgaacattagattttaaaggcttatacttaagatgaccattagtagttaaatctggtttataactaatctagtgtaatttaattaatagaggttagtgtggagtcattcatatatttatatttcctgtttcatatgtttataaatatttgatgagtatcattggctttttttctccaatgtgtttggattcaaggaattaagggtctgtataaatacttatttttctgtgtgtgcattttcttgtgtttattttcattggttttgagtttgacttaatatacacatgtgcatttaaaaagatgatctttccaaaagctttgcttgggatctttgctaggaggatgagttaatggatggagagggctgcttgctttactgtttattttcccagacaaatccatggagacaggctgctaataggataggagaaaaacaacaaaaacaaatacagctttttggcctggaactgaattgtattatctgtactgtcagttagagcctttgctcacttacccagacgatctctacagggattaaagcttcctcctgcatttgcgataactttcagtatgctgcagcgtcatatccagttaatattaaaaaaaaaaatctggctgtaaatagttacaaaatcctcaccaaatcaacctttagcaagagtgattgtgctgattaatcaaacaagattgtcagtaattaaaggaatacagatgacttggattttattttcagttttcatatgtaaattcttgcagcccttccccaaggttgggcctgattttgttatgggatctttgggctgttgcttttctgaccagcaacctctgtggccagtggcgcctttgcctgagttcttgtcctgcatctaggaagaatgaggtacatagacaagtggagggtgagcaagacaaagaggagctttattgagttagaaaagctcagaagaggcctgcagtgagtagctcctttctgtaggcaggtcatctcgttgagtgttgagctctcagcagagaggaggcctggagtgggtggctcctctctgcaggcaggttgtccygacgaatgttcagctcttagcagagagggtagctcctctctgctgctggtcatcctgttgtctgcagctctyagcagagaggaggccctgaagagggtagactcctctctgatgttgatcatcctgacctcagcagctctcagcagagagggtagctcctctctgcagycggtccctccactggstctgctctgctctggctgagtccagggcttttatgagcctcagargggaggaagtgcatgccgattggtccatgggcctgcggtaaaggcaccacaagtccccactctggtccgcagggctggcagcctggcccccagccttcaggcctgccctgttytgaagatgaggcctcaccagggacctgccctgccccttcccacccaggaacctgtctgcatcctgctgctgcccatcacacccaggctgctcacacccgtgccaaggagcacccacaggccagcccagagcctcattcagctccatcttggcctccctctcctacttggcatccatagtccagaagggccaaggtggcaggaggctggtgtgtcagtgctgcctggagcagcacacacctggctgggccacaacaacgctgggaccaggaagaggccaggcaatgggagcagatacccctgagtctgctgatgatgggggacccacctgggtactcgagagcaccaggagacccaggcccacagccacaacccaggcagctgcagctgtgcctggggagctctcaccctaccaactcataaggggcagagctcccgccagtccctggctctgcagagtgtgcagcattgactgtgctgccttctctgcatctcccacagtggtggcaggtgaggtgcaggtggcatagtggccctggccaacccagcacaaacaaacccgatgctcccagggctagtcctgtgagtcccagtggcagcacctttggccaggtgcttgtgggctttcaagacatggtggggcgcgaggttgaggctgcaatggcggctccgaacttagtagcaggtcctgctacctgtgcgagggtggaggtggcacagtccaccttgaggacaygggacacaggagactgttgccactgctgctctcacagttgcttctgctatcctgtctgcctccttgcagcctggagcagggctccaggccatcgctgggctgggctgccgtccaaggcaaggatgacattgccgcaagttccccctgtggacccggctctcggtggcagcctggggctcctcctcgcacagcttgagaccctgccggggggcacctctggggcrgatcgcgggccccaaacccagttgtcgggagcgccaggctgaacagtcactccgacgtggggtggatcctggggttgcagcgtcggtggcccgggctgagcctccagctgaggtgcaggaacttggagccgccagcagggtgggtgcggcgacagagtcgcttgccaggtctgggaagcgggcgccactcccgctttccaccccacacccctgaagtacggccccactgtgcgttcaggcccacctcccttcactctgtgcgcaactgcagcacccctgggtccaactctgccttgagacccctccatgccagaccgtgctcttcccccgcctgcaggtaggtcrgcccggccccacctgagtggatcccagggttgggcttccagggcagcaggccccaggtaccgttcgccttggagtccacctgaggatccacagcctgcamccccacctgcacccacacccgtgccccaccacagccggtcccggctgccaaagtggcagtgactactttggatggcccgctgctgccatcaatttgaatggtttatattttgccgtccttgttgagaagaaaaacatggatgtatagatatacagtgatggatggactagcagcttaagaatcattttggggacattttwwaaaaaattttttgagacagagtcttgttccatctcccaggctggagttcagtggggcaatcgtggctcactgcagccttgacctcatgggctcaggtgatcctcctgccttagccacccaagtagctgggactacaggcgggtgccaccactcccagctaatatttaaatttttatagagacagggtcttgctttgttgtgcaagctggtctccaactcccrggctctcacagtcctcctggcttgacctcccaaagtgccaccacacccaggctattttgaggacgtttctcttttcagaaaagttataagtattttgaccctgcatgaaagtttggaatgatggaatcatataaacaaaaacaacagaaagcctcaaaagatttttttaaaccaaacaaaaattattggaaccagcttttacctcaagcagtgaatgagctacacagaaagttgatttttcttttattaatgattgctagtaatgagaattttacactttattcttctcaacctccctccaggtcagttttggttgttacagctggaggaatgatactggcatccagtgggtagaggtcagggatgttaccagacatcctataatgcacaggaaaaccctccctgacccacaatgaaacattgttagcccaagtaatgctgagattgagaaaccctgctgtaaagtgtggatttttatcttgatgggagtttttccaaatagctacattgatgtttacaatgctttataaataaagggaagttttgttctgtttgtttgaattactaataagagataaaagaggctttagagacagattttgggatttatagatgcaataaacacataaacacagtcttcgaaaaatgttcatggagacaatatggtgatcttgtgatacagggaaatggaaaacattttattatagaagaacatgagaaatttgtattattttttactctttcatggacatgaaatgaaacttctactttgtaggtgttggtgttgtacagaattatttctatatttgtgaattaaatcatataataaagtaattgcaatatccaaaaatcaattatcttggtagaatattcaagagcctgaagctctggattcacttcccatttgtgactaaagttaatttatttaatgtccaagcctcagttaacacatctgaaaagtaaggtagtttttataaacttgtcagatgggcattagttaatttgtatttgataatttgtattgacactaaactgttatcagatgttaaaagaactgttcagtctttgattgctgaacttcagtgtaaggagtaggtatttctttgttcatttcataaaggagctcttgaacctccgttttcaagcattgtctgctcagtcacaataatttgcagtggaaggatgtatatgtaaccacacatgtgtaaacacatacacacctagtgacttgatggtagagaagttaaggatttacaaaatgtgtttacattgctttccagagattgaggttgaggtttttggaacctggcatactgatagtacccattatggaaccataatcatgtggagttagcatacgagatagagcatataacctataaacatatttaatgatactcatctattgtgctacaacagaaacagacattggagagtaaatgtaaatgatcttattcccactcttaaaaatttgcagttgattttattttttaaatgattatgttgtctgccatactacccacagtccattaactaactgaatgcatgttgtcgaaaaagttctactttctgtaaaggaggagagggagaaaaaaaaaatgcaggttggagtcacaaatcatagcaagtcactttacctttgcttccatgtttaagaaggtgtctctttggtggagacagatgagatctgtattctgtcaccaccaaaagtccttggggttatttttttaattttttttttttaactaagggaccagccagggctacgcaactaatatagagaaaaattcagacaagaaattagatctcagatggaggtggaaactgcaaagtttgatcatcttttagagattgcagtgtataaaataaattgtttcacttataaatggaagcaaagcaataaacttcatgttattctatatacaactttaattactgtttcattttttaaaagatattttgttaagatggtattttgaattggtaacatatgtatataattcagagatcaaaactgtatggaaagatatacatgctcatwccttgttccttctaccactgtaccccaacctttccaccttacttttattagtctcttgtttcttcttccaattttttaacacaaacaaaaawtatgcaaatatatatgcaaatataaatatatgtttatgtgtgtgtatatataatatatattatatataattatattatatataatatatatattatattatatatattatatatatatatatatgttttcaatacccatttctcccagttatatacaatgcaggaaactatgtatacccttcagtactttgcttttttgatttagctctgtttcttgcagatctttttctctcagtaaatgggcattttcctcatccttttgwaggatrcatggatgaagaactaccatagttattcaaccagtgccttattttatggattcttaggctattgtcagtcttttgccactattaacagtactacaaagagtaatcttgtccaggtgtcattttgtacttgtgctggtttgttgtaaaagtgggattgttgtgttatgggtaaatacatttgtaattttgttagatattatcgtatttccttttatggtgattctaccattttttactttcaccagtaattttgaatgtgtcggggtttccaggttggtatcagtagttagtagttaatttaaaagggtaagtaaataatcatttaatgttttatatttatgtttaatgattttaacataaaacataaatatacattgatttcatttgtcttagggcaaataattttttaagaatagtctgctcattggagctctgtaatacctcttttctaaaccatattttattaattttagtgtttggcatctatcaagtagagtgataacttaagatactctgaggtaccttgagtatccccattcatctacagctgttctgccaaaccaaattaacagttgagagttactcatctttattgaatctttcctatttaggtttttttttctaaaaaataatatatttatttgaatcacataatttcaatgtcaagtaattgttaaactagaattttggaatcagtattttttactcatgttttgtttaccggtaagtcaccttgcttattacagtgtctcaacgtattaagtgttyagtaaattttcattgaatggaatagaaggaaaagaggtagtatggaaatagactcaactgattstaattatgcacccaaaacaagaaagcaaaggttacgagagcaggaggagggtgcgcatagcagagggccttcttatcagccaggatatttaacctcccatggctgaagagtctaggaagtgacatattttgctttccagtctcctaactttctcttcttagacatacaaaatttatatcaaatagagacagtgtgggtccatctttttccctcattttgctgtcattttcaaacttgtttattctggaaaattataacatgtcttgccaaaattgattggctagatgtgctgcaacttacagagctttagaccagttataatgatgaaggttcagtttagatagtaatgtgctttgaggcaataattatgggatatttccttgtagtgaccagtaatttttatgtcttctgtattagtccattctcacattgctaataaagacatacctgaggctgggtaatttataaaggaaagaggtttaattgacttacagtttagcatggctgagcaggcctaaggaaacttaacaatcatggcggaaggcacctcttcacagggctgaagagagagaatgagtgcaagcaggggtaataccataaacttataaaaccatcagatctcatgagaactcactgactatcatgagaacagcatgggggaagctgcccccatgatgcaattacttccatgatgtgggaattacggagattacaattcaagatgagatttgggtgtggacacaaccaaaccatatcatcttccaaacagaatttatcatcaacactgacragccatttcagttttatcttaattattgcaaggactggtcaagagaacgtgtttggaaattggaaattaatcatctatgttgaggaaataatttataacatttgagtttctcyggtgaatcattaacatagtttccatatttaaatttctgccattatattttttcacattgtctgtcttctttccaaataacttctcagagaaactcttagaaaaagcagtaataattaagggctaaaaaaaagagcttcagtgcacttgtgacatcattttatccgttataattaaccattaaaaattagttaatattagttacctaactaaagttagttaatataatatcattatgtgtgctgcatcatctatgtgcccttctggcaagactgagttttggtgagtgagggttgttactgcagtcacattctagacacagtcatgtgctgcgtaaccatgttttggtcaacatcagactgcatgtacaaatgtgtcccataagattataatggagctgaaaaattcctatggcttagtaacactgtagccatcataatgtcataaccattatgatgtggtagcatagtgcattactcttgtggcaatgctggtgtaaacaaacctgctgtgctattagtcatataaaagtatagcacattccatttgtatagtacatcatacttgataataaacaactgtgttacaggcttatgtattacctrtactatacatttttatcattgtagtgtgtactctgcttataaaaaaaaattaactgtaaaacagcctcaggcaggtcctacaggggatattccataaagaaggccttgtaaacgtacgagatgacagcttcatgcatattattgcccttgaatacctttcagggaaataagatgtagaggtggaagacagtgatattgatgatcctgacctacgggcctaggctaatatatgtgtttgtgtcttcgtttttarcaaaaaagtttaaaaagtaaaataataaataaaatttaaaaataggaaaaagcctataggataaggatataaagaagaaaatatttttgtgcagctgtataacatgttgttttaacctaagtgttattataagagtcaaaaagttaaaaaaaaaaaaawaaataaaaaatttataaagtaagttacagattaattcctgaagaaagaaaagttttaaaataagtttagcatagtcttattgtaccgtgtttattataaaatctatagtagtgtacagtaatgtcctgggccttcacattcactctttgctcacccagagcaaagagtttactcactgactcacccagagcaacttccagtcctgcaagtaccattgctggtaagtgccctatacaggcataccgttttttaatctcttatacattatttttactgtgcctgctctttgtttagatatgtttagacacaaataccattgtgttacagttgcctacagtgttgaatacagtaacatgctgtacaggtttgtagcctaaaagcaacaggctatatcatatggcctgggtagactataccatctaggtttgtgtaagtacactctgtgatgtttgcacaatgacaaaatcacttaaggatgcacttctcagaacatatccccattgttaagtgacacatgactgtattttgttctgtaactttcttggccaaatgtactattttgagtcaaattccatagacctttttgtttcctcttgaagtataatgaaccttttccttttaacttataaaaagatgagtgtattcaagattgattgttcagaaactttgtctgggcagatttgactttttattttaaattagctttgtcacaaggatattatcaccttatgtcttgaaaccctgacccagccctcattgcactctcccaatttccctgctggattttgtttgattatttgttgttttgctgcctcaccgatttacacatatcaccctgtagtttcaatatgtaaattcaaaacttacctgttttgctatctaggataatatttagataatcagttatgttgatgagaaagagatagatttgttctgagatacttaaatttattttaactgttctctccccagatatacagatactcctcaacttacaatggagttccttcctgttaaaggtatcttaagttgaaaatatcataagtcaaaaatggatttaaaacacctaacctaccaaacatcacaatttagcgtagcttaccttatatgtgctcaacacttacattagccttcagttgggcaaaatmgcctaacataaaacctgttttataataaactattgaatatattatgtaattaattgaatactgtactgaaagtgaaaaacagaatggttgtatgggtactcaaagtaaggtttcttctgaacatgtatcactttcacactatcataaagctgaaaactccaaagtcaaatcattgtaagtcagggactgttcattacttttgttttctaatgcagtggtaattaatgaaggaaaataccagaaattgacagtgtattgataaactgttctttctattcatagggctatctttttgcctttatactaatctcctttaataaatggaatagaaaactacttttttttttggccatgtcatctgtttttttgttttttttttttgacagcatattaggttgtggatagtatttggaaatccacatctgctctttatccacatgtgtttatcctacttgcagtgtagataaaaatgtgctttgtattttagattaaaaattgtgttttccattattttatcaattttcctttctgaaaattgaccttttaactttgtatttttgcagggaaagcttttgtcagaggaacttttattattgtttttcaaaaggcagttgcctcaagaaaatctattttactttagtatgaaagtggaaaactgacatttaattgcacaagctgtttaaaaatcataaaatataactactgctataaaaatgtgttcatataagagactagaggataatattcagagcataaaacaatggttggagatccacagrcaaccaacactggtagtcaaatagtgattaaattcttgataagtcttgctgcttttttttctgaaattttatttaataatatcatataatgtttttcatttgaaaaggaaaaagatgttatcaagttcctgcctatttaactttagagagaacttagtttggtttattmagttagacatgtagtcagtgtagcactttaatcttttaactttaccactttaattattttacaaatacaagttcttgatgatcttttatgtttttctaggaaatattagtgataacatctcatatcaatttttttgtaacattcagaatgtgtagtcatgaagaagaacagggcttacctcaaaatatctggtatactctgcaataaaagtatcatcactggccatcagagaaatgcaaatcaaaaccacaatgagatatcatctcacaccagttagaatggcgatcattaaaaagtcaggaaacggccgggcgcggtggctcacgcctgtaatcccagcactttgggaggccgagacgggyggatcacgaggtcaggagatcgagaccatcctggctaacacggtgaaaccccgtctctactaaaaaaaaaaatacaaaaattagccgggcatggtggcgcgcrcctgtagtcccagctacacgggaggctgaggcaggagaatggcgtgaacccgggaggcggagcttgcagtgagtcgagatcrcgccactgcactccagcctgggcgacagagtgaaactccgtctcaaaaaaaaaaaaaaaaaaaaaaaaagtcaggaaacaacaggtgctggagaggatgtggagaaataggaacacttttacactgttgttgggactgtaaactagttcaaccattgtggaagacagtgtggcaattcctcaaggatctagaactagaaatgccatttgacccagccattccattactgggtatatacccaaacgattataaatcatgctgctataaagacacatgcacacgtatgtttattgcagcactgttcacaatagcaaagacttggaaccaacccaaatgtccatcagtgatagactggattaagaaaatgtggcacatatayaccatggaatactatgcagccataaaaaatgatgagttcatgtcctttgtagggacatggataaaactggaaaccawcattctcagcaagctattgcaaggacaaaaaaccaaacacctcatgttctaactcataggtgggaattgaacmatgagaacacttgaacacaggaaggggaacaycacataccagggcctgttgtggggtgtggggagaggggagggatagcattaggagatatacgtaatgtaaatgacgagttaatggtatagcacaccaacatggcacatgtatacatgtgtaacaaacctgcacgttgtgcacatgtaccctggaacttaaagtattaaaaaaacaacaacaaaaaaaaccatgttcttattggaccactgcatacctgacatgtatttcattatttggtgaatatgaactttaagaggaaatttctttattatgaagttttttaaaactgaaattacagtgtcacaaaatagttaacttgggtcagaggcattccaaatgatttgctctgtaagtgaatgaatgaattgaaatctaacttcgagtattatacttcttttgacagaaattattttacaaagaaaatgtaacataaaattaagaaattattatttctctggttttgtttggcgattctaaaacaatcaccaggaaacatattacttttccatgagttcttacgaacacctttaccttgggtatatgaaaatggcctgctcttgagttggatgctttattccagatgtgttcacataaacaaagtatggaaagtctatacttgtatgtataggaaacaatgggtcagctttgaaattttttatgaaatgtacatagatttttctagacacgtacagaaaaatgagaagtcgtgtctagatggagccatctcttgagactggacatctccagtagaaatttgacttctagctagaaagacagtatcaaattgttctcaaatattaatttatcattcttctttcagggcttccagatgagcttggaaactgatttacagagataattaagaccatttgccatgaacttccttatgtatccccatcattaacaagacatarcttggctctattattatctgctgctcctttcctacactgtcagagaaggacattttttgcctaaagttaattgttccatctagtttctgtagctcatctcaattttaaaaattttagctccctagtttctcctcacagaccaaatatattaaaagtgaacttgtgaaagtcaccagtgactactgaacaaaatttaatggtttcctttcttactgtgttcaattccataaattttatcctgctgagtacctgtatcttgaaaccctgtaccctattagctttgatgacatgacacttttcccttctgctgactctgagtctagtactcttttatttcagtggaatttaataatcaccttaatatggcaaatatttaaacaaaaatctgaatccagtccagcctccggttttgttttataattcaaaatttgaaatctcaattattttatctcaatttcttttttctgctctattaccattactcttctggttgagttatttcctttattactgccattgcctcttgactcgtttctctgccttcagtctctttctccaccatttcatattcattctgttttatagtattcttcctaaaggagtgatatactgttaaggaacatacagggactccttgtttgcctcatcaagtccagctcttcattctggctttttcactttgcaaaagttgcccataccccatgcagcatcttaccattatagtattttctgttttcactgaacatttaccttttatcttggcaattatgtcttctggtagtcatgtgatatgcacgtactattatacattcattattttctccaggcttttgcttattttgtctcctcctctttcatctaaaaccatgctcattacttttccttgactgcctgtcttaacagccttttccatgaattttttatttttgaggttttgtttagtttttactaaattggctctacaaatcttttttctctagcttacttgtcttctgtaccacctagcttagttcttgatgttctctaatagttcrtgtgttccaggtttttcctgtctttctaataacatgtaagtatcttgaggtcagagagattgatacagtttggctgtgtccccaccaaaatctcatctcaaattatagttcccataatccccacatgtcatgggagagacctggtgggaggtaattgaatcatgggggtgcttacctccrtgctgttctcatgatagtcagtgagttctcatgagatatgaaggttttataaggggcttttccccttttgctctcattcttctccttcctgccaccatgtgaagaaggatgtgtttgcttacttttccacaatgattgtaagtttcctgaggcctccccagccatgccaaactatgagtcaattaaacttttttcctttataaactacccagtagccttgggtatgtctttattagcagcatgagaaggaactaatacagagatcaaatcatatttttgatagccgtcagataatagttgtttcatgaattttgcccgttawttaaaaataagactacatggccaagtgcagtggcccacacctgtaatcccaacattttgggagcctggggcaggaggatcacttaaggctaggagtttgaaaccagcctgggaaactttgggagaccttgtctctacaaaaattgaaaaatcagctgtagccctggctactcaggaggttgaggcaggaggattgctagctagatccyagaggttgaggcctatggtgatccgtgatcttgccactgctctgtagcctgggtgacagggtgagactcttgtctctaaaaataaataaacataagacacagaagctaaatatttaaatctctttagttttcacaggaagtcaataatgaaaccaggatctgagtagaaacagttattttaaaatcataatatcacagttttatcatatcagtttttatagttgtaaaaatttcacatcagcagagggcagtcaaaccatagttcattcaactatcttatgggaaattaaaattttctctgtgtttttctgcttaggacacaagctgtactttatataatcagtttgtaaatacatttcaaagctcttcagttggtaagctgatagaattgtattactgtttagccayggaaggtaaacagtttttttwaataaatttaaataaaaggaattaatttttttagatcatgaaatgctttattatttggtgtttttgatggatggccactttacatagaaatttgttttttctgcctcagaagcagtatttctgttaaattgcctgttattaattaggctattttttattcaaaaatattaacttttatggaatacctttattttcccctatgaacttgagaaaaatgagtttttattagaggctrtagtataacactaactaaaatgtagtttggaaagttttattgagtttttcttccttaaccttttctttggctggctgcaarcaactagtgataatgtgtttttagatgtgcttattttcacctcttcctcctggaggttaagctagtactcattaaggaaaaaatacagtttatactaaacagtgtttaacatatactgatggtattactgtatttcctgttttgtgttcacaatgagaagattctgaaaaactgtctttgtgtaaatactttactgacataccagacaagtataatcttgtctgctggtaggcaggaaagagtgatgtcctggaatgttgttgagaaggaaatctctttgtgttccacaaatgatacccttaaaccctttaagaatataattttaaaatgacagctctgaatttgcttttccttccgtttattaacttttcatgcgtttaagttcagaaatgcatttagttgggaaaaaaaccattgtgtctgagaaagaagtatctccctggtagtttgtgggaaattattggtagaagtatctcagggtaaacataaaaacagatttaataattgttgctttttgttttcttagtttaaactttttctgatacttgagtcaggcttttggtaattctctacaggcttaaaaaaatgcagcatctccaacaaccatccgaaacatctacccaagaagtaatttggggagattgttgttagaacacaaattttttttaaagttagagttggagtttttaaattttattatttaatgtgagtcattaagacatatgaaaagctgttgtgtagtgttaacattgaatattctagtgaatggatttttatatacttaattattatagctgagagttcacttaaaattatactgatgtttctgttcagtgactgaaaaaaaaatgattatggttaaacccttaaataattgacaaaacagacatcacagactagacctgtgtgtgatttctgggtcagtggttctttttcttcttcttctttagtactcccatcattattacttacagtgattttgtacttcagctctcactctaaaacccagcaaaatggagaattatctgtaagagtctccaaatacaaggtttaaaatgcttgttaataattttcaaactttagaaaagtattatatgctttttttcatcttgaagttcttgcattgttaatgcatgtcatatgttgtatcctttgttaaagtatttgcttaaaaatatgtgggacattatccttcatatagacctgttttcataaatctgctctgatgaattctgaaatatggaggctactgcattttcaattaaaaatcttaaaggsaatactttaagacaaaagagctaagtaattcaaacaagtattaactaatatggtagtttcatggtatcagaaattcagattacttctgtgccatcccttaggccacatggtaaaaagtatctcactgtcacattagttgggttctcattcaggtcaacaagaattaggagataaggtaatagctcatccctgccgtttaagagcataacccataaattgcagctatcatttacatcccattggctaatcttagctacaaggkaatattcagctgcaagagaggctgtaaaataaatatattctctattttgaggggctgggatttaaatttggctttaactcaggggtttcattactaaagagaaaaactaacagtctctgcgattacctgttagcaccatcagctgtcattgtccactccttcctctttgaaacattcctctttgttttacgtgacacagtaatacctaatttttcttctatttctttgtcctccttgactcctttacatatttattctggtctgcctagccacagaatgttgcagtttgtcaaggctgggcacrggacccatcttctctcatccacatccatggcttcagttgtcagctgtgattcagtgcctaattcagctcagatctttgctctgaccgattcaaccatctacttacatgtctcaaaggcacttgcagttcaacatgtttttaaattttgttctaaattatatatataattatataatcttaattttatgaagtaaattctattaccatccttgatcatacacgtgagaaactgaaacacagatggttaagaaacttgaccaacatagctggtaactgttatgtgaggttttttgttgttgttttgtttttgaggtagggtcttactctgttgcccagactgaagagcagtggtgcaatcatagctcattgcaacctcaaactcctgggctcaaaccatcccccacctcagtctcccaagtagcagggactataggtgcaggccacagtkcccagctaatatatatatttttttaatttatgtagatatgaggtctctctatgttgctgaggctggtttcaaactcctggcctcaagcagtcctttcacctcagcttcccaaagtactgagatgacaggcgtgagacacgatgccrggttcagttctrtcagttttgataaatgcatagaattgggtaaccaccaacacaatcacaatgcaaaacaatttatttactccaaaaatttattcttgcagccaccactggtgggatgtcttctttccaccactgacccctggcaactactgatctgtcctgtagttttgcccatttcccaaatgtcatataaatgtaatcatgcmcatgtcatctttgagtataacctcttttatttcacatgttttcgagattcgtctgtgttactgtatcagtagtttgttccttttttattattgggtattattccgctatatagatgcactacagtttgtttatacataataaacaataaaggacattttagattgtttgcagcttttgctatgaagaatgttgcagtacacattcacagactggtttttatgtgaacaaaacttcttatatctaatatgattctaggagtggatttactgaatcatagggtaattaactgtatgcttaattttatataaactgccctattactttccagattgcctgaactatattcccaccaacaatatatgagcattccaggtgccctgcatacttgctagtgcttgttattgtcagtgttttttttttctttagttttaatcattctgttagttatatagtattatcttattgtggttttaatctgcattgctcttattaccagcaatatcaggcatctcttcatttgcttatttgtaatttgaacattttgtttggtgaaatgttttctttggatcaatttttaccctttcaatgggttgttttctttacgtattctggatcaaaatcctttatcgagcatattacaaaccttctcttaatctgtagcttgtcttttctttttattaacactgtagttcacagagcaaaaaattttagttttgaagaagtacaatttccttttttaaaatcaactctttacttatgtataatgtctcctatggggatttttaaaattatttttttattgcggtaaaaaagcacataacataaaagataccatcttaactgtttatttttcttttctatcttagcagtttytaagtttacagtttagtagtattaagtatattcacattgttgcacagcctccaaaactttttcatcatggaaaacagaaaatctgtacccattaaacaactctgcattacctcctccccccagtccctttctactttgtttctatgaatttgactgctctggatacctcatataagtggaattgtgcagtatgtgtcttttgtaactggcttattttaatttagcataacgtcctcaagattattttatgttatataatgkatcagaatttcttttttgaggctgaatattttattatatgtatataccacatcttgttatccattcatctgtagatggacagttaggttgtatccacctcttggctattatgaatagtggtattacaaacatggtgtgtgaatatctatttgagatctgctttcaattttttgatatgtactcagaagtgaaattgctagatcatatagtatttctatttttaatgttttgaataactgccatactattttccacagcagcygcaccattttatattcattccaatagtgggaacaaggttttaaatttctgattcttttcttttttcttttttgatagtatgtatcctaatgggtatgaggcgacatgcattgtgattgtgatctgtacttccctaatgattagtgattttcactatattttcatgtgcttcttggccttttcccccccagatttattgaagtatgattgacaaacaaaaattgcatatctttagagtgtacaacatgatgtttatatacacagacacatatacattgttattaactgtagtcaccaccatgctctacattaggtctttaatacttattcatcttgtggctgagggtttgtatcctttgactaatatcgcacttttcccaacccttaggtcccaaccattctattctctgttaataggagttcagctgttttttagattccacatataagtgagatcatgtagtacttgtcyttctgtgtttggcttatttcacttagcgtgatgttttcagagttcatccatgttgtcgcaaatggcaagatttccttcttttttatggctgaattatatttgtgtgtgtgtgtgtgtgtatacatatatgtacattcacaatagccaagctatggaaacaaccagtgttcattgatagaagaatggacraagaaaacatgatgtgtgtacwtatatatatatatatatatatgtgcatatatatttgcatgtgtacacacacatcacattttctttattcattctctgtcaatggacacaggttgtttccatagcttggctattgtgaataatgcttcaatgaacatggaagtgaaggcatctcttccgcatctcttccgcataatgatttcaatccttttttttttttttttttgagacggagtctcgctctgtcgcccaggctgaagtgcagtggtgcgatcttggctcactgcaagccccgcctcctgggttcacgccattctcctgcctcagcctccccggtagctgggactacaggcgcccaccaccacrcccggctaattttttgtagttttagtagagacggggtttcaccgtgttagccaggatggtctcgatctcctgacctcatgatccgcccgcctaggcctcccaaagtgctgggattacaggcgtgagccactgcgcccagccgatttcaatcctttgtgtatacattgccaacctaaatagcaggcagagaggttctccgaagataatgggtttgttcgagactgcatagaggatttgcagttctgggatatgcagcctatggggaccacaggcatatccaaagaggttcaggcaaggggatgcttttaaaggtaaaggagaaaagtagtagtttattttgaaacaatgacaacattggttacggggcttatcacaggagctgacaccagttctttagtggaaactgtgtcaggcaagtgttcttgtgcatctggctagctgtccttgtgactcctgtaacaatctgcagtttagaacgttgtggttacaggcatatgtgcctaagagtccttcatacagtgtctgttatagttcctatcataggcgtgtgcgtgtgtgtgtgtgtgtgtgtgtggcctccctttgtaaactcctagctttatttatatatattttttgtttgagtttgacacaggtgacttcattttgattctgataccttttacaatacccagtagtgggattgctgaatcatatggtcattctgtttttacttytttgggtaacctagacattgttttcttaaatggctatactaatttacaatatcactttatattgttttcttaaatggctttactaatttacagtgtcactaacggtggataaggattccctagttttcacatccttgccaaaacttactgtctttcatctttctgatggccagtctgacagatgtgaggtgacatctcattgtggttttaatttgcatttctcattattagagatattgagcacttgtatttgttggacttttgtgtatcttttgagaaatgtgtattgaagttctttccagtttttaatagggttatgtgttctcttgatattgagtagtttgagttccttgtatattttagatattagctctttattagatgtatgatttgcatatgtttctcccaatctggggtttttctcttcactctattgtttctttggtgtgcagaagctttttagtttaatgcagttccattggtttatttttgctttcattgcctgtgcttttgaggttatatccaagaaatctctgtctgtggagctttttctcttaggttttcttctagtagttttattttcaggtcttctgcttaagtcttcaatttattttgacttgattcatgtataaggggtgagaaaagggtccatttttattctatatgtggatattcagtttgctcgtcatcacttattgtagagactgtcctttccccattgtatgttcttggcatcatcatcaaaaatcaattgactatagacatgtggatttatttctgctctctctgtcctattccattcgttgatgtgtctgttttgatgctaggtatggctttgcagtatattttataatctgtttgtgtgatgcttccagctttgttctttttggtcaagattattttgactattctgggcctttgtgattccatatgaattttaggattttttttttttttttttgcaaaggatcmtaagaaactactatgaacaattatatgtcaacaaatcatrtaacctagaaaaatggatagaaacatttaacataacaaaactgaatcaagagattggaaatctgaacagaccaataattagtaaggagattgactcagtaagtagaagtctgtcatcagtggaaagcccagaaccacatgactttatggctgaattctaccacacgtttaaagaagggctaatactaatcctcctcaaactcttctgaaaaattgaagaggagggaatacctccagactcattttatgaggccagaatcaccctcttaccaaagccagacaaagacattacaaaacaaaactataggccagtattcctgatgatcattgatgtaaaaattctcaacaaaatactagcaaaccatagtcaatagtacattataaggatcatttaccagtagatcaagtgggatttattcctggaatgtagattgcttcaacataagcaaatcaataaatgtgacttaccatattaacagaatgaaggacaaaaactacatgatcatttcaatagatgcagaaaaagcctttaacaacattcagcatcctgtcatgattaaaaatctctttaacaaattaggtacagaaggaatgttcctccacacagtagaggccatatatggcaagtctgcagctaacagcatactcaatactgaagagctaaaggctttttttctaatatcatgaacaatacaagatgcttacctattctcaccatttcttttgaacatagttctggaagtcctagccagagcaattagacaagagaaagaaataaaaggcatcctaataggaaaggatgaagtgaaattatctttgtttgctgactacatgawcttatacagttacacctctgtatctgtgggttctgcatctttggattcaaccaaccacagattgaaaatactcagaaaaaaatggatagttatgcctgctgaatatctacagacttttttcttgtcactcttcatcaaacaatatagtataacaacgtttacatagcatttacatgtattaggtattttaagtaatctagcgatcatttaaagtatatgggataggcataggttatatgcaaatactatgccattttatataaaggacttgagcatccatggagtttagtatcctccaggttgcctggaactaatccctcatagatactgagggacagctatatatagaaaatcctaaggactccacccaaaactgctagaattcataaacccaataaagttgcagggtacaaaatcaacctacacaaaccagtagcattttgttttacactaacaacaaactgtctgaaaaaaattaagaaaacaatctcatttacaatagtatgaaaaaataagtaaaacaattagtaaacaaggaagtaaaagatttgtaatttccaaatatttggaaatttttcagtaactcagtgtctttaactaataatttaatcattctagtaagaaaacatgctttgtatgattttagtctttacatttattaatttatgtaaattaatatgtgggttttatgatcacccacgacattgtcctaacttgtcgactgttctgtgtgctcttttaaagaaggtagtctgttggccgggtgcggtggcttacgcctataatcccagcactttgggaggctgaggcaggcagatcacctgaggtcgggagttttagaccagccgaaccaacatggagaaacccggtctctactaaaaatacaaaattaggccaggtgcggtggctcacccctataatcccagcactttgggaggcctagacgggcggatcacgaggtcaggagatcgagaccatcctggctaacatggtaaaaccccgtctctactaaaaaaaaaaatacaaaaaaattagctggggtggtggcaggcrcctgtagtcccagctacctgggaggctgaggcaggagaatggcgtgaacacgagaggtrgagcttgcagtgagccgagatcgcaccactgcactccagcctgggcaacaaaagcaaaattccgtctcaaaaaaaaaawatatatattagctgggcgtggtggcacattcctgtaatcctcgctacttgggagactgaggcagaagaatcgcttgaacccaggaggcagaggttgcagtgagccgagatcatgccattacactccagcctgggcaacaaaagtgaaactccatctcaaaaaaaaaaaaaaagaaaaaaagagaatgtagtctgttgttgggtgcagtgttttatagaggtcatttagtcagtggtccccaacctttttggcaccagggaccagttttgtgaaagacaatttttccacaggtgtggggcgggggttggtttcgggatgaaactatttcacttcagatcaggcattagattctcataaggagcacacaacgtagataccttgcacgcacaattcacagtagggttcacacttctatgagtgcgcatctaacggtgcggctgatcaggcagtaatgcttgcttgcttgtctgctgctcaccttctgctgtgcagaccagttcttaataggctgcaatctggtactgatccacaacccgggggttgatgacccctgatttaggtcactttggttgattatgctgctattcatgtatttgatattcttgaagaatttctatttggtctattcttttggttcctgagagagaaatgatgaagtctccaagtgtaattgtggatttctctatttctcctttcattttcttcagctttgcttcatctgtgttgaagctctattcttagatgcattcacatttatcaattgttgcaccctctacatctcttggtaatttttgtattctgacatctaacttcctcagattttaacacaatcaatccacttttcttttgctggtgatcacgtggtctcattttacattcttttaacatgtatgtattattttattacagttgactttcatatagatagcattcaatttgtatcttgtttgctgtacagtcttaatcaggtttcttaaagttgtgtttataccatttagtataaatttccatatgtttgggtttatgtctgtgactttattgtttgctgtttgcttccgtttttcattcttcggttttcctttttctgccttcttttgaattattggaatattttttattactttaattcatttactggcattttaaaatttctttgttttgtgtgttgctctagcaattacaatattcacatctaagttttcacagtctacttagagttaatattttatcacttgaagtttctatacattagtatagaacccttacaatgatctaggtcaagaagatagggaaaatggatatttgatgacagctgggtgtctgccacaaaggacaacattaagttgccttttagcccacacttctcttaatcttttctgtactgcttgttatgcatcctttaattatttgttttattctatattaatttcagcctatagtgtgcaattatatggaaaataacgttatgtccatgcctcctttcttgggatatttcctaaattcagtatgagattgttgatatagataagaaaactgacttgcaaagagatttcattgccccaggtaacacagctaagtggsagagctgcaatttgtactctgagtctggttttggggtctgcacatttgaccacaatgctactgcctgtattttacttaagataatagttatgtttatgacaaacctctaagtatgtatgacttctaaatttacacattctttgagtgttctaatttcattgtcataaaagcttactattttctcatttttaagacatatttcatacttcttaagatagctcttaaatktattccagaaactttaaacatttttgatattgttgaactagttttggaatcaaaacaatttgtgattcccacataattgcagttaaattttttcagtgtaattttaaaaataccttatgggaaaatactactgcaagttgtgtaacactttaattatctattttttgtaatcataacagcgtacacttaacatttggaaaaaaaataaatatattcaaaatatactttttcatttttttaaggtaatatttggtatttataggtcttcaagcccaggagcctacaaccgacagactgggaaccatactttatactattagtgaataataataacaaaaataagatttacattttttcttaggataccagagttgaataaattcaaatttagaaacacatatacatgtatatgtataaaatatatgtatatcaaagaactagaatttttaatcagactcaaaccttaccagtgaaatgggaatactctttacattatccacctaaaatgttcctattaaccatgtggttttaagaggtatttaaattttggaatttttaatagctatctgtttcttctgtaactttgattatattatagcttttcttgaatgaggagataaaacagatgtaaatattaagacaaaagcttgatgcctatgaaacaaattatttccaagtacatagagtgaaaatactttaaaagcctttgaatttggcaactttctctttgcattccctttcctgattctgtagcaatcactgtcttgttcttaatgaactggtactcaaaggtcattcagaaasattcattaaaaccagtagggaaataattctacagacttcctttaaccaacctgtagttttgttttctttcttaatagcctcaggtctcagacacaaccatcttttatttattttttctttctttctggaatcaaataacttttaaagatttgagaaaatcagcaccaatatttgaagattaaaacttgatccatctgtcagttagaattttgatttggaaaagccrcaggtaacagtgtaaattctagttttacaaatgtagtaataaagaatatacttcagtggcaatttaaacttcatattagtgaattaagatactcagtaagtttcagggtattagattgataaagcaatacctggattaatgactagtcattatgaggtgtacttttatctttcatttaagtcaaaacttatgttgcattacatgctttacaaaaattgccacattattacrttatggtttggccataaataggagcaattttgggaaccatttattttgtgaatggttactgattttctgaatcattcaagttctacattctattaaattttataagcctattatttaatatgagctttttctgttttcagactgatacccattatttttcagtcatagcagagaaataggtttccaggataaaacaaattgttcaggtattcaagcagccctcaggagtaggcaaatatcaacagataggtcactgagagatcaagggatttactcttttctttggtataccatagttcttgaaggctaaaattttggtaactgtttcaggaaaataaatactgtactatatttcgtttctttccttcaatcctgwtatgtaaagtaaacaaacctgttttcagaatatctaacctttagttgagtaaatgacaggtaggaaataaagctgttgatacrggagaatgagtaagtgaaaaaatccatcctttgtcaaccactcttattttttaaattgaatctgctttcagtttcagtagttgggagtgctagatgtacatagcttaatggatttggtgcttaaaattctggttttcttcttttacttacattccaacatcacaatagaaaataatgcaaatagccttctaaatgattgatatatgatgatatgttaggcttatttattgagtcaatgcttcacacctgttctgtgtcacaacacctcccttagaggataaggttttttttttttttwaaaaagcgattctttcttgtaatgccacaggcattataaatctctcaattgaaaaatactgaattaaatttgcttcttatttaaaactacttaagggtaaccctttgtatacttgttttttaaagttgattgcttattatcacattgctctatgtgtattcccattttttaaactttgacaagatactaatttttatattcatggtaataataatcttaacattatataacattttcacaatatggagtttactgaaaacaaatctaaaattttacatttaagttcactaaagtaacacttgtaggatgagaaagattttacttgtttggtggtacatggaaatttgaccccacatggaacaaaagttaacattgtcatgaaactactaaaaaaaatgctcgtgtcattttagcctacattaattatagcatctagattgcataactaataacttcatagtattctgtcctggtgagatgacatctagaatataacacacaattttgagatttcatgatttgcaactaattttggacataacaggcaaggtccacagcatatttttaccatggataatagaatgtaaaatagttactgttttcatgtgtttaaaagtctgttctctagaaaagacatgattttaaaagaaagtttctagcaaaacaaaaagaataactttgtggtgaattggaatttttcactaggggacttgcttgttctggtaggcattgatctcccagttgttctgggtgcttttaaaaattatattacatttctgctgcattgactaggaagttaaaattagccaggcatggtggcgtgggcctgtagtcccagctactcaggagactgaggcagaagaatcgcttgaacccagaggcggaggttgcagtgagccaaaattgccccactgcactctccagtctgggtgacagagcgagactcggtctcaaaaacaaaacaaaacaaacaaacaaaaaaacagtgttactctatagtgtactgtgttgccagatttgttttgcccacctgtaggctaatgtaagtattctgagcatgtttaagttaggctgggctaagctatgatgttcagtagggtaggtatgttaaatatttttttgatttaatattttgagcttgatgggtttatcagaatggaactccgttgtaagtagaggctcgatctgcatctttggagaaacgtctatgcaagttttttgcccacttttgagctgggttgtttgttttttgtttgttgttgttgggttttaggtattccctatatattctggatattaatcccttatcagatagatgatttgcaaacattttctttcattctgtgggttgcctttttactcacttgccacttttttgtagcaaacgtgacccctcctaaaaggggggatatatgtattttaagaccattccttggcagtattgtccttagagctttaggttgactatttgaattcgtatggtctttgactcatctcatcatctaaaactccttgatgttttcctcctttctttaatgttatatagacacaactgggacagctgacagtgaatataggttatatttttgcgaagaatttagcaagagaggttggctgtttggcattaaatatctgtatcactgtgaagtttttaattgtttttggatactaattatcactgaacatgacctagaacaataccttattacatagagttactcatttgtcaaatgtaggaatgaatgtatgtatgcatgcatgtaagtacacatgcatatagccttggtagttactacagtgctatcatagatgtaaagtctttcacaggcctgggtagacagcagtcatgttttattcatggcctagtctagcatggttcctggtactcttaagttttggtgaatgttcgtcatataaataaatatatttaatttagaaagcatcagaaaaactaacatttggataaagcagatataattttgtattatatatgtgagtaattttctttcatctttaaattgtcatatttccaaggaatctattcattgttgatttcatgtccctcttaaacaacttgagatacgttaactttggtaatctgtcatagacttcacttcattctgtggcctttaatttaagagaatggtagttctttagatgctctctcagggttaatctcccaacagctggaaaaccaagaatggctgtgaaaagtacttctttacctaatacaggattgcataactacttgcttttcccttaaaaataatctgcagtatacatggatcttaaaataggaatgataactcttttgtagaaatattaggggatcagaagagataatttatacgaatcatttggcttacaatttgttgtaaagtgaggccttgagacgcaatagctattacagggtgagcattctaagttggaaaattcaagacctgaaatgctccaaaatttgaaacttttgagttctaacataatgcttgaaggaaatgctcattggagcatttaggattttggattttaaggtttgggatgctcaaccctaaaccagtaagtatgtataatgcaaatattacaaaatccaaaaaaaatctgaaatctgaaacactctggtcccaagcaattcagataaggggtattcaccctgtattattagtttttccagaaaaaaaaaaraaagattatcaaagatacacacccgactttagcactaaaatttttaagttgttgtaccttcaattgctttatttttccctttcaattctaatgttaaaaaatgtaatcctgttttacaaaatatttcagcaagttttcagcagtcgtcgctattacattaactataaataatcttttgggagacctatcaacatctactttctctttcacaatttgataattaacgtatatcacatctgtgcctttctttctagggatttccaagatctgatggaatttgcaatggttgatgtatatatggctcttatccattgtcagtaacccaccttcttatgagcttttccaattttcgggcaaataactaagtacagtatttgtgctgatataggtacaagagtttaaagaaggcatgacttaagtgttactaagaggaaataaggagaaattatgttaataaattggcattatatactaataaagttagtctccaatctgtggaaacatgaagaatagaatgtaatgctttgcatttctcggtggatgaatgattttaaaatttcatacatgggggagaaaataaaaatactcctgaacccaaagcttgacttcattcagggatatgcataaacttctctctctttttttttttttttcctttaacctgaaaggacatttagaaagctaaatctatttttccttcttttcagtcagaaagtcaggcctcaccagcaacagactactggtgttttgtaagggctatataatgttttcatcgtaatgctatataatgttttcatctttgtattcgttagcccagactttttgtttagtactaggaagtatttccacagatgttgagtgagtggataaatgaattaacttgtgtggtatacctggggaaaaggcagtaaatgggtagaaaaactcaagaataatctacacctatggggttgacaacttttccagttgctctaggaattactgtaatcattttctttctgttatactgccttatagatctgatggaaattttgaaaagagygtgttctcattgtttagctctatatatctgttggcttcatttgcttttaatatttttttctaatagatacctttctggcttgcacagcaaagttcaattaatgtaaggrtaaaatgtaaattatctaattcagcttatttacatgctgtaagtaatatagtaatgctaactgggctttccttggcttttgtttcattgtgatctgagctcagattatagtttgatctgctatgcrctgacctgggtgccagatgcaagggaagccagtaaataatactataaagagagatgctagctttagttttgaaaggacgatgacttgtaagtgagactgttgtaaaccacacagtaattaaaaagctccataattaaaagggatatttcctttctttaacctgtcttaaatgttagatatgattaaaagcaaaagcatttctctcaataaagttgggggaaaagtacttgtttttatagtcagtttttgaaacataggaaaagtgacctcaaagaacctgtgttgtaaaattttcagagtcataggaacttgaactttgtttcttgattacttgatgaaattggtcatactagtttatgaatagttctgaatggccttgtagtcttctgttggttttggtttcatctttcagtagatggacctgtggaaaagtggaactggctttgaaaatgtactggaagcarttattttcctaagacaataattttttttctcttttccattttctttagaacatacaggctagaagatccactcagcatttaatgcatatgactttacattgctgtttatctttttgtttatcccgaaattggaagcttctaaaaggcagagattcactctcttcctgtggtggttctagaggctgtgccttgcatagagttaatttttaaaaaataattaataattatttttcttaccatttctattactcatttttcaatttggagaataattttacctggccacactgatggaacttgcatacatgggccagctcttttactcagttgcccaatttttgaatgaaactgaaaactgtggacagatacatcagggaagaggaacatacagagtaaaagacataaaagccttaaagttgcttcagtttcttcatttcatcttgtaaattacacaggagtccttcagataamactcactggttatatgacaaattaagcaattagattactgcacacctaataatagtagcaaataatgcactttcaatctgctaatatgttaagcacttttcattatctcttccttttacatraggggaatctgaagtttagggaatttaaaacttccacaaagttagtagtcagtagtttatatactagtattaaatctgtttaaatccaaagccggtgacattaacagtttccaaacgataataacaaaagtgaaaaatgttagtatcattccttgagaattcactacataaaattctcttccaaatatttactcattttatagattaggaaactgatccccaatgaggtatatccttttggtatattggttaaagaataatatrtctacttgagagtggcatcctaattactgaaaactggactacgaacttttaaagtttaattaacagtaatttaatgtatttttatgttatttcttaatctttggattattttttctttttggaggttgtgtatactctgaatacttatagcagtacttcagaacaatttagaacatatttgtacttctaatgcaaatttaatgtctagaatcctgttaacacatgtgataaatgccaacagaaagagattgatttgctgtcatgaattagactgacagatttctcaacaacactagatgcaagaggccactaaataggaaactaactttgaacctaagattttatccaactaacttatttaaatatgagggagaagtaaggatatttgctcatatacaagatctcagaaaacttactgtaccaacactatttctgaaaagcaccaggcaagaaaagtatgtccagaaggaactagtgagatatagttagtaaaaggaaataaagaacccaagaaagggtatagttttatagccacacaatggggagaaaaacggaaaagaaggggaagaaaagaaataagagccaagtaatttgttggcttagaattaaaactccaggtaatattagtctttcagcagttatggggacaagatgggtaaggaagtcagttagagatcagagtaggtgaaaattttgaggttcttgtattcatcagggaaagtatttatgaactttagacactaacagtgaaaaatatgcatagttatgaaactcaaaattaagctctctgtttaataatagacatcagagataacatgaacagatactgataaattgagaaaagagcttcagtaccaaaygaaacaaagaacacagatttccaggtgcttttttatctgawcatgttgcagcaccattggaaccattgtgtcactttaaccaagcctccaatatttttattctttcagatcacaaggggtggatgccaaacctctcatttttttcctcatgattacactacaaggcaaagcgcacagggtttgagttcgttgcagttgctagggacatacacctagggactgactactagggcaacctatgctgtcatgtcacattgttcataagtcttccgtsagcaaagatctgtcccaacaaatgccccatactcctttcacttccaagttattttctatcctaaacaatttttccttcctttatactggaaactccaagatctataacattttatsataaacttgatcttattttatattatatatttgtgttcccatttcactcttctgttatcttactctaacacttaaatgctgtatgatcaaagttaactaatttcttaaatttaatgaatctctttaaaccaggagatgtcatgtcttggttgtgcatggtatacataggaatgatagtttaaggaaacccatttctagatctttagtgcctaaaactgatctgcttgagaattcacttgtgatgggggtggaaktttctcttctccaaactcctctttacctctgaagcatcaaacaagtgggcagtgggaaatacaggtattacgtttgagagaatagatggcactaaagccatctattattaaactggtactcagtaccagtttactgagtgtggtctgaagatcataataattaccatttgcctttttcattcttattttctcagtagttacaattaaaaaagattttcagttgttatctgtcatcattcctgatatataatatagacagatttcaaatacttgaggaatatgattagaacagaattacttctcgcttatttgtatgaacaaggtttctctgtactttattccacaaattttttttagaaattgaaatagaatctaaaaaattgaattgtagcaataagtaatagtttacaatgtctataaaaattcactggggagggagactaataagaggattccagctgtctcattaagaaacgaactttctataaccttaatgtttaattatattttccaaaaatcattaatacatttatgtaattgtacatgaatcattgtaatgctcattcaatccagaagaaacgtaatacttagaaccttatgttcatatgagtgaacaytttttaaaatttcaaaatatgtgcatatttttctaagaattattacaagatgatcagagaaagaaggaaattctattgggatagtagagtagaagtacaaattcaaggagaaaaaaagagcagtgtaaaatttctcaaagatatcttttaaatagatggtagtgttaaatcactgtatatttaaatctgttgaatatgttgaaagagttgatgtaaaggtcttattttaaaatctcaatatttacaaaactctggaaattacatcctttaccactatttaaacatgggtacatgtgagaaggcaaaaatctcaattttcttttttaagtatacatacagttcctttttagcactaagagctacgtgtgcataatgattgagaccagaactccacattttgttgaaaagtggggagtgagggggagagagagaaatgcttttaaaattaaacaatgaaacttttccggggagtagtgaagagtgggtggttataaaatgacttggaagcagatcagctggaaaggtgaaagaatcagaaagcaaatatagcagtggataatggagttgatctgtagctagcctatagcaactgcctttactatattttaatatgtgccattaagtgtgtctcttgattgcttctgctttctgccagtatggcttactgttgtaactagagttagttagctggcccactgataccaccaccagagccttttctaatctattatagatttctaacgtgggataggaggccaacaatgtttctttgattacaaataggaggtacataccttgccaaaaatttgcaacatgatagaattgaagtcagtacagaacacacacacactctatttttttttttttttttgagacagagtctcgctctgtcgaccaggctggagtgcagtggcacgatcttggctcactgcaacctctgtctcccgggctcaagcaattctcttgcctcagcctcccgagtagctgggattacaggcaggtgccaccatgcccggctaatttttgtatttttagtagagacaaggtttcaccatgttggccaggctggtctcgaattcctgacctcaggtaatccgcctgcctcggcctcccaaagtgctgggattataggcgtgagccacggcgcctggcacacacacactgtttttataccactgttactttacagtttgcccaagttatgacagagatggcacttatacttagtaaataaatttgataagttacaggcttacaaatggagaaatcaagaatcaggtgactaaagtgagatggagataaaactagataagatgagtctttgctgcaacacttgacaaaatcctgggagaaaggataaaaccatctaattcataaaatttataataggccaatggactggaaagaaaaagaaatacaggaaagatactgtggaagagaaattacagaaaaaggtgaggaaaaagttaatgtctggggatgggaataaaatgagaaatggggtttagctgtctataataaaacaaatagaaaatgaagaccraagctttttctctgcttcgatttgtacttttcaatttcataatatgtttgtctaaatcagtgattatcaaaagggctctaaggtgtgcatctgagaattatgcatgtacatcagaatatgcaaatgttctcttttcttcataagattctggtacaacttaatgatcttaaaaaatgcttacccaatcccacctcacataggcacacacaaaaaccactggatatttagatggaactgtgctgttcatttcaatggtgttgaagcctaactaatgtgattttcatcatgtagcaaacatttaaaacttttgaatttcctaagcattattttaggaaatagcttttttttttggtcagagtctcactctgtcgcccagtttggagtgcaatgacatgatctctgctcactgcaacctccgtctcctaggatcaagcaattcttctgcctcagcctcccaagttagctgggactacaggcacacgcctgtagttcaacatatgcaaatcaataaacataatacatcacataaacagaaccaatgacaaaaaccacatgattatctcagtagatacagaaaaggcctccgataaagctcaacacccctttatgctaaaaatactcaataaactaggtattgatggaacatatctcaaaataataagagctattcatgacaaacccacagccagtatcatactgaataggcaaaagctggaagcattccctttgaaaactggcacaagamaaggatgccctctctcaccactcctgttcaacatagtaytggaagttctggccagggcaatcaggcaagagaaagaaataaagcgtatttaaataggaagagaggaagtcaaattgtctctgtttgcagatgacatgattgtatatttagaaaaccccatcatctcagcccaaaaactccttaagctgataagcaacttcagcaaagtcccaggatacaaaatcaatgtgcaaagatcacaagcattcctatacaccaataataaacagagagccaaatcatcagtgaactcccattcacaattgctaaaaagagaatacctaggaatccaacttacaagggatgtgaaggacctctttaaggagaactacaaacsactgctcaaggaaataagataggacacaaacaaatgaaaaaatatcccatgtgctcatggatatgaagaatcaatatcatgaaagtggccatactgcccaaagtaatttgtagattcaatgctattcccatcaagctaccattgacttccttcacagaattagaagaaactactttaagtttcatatggaaccaaaaaatagcccatatagccaagacaatcctaagcaaaaagaacaaagctggagacgtcacactacctgacttcaaactatactgcaaggctacagtaaccaaagcagcatggtactggtaccaaaacagatatatagaccaatgaaacagaacagaggcctcagaaataacaccacacatctacaatcacctgatctttgacaaacctgacaaaaacaagcaatggggaaaggattccctgtttagtaaatggtgttggaaaaactggctagctatatgcagaaaaaatgaaactggactccttccttacaccttatacaaaaattaactcaagatggattaaagacttaaacataagacctaaaaccataaagaccctagaagaaaacctaggcattaccgttcaggaagtaggcatgggcaaagacttcatgactaaaacaccaaaagcaaaggcaccaaaagccaaaattgacaaatgggatctaattaaactaaagagcttctgcacagcaaaagaactatcatcagagtgaacaggcaacctacagagtgggagaaaatttttacagtctatgcatcttacaaaggcctaatatccagaatctacaaagaacttaaacaaatttacaagaaaaaaacaaacattcccatcaaaaagtgggtgaaaaagtgggcgaaggatatcaacagacactcctcaaagaaagacgtttatgcaaccaacaaacataagaaaaaaaggtcatcactggtcatkagagaaatgcaaatcaaaaccacaatgagataccatctctcaccagttagaatggtgatcattaaaaagtccagaaacaacagatgctggagaggatgtggagaaataggaaygcttttacactgttggtgggagtataaattagttcaaccattgtggaagacagtgtggcgattcctcaaggayctagaaacagaaagaccatttgacctagcaattccattactgggtatatacccaaatgattatgaatcattctataaagacacatgcacacgtatgtttattgcagcactattcacaatagtaaaaacttggaaccaacccatatgcccatcaatgatagactgaaataaagaaaatgtggcacatatacaccatgaaatactatgcagccataaaaaagaatgagttcatgtcctttgtagggacatggttgaaactggaaaccatcattcccagcaaactaacacaggaacagaaaaccaaacacctcacattctcattcataagtgggagttgaacaatgagaacacatggacacagggaggggaacataacacactggggcctgtygggggatgggggtgggaaaggggagggataacattaggagaaatacctmatgtaaatgatgggctgatgggtgcagcaaacccaccatggcacatgtatacctatgtaacaaacctgcacacctatgtaacaaacctgcacattctgcacacgtatcccagaacttaaagtataataataagmaaagataattagaagacaagctacaggctgggggagaatatttgcaaaagacacatctgataaaggactgttatccaaaatacacaaagagcttttgaaattcaacaataagaaatctaacaactggatttaaaaatgggtgaaagaccttaacagacacctcaccaaagaagatatccacatatcaaataagcatatgaaaagataatctacattatacatcaaaagagaaatgcaaattaaaacgagacatcactacacacttgttagaatggtcaaattccagaacactgacaacaccaaattctggcaaggatgtggagcatcaagaactttcattcactgctggtgggactataaaatggtacagccactttggaagacagttggatagtttaaaaaactaaacactcttaccacatgatccaacagttgcgctccttggtacttaccaaaaggagttgaaaacatgtccacacaaaaacctgcatacaatgtttataggagctttattcataattgccaaaagttggaagcaagggatagctgacatctgatggataaaataataaatagaagagaaacttgggagactgagatttctttaacagcggttataatagctaacatttattgaatacttaagtggcatgcagtgtcttgaatgcttatgttaaattatatatcttcccaatarcaaccacatgtatctgattatcaaagaattttcctcttgattacttttgtcattcagatatttattaattcttccattatctcagygggcaattgagtcatgtcctagcttcctcttttaggtggaaacttgacaggcctagaatgtccacagtggctcacctatrtgtctggcttatctgggactttctcctgtagcaccttcgaactcttccacatggcctttctacagcatgggcttctcacagcatggcagccgagttccaaggcagaacatttcaagccttggaaaggaaaagctgcagatcyctgaaggctcactctgaatttatactatgtcactttgccaattctcttgtcctttgttttgatagagcatctcacagggctagcccaaatttcatgtagattcaacctcttgatgggtagagaagaaaactttttgtacccattttttttcttcgacatttattttaagttccaggggacatgtgcaggatgtgcagatttgttacataggtaaacgtgtttgcacccgtctttaacccactacagatattatgatagtttcctgtgttgttattattactgtaaaattatatttataagggttaactgccttttttacttgtaataacatgaacataaaaaataccaatgcaacatgtaaaggtagctccaaaaattagtaagcacaaagaaaatcaagcaaaataagcacaataaaaccacagtagggcatatcctaatgaaactgttgaaaaccagtgataaaaagaaaactttaaaagcagtcaaatggaaaaagaaaaaacaaacccacacattaaatacaaaggaaaaaaagtaataattgtcattaacttcttggcagaaacagtgcaaaccaggaggcagtggaatgctgtctttaragttcttaaagaaaaaactgttaatctagaattccctttcaagcaaaaatatcccttaacatatgaaagtgtagtaaagacatttgtctttcaaagacttytgaaagacaaaattatcggacaaattaaacttgtgagaatttcttgttagccaacttgaacaacaccatgagaaatgataccaagttcttgaggctggaggaaaatgaagcagatgggaacctgaatccattcactagatggaagcttgaaagaaatggaggagagggttagacaatgtgaagatttgaataaaaataagggagcttttttttttctcattttccagtttatttaaagatactttactgtttaatgttaaaaccgatattatagagttctgtaatattcatcaaagtatatacatgacaatattgccacagatgacaagagaaaggaaaatggaaacatatccttataagctcttaaagtgataaaataatatttgtagacaggtcaacagtttaaagtagcagagtacagcatctagctcccaagacaattgactgcacatctaaggtgatactgccctatacaggctaccaaaagtgtatgataagtgtccatagtgagattttaagagtaaaaactgtctgaatttaaggattaaaaactaaaaaaatagaaacagttgaatttttgaaacagtgaatattcaaccaatcctagctttgtcagttagtagctgtgtaaccacagcacttaaatttctttggaccttaatttccaaaaggagatcattgatatcaactctataaggaaggttatgggatggattagagaaaaaaatatattaagagaaaagcatagtgcctagtgcttgacatatatataagaaatttaacaaatgtaacacgtattgttaaagaaatttaaaaggtcaaagttagttactttggagacctcagtaaaggtgaggaagcaatacaacagatgattttgacaaacattagaaaatctgaatctcttgccaacatttttttctgtccacttctgcccctgcctgcttccctctttccctcttttcttccctccctctctgcccctcctccttattgttctcttgatctgtgaacattctcttgaatgtttctttcctgttgagtatctatccctatttctgtttatttgtttgtttatttatttagacacagagtctcactctcgcccaggctggagtacagtggcatgatcatggctcactgcagcctcgaactcctgggttcaagcagttctctcacttcagcctcccgagtagcgtggactacaggtgcacaccaccagacctggctaagttttatatttttatagagacaaagttttgccatgttgtccaggctggtcttgaatgcctgagctcaagccttcctcccaccttgaccagtgctagggttacaagcataagccactgcacccagtcttatccctattatgtaattttttttctcctttcttctcattgtctttttttccctgtcttcttttcctccacattccttcttgctagtcaaaatagtgaacagagttacattttttagtatatgcaattggccttgtgtatcttttgcttttgcatctacagtttcaaccaactatgaattgaaaatatttggggtcggggaacaaaaattaacaatacagcattttcaaaatttaaattgttaaaaaaatagtataactatctgtagcatttacattgtattaggtattataagtaatctagaaatgatttaaagtatacaagaggatgtgcgtaggtcataatcaagtagataccattttatataagagacttraacatcctcagattttggtatctgcaggargtcctggaaccaatccctcatgaataccagagaatagtattttattttttgagcaactaaaatgttgtttttctgttagttttaaagcatagtttgattttgttttaaacaaaagttcatcttggtacctgtattagtccgttcttgcactgctctaaagaaatgcctaaaattgggtaatttataagaaaagagattgaattggctcatggttctgcaggctgtacaggaagcatggcagcttctacctctgaggaggcctcagggagcttttacttacggtagaaggcagagtgggaacagatattataaatgttaaactcgtgtatgtaatttaaagggactaacacccaggatatggctagaccttaagttaggactctcagctacatggctgtgtttagtttgcaagtttatctcttcatcatagttccttcaagtatgcttgtcatttctgttttgaacagaaaaaaaaaatggagcaaaatcttgaagttgtaatatrgaagtttgaaccaggggtagaatactgaaacaaacatgttaaaagatggggtctaggcttcacattacgtacgtaacccttcaagggcctattctctatgctgtagcttttcaattaatgtcaataatagaattcttagtacaaaattcctagatacctagtcaccatttttaaacattagcttgtcaggaaaatgtgccaaaaagttccaaaacatgaaattacaaataaaaacttagaaaataatccctttagcaattgggaactgcctcagtacctactcagattggaaaccctcaacttggtcatgttttttatcaccaagacagctggtattgtttacaacatatgtctgagtattatttttaagtttctaattgccagtatctccagtttttaaaaggacacaaaccaacctctttgtaaaacttctgccctccaaaggctttatgttctctaagatagttaagaagattaaaaaaaaaaaaaaagaaaaamaaagaaactcctgttcttaatgatcccatgckgatagtttttttttggataaagtgtaggctgctgttcatagagatgccaagtacatatgaaaggagggactcatatggaaggtgaacttattaccagaaatcctaacctgcaggtagggtttctttcttcctcaaaataaaaattaacccatggggtgagacgcaaatttggcaacaacactgaatgatctctctacaagcttttttttttcttttttgagacagagtcttgctctgttgctcaggctggagtgcagtggtgcaatcttggctcactgcaacctccacctcccaggttcaagcaattctcctgtctcagcctcccgagtagctgggattacaggtgcctgccaccacgcccagctaatttttgtattttttttttttaagtagagacagggtttcaccatgttggccaagctggtcttgaactctcaacctcaagtgatccacccaccttggcctcccgaagtgctgggattactggtgtgagccaccgcacccagcctctacaagcttttattcatcataaccatacacatttattgttgcataccataagaagcrtaaagctttaaaagccttttctggactaggccacctctaccccctactktgtatggtttacattggtttctatgtgaatcatttgattattgcattcatgttttatctcccaaatactgctagctcccttaggatgaggttattgttttatataaaagatccctttcaaaaaagtagtctcaaaaaaarattgtaactcttgatttacatagcaaagtattaattaacagcatcttccaagatcagacgagattgagcgtgttcggggtggtatggcagtagacaagtaacagcatcttaattagttcacgtaaaacaaatctctagccacattcactccaactttcaatatcrcaaaatgtgtggtatttcctaaaaacatagctttctatgtcatcatcaagtgaaagtaaatacctcccccctctataaaagaacaaaacctattcaacttaaataatgaaatatgttattgttaaaagaatcctagagtcacagaaactggatactgaaaaggaagtttgaactaagtcgatagcattgggagtgggtgtaaagagtggctaggaatgacatcttccttgttccccatacgcacatataccactctattttgccagatacaccaggcagctttttcaaatacacacacacacacccacctttacaccttaacctctcactgtggcattactagggtagtgagcctctgtgaatgatgaaagtgagtagtgtctttggtgtgttgagccaaaaaatagattgaaatcactgacaataccaatcctcatttgacacatatgaccattacagctttgagaagataaaatgacttgttccaaattacttttggcagagaaaataacctgaatctcaggtcaagttgtgctctatttcttytgtacatttaaaagtgtggggatcctcttggaattagcctgtgaaatgtatttgcattgaaaggtcaatctcaggaatttcagagcaaasgttttktttgtatgtatgggtgaaaggacacttacagttttagtatcaatgcaatttgatataaactcattagaaagtctaagtttactaagctatgtattaatttaaataggtatracaatagtagagatgaataaaacatcacttcagtatttcatctctcttcatcttgacaagtgaagttcaggtgtggtaatatctattatgtaggggctccccaaagaacttcgggtcaagaaatacagagtacataggcagtatataaacatacttattattgcatctagtctatggaaaaaaaatacagaaagaacatttgagcacaataaatctcccctaaagagagttattacttgctgcaacctgtctgcagcagtcagaggaaggaagtcagcaagaaagggaaagaatgccaggttgcaaataccaaacggtcccatcatttgcaattcaagactaagagcagattcctaaaactcaaagttcaaattcagctgctaaaattacaatggtctcctagattttagaatcaatttttctaccagtaaaggtgatcttaatctaaaatattaatagcgaaaaccacagaggatatgtggtaaaagagactgcagaaattatgtctaaccttcttattttcagatgaggttaacatggattagagagtgtttatttgactcctagtccagtgttctgtccattacattttgttaggaagaattataattctaacaaattacttccaaatgccaggtaaatcaggccygattaaaagtatgtcttttatagctgttaaatggttctgaaaaactaattctgaaggatttatagataatttattatttcrttttcttttgtaaaagttttggcaagtttttaatctgatattatgatgcttttggaagctaacagatgttgctctgaaagtcatatttctcacttaattacagttttaataaagcagcctgggtaatgttagttgggggagtatttaggacacataggagccaagtcagatagaagtcatagaagtgttgcagtcaagaggcgtttgattataaggtgcatcattactttgtagactactaagaaagaaaatgcagccaattaaactatgatatgcattgtctctgatttctgcatttaaaaaatgaagaaatatgtttcctatagtcattgaaatayagtaagtcgttggttaggaaaggtaaggacctttctaaaggggaagaagcagagtagaggtgagagtgcatagcatgtagagcctgggttacaggctcctctgggaagcagtgggatattaactggaaggctgcaggacctaggaccgggaggtgcaggaagtgaggacagtgcccagacctaagccaattgtcctgagtctcctggttccatttagttagtgaacaggataatgtatcagaatcaatcttaacaatttaagtgggagagcagcattcaaaatcttgagactctcctagaatttagaagagaaatgaagtgattaaatgccagccaaaagcatttcagctttattttttaggcaacagtgggcctctgaaaagcaatgaaataaacaagtttttagaatatgaatctaacatgggtgtgaataattatggtctgccaaaaatcttgtctttttgttgttgttgttgttgttgttgttcagagactccttctagagtaacaatattggtgtgatgactagccttttttctttctattttaccaagttgtgctacttctctgagaaaaatccaagttttacacttaatagtaaagaagccagtggttatttatatgagatttttacccaccctaaccttagactcagtgccacaacacagcatgctaaattaggttacatccttaaaaaataataataataattcacttkgggtggagtacagacctgcccgtagccatcagttttactgcaggcaaaataaagacacacctcttcctgaaaacacagacaacacaaattactgtggccagcttcttatattataatttttacatcagctcatccctaactgytaatcacctaatactacaatgtaaacactgccccttccaaagaccaggcttcctttggtggtattctgtgataacctgtcattctgtagtatccttgacatgtctccctcttacaagattctctcatctctgcctgtgttttatcacctctgtcctatcactgtgaacaagaaaatgccttcctatttgtcccttgctaaattcctactcatcttttaagaatcagaccttccgaccacctccagcaggagtttgggcttctatgcatagagcagttacctctttctttttcttttgttttttttaaatacaagtagtatccccttatctgcagcggatacattccaagacccccagtggatgtctgaaaccatgggttatattaactgctatatataggtttttttcttatacatacatacctatgatgacatttaatttataaattaggcatggttagagattaacagcaataattaataataaagtagaacaattataacaatatgctataataaaagttatgtaaatgtgttctctgtctctctcaaaatttcttattgtactatactcaccgattttcagactgaggttgaccttgggcagctgaaactgcggaaagagaaactgagtctaggatgactttctrtctcaattcttgcattgtattgtacactccttaaggataaaagccatgtttcttcagaatcttatcccaaaaacttagcagagtgcctggtacataatcagtggtcactgaattttttttgattgattagatgatggagatttatgtatgtctagctataaagtttatgtttatcatatacaatattggcttaataagatattctttggcctcaaaattagaacctaataggaagcttaagacataaaactaatttgatgacaaggaagcatgaaataagtgctctaaaaagaaactcaagaacatttaggaaggatataccgcatccagcaggggtgactaagtgataataattacactaagtcttggggaagaaaggatgctatttcaggaggtggaggagaggaataggtagttattccatatggaaataatactctaggcaagggatacagacatgaaagcaaggaatgtatttgaaggatggtatcttctaattgcatagttcaaaattctaaataggaggtcagtggctaatagagctaggcaaggaagttgaaatcacattatggaaaagtttagaatttagtaggcagtagagagacgtaatttctgartagaaaaaaatactgtcatgagattttacaaagrttaatccctgctctgactggattagaagaaacagaaactgtaggccaggggtgcagggttcttmaggaaagaaatataagacaagaagttaaactaaataaaaataagacaaggatatatatgagtgatattgtaatgtataaagaaaagtgtctcattagacttgcaagctggtccatttacatttgatcatatttttagagaaacatgaacaagccaaggcaagtccaaaggagagtaatcaggatttgacggggagggagggatgagggtctgcaagtggtgagttcctggttaatcagctggggaaaaaaaaagaccaggaaggaggaatgtgataggcagcttcagttattcaaaggactgtcctctagaagagacaacatccttattctgttacttcagagaggcaagaagagacactataaaagtggattgtgtccggaagagtgtgaccaagatatggaatgatttggaaactgtgtcacacaagaagaataaaagtattttttatgataaaggagaattttaaggaacttgaacaccaccttcaaatacatgcaaggaaaaatgggacttttgaacattcagttaactccatataacagaaccatctaatttatagataagcaacttttctctttaccaattatagtgggccatctgtcaaatattatagagtacatgagtatgttggaaggaaatgttgacagtgacaaatgtttttaaaagggaaaattaatagtgtacactacatttattttattagtatctctaatatcagatggaaaagaaaggagaatcaatgggcccactgatggcttagaacttatgtctataaaatttactcatattattgcattaatatttcagaattcatagtctcaaataaatacaaaatatagagagacatatcaggaagtttaggttacctatgtataaataattaaatctctttattaaaatgaataccaataccaaattttattttataaggagtcatcatggcatagtatgaagagctgtgggttgacatcaggcataccyaaatttgaaaccagctctgctacttactmgctatwttaactttagcatgttatttggcccctctgggtcatggtttaatcatctataaaacaaggatataattcctctctctagggttattatacagattaataataatgtttatgtagtatataaaaagaacctcatacatatttgatatttaaaatggcaattattaatgttattatctgaaaaggttttaacaagcatgctacatagatgcaaatggtaaagtggaaacaatgtggactttggaatcagactgacctagctttgaaggctagcattgtcactcactagctgtacatccatagtaacgtgattaaccaagctgaactcagattatctgtaaaataaaaacactgcctgggccaggtgcagtggctcacgcctttaattccagcactttgggaggccgaggcgggtggatcacaaggtcaggagttcaagactagcctggccaacatggtgaaaccccgtctctactaaaaatacaaaaaaattagctgggcatggtggcgcgtgcctgtaatcccaactactcgggaggctgaggcaggagaattgcttgaaccgggacccaggaggcagaggttgcagtgagctgagattgcacggctgcattccagcctgggctacagagtgagactccatctcaaaaaaacaaacaaaaaaaacccaacactgcctgtctactccacaagttcagagtagtaaattaggtcatgcttattatttttgtttttaggatagtctggtatgtagtaaaacctcagtgttaatttcattttatttccccaaatatatgaacaggctgtaccccacttatgacctcttaacatgtattttacagacttacgtggattggaagtcctggctgggctccacagtccctgagggaagggagagcttcccttttttgaacatccaaaccccagggactgattcacctaactgctctctattaggcaacccttgaaaggaaacttctgagttttagtaaatgaagagaggacagagacccatctcttgttttatgcagaagtaaagagtttaagtgactaatgtccaggcacacttactgtaattactcctctctaaaccttatgtaatacttctaaagccctacatctttcaagagggtgtagtgatcagaggtaaggtttaaagtctaccacttagacctggtttttaacttctcatcaaaataccacagtctgcattgagtgttctgatcaggcttgtttycttattattgaggtaacttactttgctctttctctgcacatttaaccatggtgttctttttattgagaaaaccaccccttttgggctcttatataaattcagagctatacttcaagtcaccccaagatctgccttctttgtgacctctagtgatccttctaacccatagtgatttttccctaccttgagctttcacagccccagttcttccatattttgtcacttactttgtattttgagttattttctaattatttcatgtgtgtaacttactttcccaatagaaatttaagtctttgaagagaggaaactgtattattggatattttttgttttattttttgtttttgagacagagtctcgccctgtcacccaggctggmgtgcagtgacacgatctcggctcactacaacctccgcctcttgggttcaagtgattctcctgcctcagcctcctgagtagctgggattccaggcacctgccaccacgcccagctaatttttwatttttgtatttttagtagagatggggtttcaccatgttggccaggcttttatatcccccactatgtctagcaaaaaatgtaattgtataattatctaattaagatttattgaaatgctttaagtttttagattctaattgaagtctctatgccaatactttattactttttttggttcatttgcctttgagaattttcttagcatttttaatttacttyaataattgagcrattatgacaggaaatcatttcatgtaaaaaacagaccaagtattctggttcctagccagttttctttcatttagatatgatggtactaaagcaaacaacaaatgacacctctacttaattagtgattccgctattctgaatatatatttcatggcaataagagtttgttgaagtttgaaggcctttttacagtctctaaaaagacttaaaattagtgttttcattcaagttatagatggttataatctcagacagctgagacttttcattttcaccttaaggttaattttatttggagtgaactgtaaaaaaaaaatactttggctttacaaaaattccttttagtgtaaaaatgactgaaaatattattattccctttatatgaaatgtccagctaaggaaaattatagagaaaaaaggtagattattagttgccttgggctagagttaggagatgccttggggattaagtataaatggacatgaggcaacttttgggttagtgaaaatgttctaatactacattatggtggaggttgcacaattttgtatatttcctaaaaattattgaatcgtatgcttaaataattcatgaattttgtggtatgtaaattatgtcttaataaagttattaaaaataatttatgaaattacagggttaaattttattttataataaacataataaattgtccttagtatccatttatgaaagtaaatatgttgcttgaaattatttcattagaaaaactattgctactctttagttgtatggctatctgtaggtcttgtatgtgatttatttattaataaatttatattgaactaagtagaatttttaaaaatatggctactcatatgtaaaagttactggaatggtcttcttatttttctgacctttttatatccatataaattcggatgatttctcattgatatttatgatatyctgctctgaaaataatataatcaattacttgcctttttaagtcaagtattctaccctagttgactataaagtgaattttttcaaaggaagtcttaaatttttcatatatctcttaagattaaatttgagagatgttcacattggggggaaaatcaaatttagtaagctgtgaactttggcaatgcaagattgaactactgccttaaatatttgttaatatctgctcactattccattcacatagcataagaatttcccctatgcctgatatttttggcttcatatttttaatttctatttctggatttgttttcttatgtccaatggagcattgatgctgatttttttacttcataaatacatagtatctgtgatggttaatactgagtgtcaacttgatggcattgaatgatgcaaagtattgaccctgagtgtgtctgttaaggtgttgacaaaggagattaacatttgagtcactgggctggaaaaggcagacccacccttaatctgtgtgggcacaatctaatcagcttcagacacagccaggatataaagcaggaagaaaaacgtgaaaaggtttgactggcttagcctcccagcctacatctttctctcgtgctttatgcttcctgccctcaaacactggactccaagttcttcagctttggaactcgaactggcttccttttgctcctcagattatgtgagttaatattacttaataaactcccctttatgtatatatctatcctgttagttctgcccctctagtatcaatcaaaatttgaagtatcaatcaaaatttgaagctacaagagaatttagaaatcatccagtgcaacttattaaattatacttttgataggggatgctaaatggttagggaacttgtttggatctrtggatttcgttggttatatactcagctcttaattgccaaggaatagtcatgatgaaccagcagactttcctcacctagttggggagaaaagaattagattaattttcggttccttgaactctagaaktctataaatctatcaactgtaactatgtcaaatataatgctatggatgttactcttcttaattaactatgtctaccttcactttctcatagtccagctatcattaatcttggattataacgtatggatcctatctgcctggctccctgaactttttatagaaaggagtatatactatattagtaaaagcacacactctggatttaaactccctgggtttgggtattggttctgccactcatttacactgtgtccttggacaggttattatcccctcaatatggggagaataaaatgcttcataaactggtgaggattaaatgaattaatacatgcttgaaatagtccactgaatataataggaactcataataagatgaataattaatataactcaaaccaactggtttcagggccttatagtatatataagtatatcattatatatttatatattatatatatttgatatatatacttacatatagatatctatatataatatacttatatgtaggtatctatatatatagctttttggggggtcctrcttagcctttctttctccataggtttaattgtagagctgtgtttcttttttttgtttgtttgtttgtttttgagacggagtctcgctctgttgcccaggctggagtgcagtggcrcgatttcggctctctgcaacctccgcctcctggtttcacgccattctccttcctcagtctcccaagtagctgggagtacaggcgcccgccaccatgcccagctaattttttgtatttttagtagagacggggtttcaccatgttagccaggatggtctcgctctcctgacctcgtgatccacccacctcggcctcccaaagtgctgggattacaggcgtgagccactgtgcccggccacagctgtgtttcttaaacttaagtaatgaataaatgtattgtaaagaaaatacctcaaacttctatgaatatacctacaaattccagttgaagaactacattaattaaatgctgccaccttccatggtagcttggttccaacacaatcagaaactctaatgcaatttttgatgttgaaatcaggtaaccagtactttattgtaagatcttcagctgattgagcattttaattttgttaggtcatcatcaaaacaaaaacagaaattttaagcatatgaaatatcttgagactatttcagcagaccctagttgagaactgttgcttcaaaagtaaaaataacacacctatgcacaccaaactgattgttttatattcaaaactccagtatcactatttgttttgatcagttgaaattacttaagagtaataacaggcctgctgccagtggtggtagcaactgaagctgatttttatcagatcaagagtgagccaggataatgccagtttggggccagctctaggtagaatgctaaaagttgttgagacttctgtcttccttctgttaccctactacattctgtcatccttcctcctgwctgtgccctttgtcagtgcccttacccctaaccccaaaagctcctcactgagatgcttgacatgttacttttcccagcatatttgtgttttaataaagcaaatctaagtccctgaaatacctcaagacttgttagaatctcttaaagtgaaatttctaacactctgagttcaataagaagaaataaaagtacatatatttttatataattttttatgtttgcaaaccaagaaacatgccatttctcctagtaaaaatgggggaagtgaggactactttgccttttctcctggasagagtagtcctcatttcccccttttttctttataaaaaggaaatgatgataaaaaattgttaattggataccacttcaaatggggattagttatgcatagaatatttcagatatattagtatagaagtcatttaagatacaagcattttatccttttgtaagttcttttgtctaaagtttgttaagaggaaagccaaagattattttgttgtatactaaaagctgtaaatattattaatttatgtcctakacttccctatggaaaagggaaactcagtattaccatgaacaggatccattctttatatgagtagttagaagctaattgtaggttattgagatttaatttagtctctggttatcatgtttagaatcttatgacatgatttgttttagagaaataacctgcttgcagttaagtacattccttagatgtcagcctggttaactagtgtctgtcctgagttggtaaatgtctacttagatgccagtgatgcgaatagaaactgtcgtgtcagcttataacattctcagagggttgcactttcaatgcagrtggggggaaggacraagtaatagcttcttgttgggatyacagtaagtgagggctcaagtgaagatctcttagttccttgaatgatcctttaaaaggtaatagttttccatttttttgctttcagttcttgcatatgtaatgaaaataacgtgaacttagaaatatgggcttagtaaattcttagtaaattatgttcacatgctataagattttaatcaatgagtttcaaatggggaagggaatttatatttaataccaacctacggcatgcctatattttaaactattaatcatccagtaacccataagcctaggaaggattagtccgasgtattacagtctcaaagagatagagcctggctatgcgcattgttctgtctgattatttttcattttctcttttgttttgtttttttgtttctagcctaggcagagtgcagtggcatgatctcagctcactgcaacctctgcttcccgggcttcaagcagttctcttgcctcagcctcccaagtagctgggattacaggcgtgtgccaccatgcccagctaatttttttgtatttttaatagagacggggtttcaccatattggtcaggctggtcttgaacttctgacctcaaatgatccgtccgcctctgcctcccaaagtgctgggattacagttgtgagccaccgcgcccggcctgttctatattattttaaaacctaaaccctttcctcttaaacaagcagacatctgtaatatatgtaacctaattgtaaaatagataaacgtaacagagagtatggttggtatagtttctggttagtgctaaatgattggaacaaagaaaggagagattactctggactggaatgatcaagaaaagctatataaggatacaacttgaggtggactgtgaactctgkgtagaaacagagttagggttcgttttggaggttctaacaattgtaatatttttagtagttacaagtagagctctgtcattcccatcatctaattataatgtgcaaagactgattgcatgtactctttgactacagttcttggcactaataaccctaaacaaagctggaggcgctaattacctccttttcctaatctgaattttgatgtgcttttgaactagtaagtcttctggcattctaagaagacttaccccatcactggggagacatttacttcagcattcagaaaactagatttttgaattaaagttttttagaggagtttttcacgcagtagcacaaataaattaatcagtgtctttatttttctatacccctatcgtcattgcctgcatataagaaggagataagtataacagtttactcatgggatatgtgtactttttgatagaaaacatggagactatgaaaagcattcattttgtctcctggttgtcagattctgtctgtaactgacagtatgatcctmtatcttttaaatgtgctattacctgagtttcttttggtaacactaaaggtagaaagaaaaaaagttaacttagggtaaaggctatttgttcctttttcattaaaaaaccaggaaattcttttttgattggtgacatcgtattaatatttagtctgatttattagcatgaggcaaacagcttttttccccagagtgttgacttagagaatgtggacttatataaaaataaagataatttagtttatgatttttcttcttttttcaaaattcagtttctttcttaactttttgttggactttttctcactttttaaaaaaaccgttagttttgtgacttgggcaacctactcggcctcaattttcttatccctaaaatggggttattaacccacctatttaacagggtggttggtaggattaaatgagatcatatctgtggaatgattcaaacagttagaacggtacctcatagttacttagtgagtaagtattagctattgttttaaataaaaccagtaggatttcaaccacactggcaggtgtgcccagctctgccctttgctagctgtgtgaccctaaaaatgttacttagcctctttgtatttcagtttccatgtctggaacacggaagtaatactgatgcctcccttgtagatttttgtaacaattaaagcagttaatgcttataaaagttctcagaacaccctggcacatagtaagtctgttgttataaatattttcaacattatgactgtttttgtcaggatgggtttttttaaagcaatgcataaaagtactataaatatacatttgttctatrtaatggccaactaaggaaacaaaagcagataaggtaaaagcacaagaaatgaggaaacagaaagaaggcaaacaggaataggcagaaggataagtactaaaaaacatacatacacttccagggagagaggacagatcagaaagttcttcctatttctaaaatttgtttatacacacacacacatgaaatgaaattctagactatagtaagtgatctttgggctatttcctatatcatagcattttcacattgtattttgtttgctcagttaattatccatcttcccctgcaagctcttgagggtaagaaacattatgtcttgttcatctttggaaccctactgtctagcatgtagaaagctctcaatatttaaattgaatttaaaaatagggttttgcaatactaacttgtatttttccataaatgcttttctaatattttccataaattttccacaaatatgccttgatattttatatatatatagrattccttgactgtgtgtgacgtagtttaaaattttcctttttctaaaatttttattttctttttaatttggaagtctccattcttattaaaattaagtgcttatgctatttaatataataatacttgttacacctttaggaaaacatagttgttcaccatgctttatataccatgtgtgaacttttctatatttttttcctttcagagtgtatygttctttttgtttgtaaagcagcatacttgatgctgcaaccagtgactttttgccatgcattcttaatacttcttggaatatttggtttaggaagtggggtaattagtacataaacactgtgtagcagaactaccctaattagtgccttttggcctggcttcaatgataaacaaagtaagatgtgtgtcagcattcatcctaacactttataaaaattgttatagccctatggggcagcatacacaagataagttaaataatgtagtagttgagaccatgagaaggagttttgtctgtctatttaatagtctttgcatgataaattagcttcctagctttgaaggcttcattagtcttaattatccagaaagcataaacttagccatcaaagtgtatccctaataacgttttacatctttagtgaaatgttgcctctttaatctgtacctaaaccaatttcactatcttyctataatctataggcgaaaaagagcattagcttagaccatcaaaatgaaatgattcaggaactgggttcagaggcaaaacatttctcacccattttatggggcctttaggaaattttctttcatttagttcactgttacttaagtctgttatttcagaagaccactacttcctatttttgaagtataaatactttaaagattttcccattaagatgttgctttgttggtttacaatactgggactactatataggaacagatcattttttctagagacaaggaacagaactttctgctagacagctcatttcttagagacactctaagcttaaaatttgggactcattatgaagtctaggtacagtttctgaagaatctcatctgtattaagaactggttgttcaaaacctctttgtaattaattttcttacattaaatcacaaggccgaaaatggaaagtaaatatgtaaaaatgtagaaaacttaaataggttaataattgtcaaagatattgaaatggtagtcaaagccctccccaaaaactaaacacaaacacttgaataaacagacacactttcctaagccaaatagattttataggacattgttaccagattttcaggggatgtaactcctgtctcatatggatgctttaaaaataaaaaaaagccaggatactatctggctaattttgcaaggcttgtacaaccctaattccaaaagatagcacaagaacagaaaagtataggtccaccacacttatcattacaagtgtgggaattytaaatcaaatttagtgaataagtccaatggtttttttttttttttttttttttttttgagtcggattctcaccctgtcacccaggctggagtgcaatggtgcaatctctgctcactgcaacctytgcctcccaggttcaaatgattcttctgcctcagcctcccgmgtagctgggcttacaggcgcccaccaccacgcccagctaatttttgtakttttagtagagacagggtttcaccatgttggccaggctggtctcaaactcctgacctcatgatccgcctgtctcagcctcccaaagtgctgggattataggcctgwgccactgcacccagctggtaattttttaatatagtattttatctaaggaagttaaggatggtttaacatttaaaaaatcaaagaaattcactatattaatggtgaaaatatgtaataggcaaaaaaattatataattgtctaaaagtatgctttgaaaagcatttgataaactttaactatataattaaaagtttagaaaattaggaatagaaggaaactttacaaactagttatatacaaaagcctacaacaaatatcaataccaaagctttaatcaaactttatacaaagcaagacaaatayatattcttgatatagatctgactagtccaataagaaaaaaaaagtgaaataaaggtggacagagaaatggtggagcagaaaagagaaactaaaatagataaaatagtccttacttggaagttatacattgtctatgtgggcaaattattagaactagaagaagcaagctatatactgtcaatagtttcaagctatatactttcaagcaagctatatactttgagtatactttcagtagttttgtttttccagatttagcagtgactacacttcaaaattcacagcaattacaaaaagtataatgcatttaaacattaacctaacaaaaaattataatagctttatggaacaaattacagaactttactaaaggacgtaaatgaaaacttggttaaatgaagagctataacatgtctattggtggggcacataacarcataaagataccaattctccccaaatccaattccaattaaaattataataagacttttggggagcctcagttaactgactctgatgtagaaaaagtttcttagatagctaagtctattttgaaatgtatcaggaagagggatgatttttttcaaccacattttaatccatatttgtaaaagtaatatggaactggcatagaaacagatgattacactaaygaaacagaagagacaggtcaaaaacagaaccatggtggggaaaaggaatgttgcttagtaggttcttgaagactggtttacaaaattttaaaaataaagttgggcccctacttcacatcacataccatgtgaactccacagagaacaaggacttaaaagtgacaggtataaccacagagctaatagaagaaaatgtaagagaatatttttctgatctttttttwaaaaaaawtatatatatatatattattttgagacacagtcttgctttgtcatccaggttggagtgcagtggcacgatcacggctcactgcaccctcaacctcctgggcccaagcaatcctcccacctcatccccctcaggtagctgggacaacagctgcatgccaccatgcttggctgatttttgtrgagatggggtttcaccattttgcccaggctggtcttgaactcctggggtcaggcaagccatcatgcccagcctattttctaatcttgatatgaggaagaacttcttaaaccctactgcaaaagcacaaactatcagggatacatttttttttgctttacattgtcaaaactaaagatttttgttcaatgattaaagagtaaaaaaattaacagaatagtgacagattggaagaagatatctgcagtgtcataagcagaygagataaatatgtagaccataagaaaaatgctttcaaatcaagaagaaaccaatatatacaaaagcaaaagttgttactagacaattcatggaagggactccttactgtctaagtgtataaagagagatgttcaaccttatgaggaattagagaaatgctaattgaaacaacataccacttcccatctatttgggaagaagtttttgaaaaatcagttggtaaatcaaaatataggtgaggatttggggtaatgaggacattcatgcactgctggttgaaatgcaggctgacacagctggtctgaagagcaatgtcacagtcctttgtaaaagtaaatatgtttataacttgtcacccagaagtgccatttcgtgtacatattctattgaaacacatttcagcttgataatgttgtgtatcccaggatgtttactgtggaagtgtttctggtagtgtggggttgaggacaacttaagtgtccatcactatgagaatggtcaagtaaaatgcawcggatgcatcctgtggaacgttctgtaacagagcaataaaataaatgttcaggcaatgccctccagccagagactcctgggaacatacacctggagtggaacaagttgggtttattcctccttgtatggaggggtaatgcacaccttgcagaactgggrgtgtcttagcaagaggatgttaggagggaattataagagctgagcttgtatgagatgatatgggggagagcttaagaaagtgggcattgtactggattgcttactttcaggaggcagagacaacrccatgattgrttatcttaattaaatcatctgtaaggagggaagaattgagtgaagctaatggtgtarttggtraagaagyagtcactcttactagctggaactgggaatatatgtttattttgtggcttggagagtgttcatattttgtccatacctgaatatgcagcggtcttgtttttgtcttgatctgttactgtcacagagtggcctcgtctaatgttgctgttctgtgaaattgttcatgttcaacagaataccaagtgagtctcagaccagctcatgataacataaaggccatgctagtaatacaataccagagcagctctcaaatatcccttctgtttttcagtactacaacaatacacaagatcttaaaaatgtagtagtgattattaaaaagggcttacagcaagwcctataacataatattatttatataaattacagacataataaataaaacagtagtatgtattattcaaggatgaatatatgtatacaagaccctataccaaatacaagggttttcatctctagtgtggtcggasggaaggggccagtagccaatattgggggtgaaaggaaatattaaataagagaagagccttgtatggaccaatgtgatagtgtgctatgtagattgaaaactatgataattcattttcagcagctaaagtcttaaaacaagtctacacttctgcagaaaagtggtaagggaaagagtgggagaggacctgtagcccagcatcttatctatatttactactcttgccttgtgggaggtgggggaagggggaggaggaggaataccttctttaagcttttcctaaatgtcttacatttcccccaaaaggaatgagctgttgtaatgatagcatgttgatgctggttaaaataaaacatgcccaccagtgtaaaatgatagcattaatatttcttgtgggaacttgatttagctttaaatgtacccaaaagctttcgaagtacaaaagccctcatattagctccagagaaaccaagtttattatatcttaaggaaaagatttcttcatgaaccttaaatttagtgtctgtgtaatcatgttattttgtcatttactttttaactgtagaaaagagcttgatttgatttttttttttttttttttgagacggagtcttactctgtcaccaggctggagtgcagtggcacgrtctcggctcactgcagcctccgcctcccaggttcaagcaattctcctgcctcagcctcccgagtagctgggactacaggcrtgcaccaccatgcacagctaatttttgtatttttagtagagacggggtttcaccgtgttggctgggatggtctcaatctcttgaccttgtgatccacccaaagtgctctgatttgggagaccttggcctcccaaagtgctgggattacaggcgtgagccaccgtgctggccagaccttgatttttttaggagtaaagagacttcctacctccactstagtcctcttatcagtgatttctttttaaaaaagtaaatgtccttgtgtcttcacttcatcttccttaataagtatttagaggcagtattttcgatattaacagcatagattctttaatttaggaaagaagaaaacttaaytttgatttttctaactttctgctcagctcttccaacgtgaatatgtaggtctctgtctcccrgggtcctcattatgctttactttgccctttccagtgccctttccagtgtttcaaccacattgagccgcatggccgcataggggactatgaagatcagctcrtgcatttgtgaagcactgcctccttgtgtcttactgttctctttcttaatkggctgtgttctggaatggtgtcttggtgttatgttttaaaacattattttgcgtaatttatgtcattttatagtcagccaggagaaagtacactacattagttttatgtcatcaaattgtttaatcatctctataatttacatgaatcttcattaataatacaggaggaaatacaagactctttctataaagctttgaaaatgctgagtttttttgaaatagatttagagggtacaaatgcacttgttacatggctatactctagtggtaaagtctgggcttttagtgtaaccatcactggaatactgtaccttgaacccattaggtaatttctcatcccttacccgtctccttctctgccatctttccaagtctctgatgtctgttattccactctgtagccgacattaatttttaaggatagttactctttatatactacttctgtaaatccataacagatccccaggttttttccttgtctattaggaactgtttaaaaaattttgtttaagaaacaaatgtatctccattcatattcttgaacaacacytctaattaatgaattactcagaaattttgctgatgaaaacatgttatgaaatctgtatattgtataagacctttgcttccctgagagaaatcactcccattgtttcttcaggaacttattctttcagacttgcaggtttgaactcttgaaaatttctatgtgttttctctctgaatatgtagaaattccatgtttgttctatgtagataggattaagatggaactgtgttctaaaaattgggytgttttttataaattgtccaaatttacattttcctaaaaaatatattaagaatgttagcttgcaacctcttttaaatccataatatgctgacatattatctttgcaataaagaatattggaaaaacaatactgctgcaagtgtacaaatggtatttaattccacatgctcctgtgcttccatcagtccctgcacataggcttctctactcctgattctaaagctcatttacactaaaaaggttattgaaaggtacttgatctgtttttgagcttaagaaatagagctaatggacagtgtcacaattgtacatgcacatgcagcccattttccattcctagatatatcatttacgttttctacatcacctacactcttgggtccagggttatagagcatartaagaagccgaaaagaatgaataccttttgaagaactattttcaagctagtgtacctaattagatgaggaccataggcagtttttccttcagatgccagcaatctagaaggaggagtaggatgggagcagacaggttgcctccccacctggataactgagtgtggktttctgcagttcttaaaattgtcagctcacacatactacttacttacttacttacttacttacttacttacttatatatgtctgtaagtacgtgacagagtctcactgtggcacccaggctggagtgcagtatyatgatcttggcttactgtaacctctgcctcctgggtccaagtgattcttgattctcatgcctcagtctcccaggtagctggcaatacacgtgtgcacagtcacacctggctaatttatttcattttattttatttgtattttagtagagatagagtttcaccatgttgcccaggctggtctggaactcttgagctcaggcagtcygcccacctcagcctcccaaactgctgggattacaggcgtgagccactgcccccaaccaactcacacatactttaagtgggactttatttaatatcttcatatcagcgatagaacttgatgtggttttccatacatgtacacacacataataaatatcatccctttgacaatactataagaattagtgcctttatcattggatattctcttaaaatcattaacagaaaatgtgttctttctagaggaattttatcaaaaaatttataaggtgtttgaacatgtgattacaaaggaaagggaaagctaataaagaacttagtagtataaccatggccaggcacagtgactcctgcctgtaatccccgcactttaggaggctgaggcgggaagatcacttgaggtaaggcattcgagaccagcctggccaacctggtgaaatctcatctttactraaaatacaaaaattagctgggcatggtggcaagtgcctgtaatcccagctactcggcagagtgaggcacgagaatcgctcgaacccaggaggcagaggtcacagtaagccacgatcatgccactgcactccagcctgggcgacagagtgagactctgtctcagaaaaaacaacaacaacaacaaaacttagtatgtaactatttatttagctatttttcaggcacattttagaacaaaagtgattttttttcaaacctctttaccctctttggtggtaggagacagatttcatattcatagaggtccatatgtggtacatatgttacttaaaacttgtggttgacactgtagtgggaagtaacagtagggtcactactgatatctaaatccctgatgtttctagtaggtataaactagagtgtgatttgtttttgtgaggagggaattatatctctgttaggtaagctaaattcttatttttggcattcatactgtaattctctatcctgattcttgtgtttttgcacattgtagacaaatattaaaaatcccacttgacatgattctaaatcagaaattcctgagaatagagatgtttaaaagatgaactaaagctaccttaaaacatttcagtattttgaaagagaaaaggatattgtatttaattcctcctttataaagaagttttaactaaactttaaaattattttttattatctggtgtaccaggattgtgtgggtaatattctttttrtttttaggtctcattcagtatctctgtttttttgataaaacaagggtcagcaaactttctctgtaaaggtctgggtagtaaatattttaggctatgcaggccacatataatctctgtggaatctcctctctcaccaccctctatactctcttcctcctccccctctttttttttttttttttttttatttgagacggagtctcactctgtcrcccaggctggagtgcagtggcgcgatctcggctcactgcaaactccgcctcccaggttcrcgccattcttctgcctcagcctcccaagtaggtgggactacaggcacccgccaccgcgcctggctaattttttgtatttttagtagagacggggtttcactgtgttagccaggatggtctcgatctcctgacctcatgatccgcccaccttggcctcccaaagtgctgggattacaggtgtgagccactgcgccyggccctcctcctctattttttttttacagccctttaaaaatgtagaagctggccaascacggtgattcacacatggtagttccggcactttgggaggcaaggtggacagattgcttgatcccaggagctcaagaccagcctcggcaacatggcaaaaccctgtttctacaaaaaaatacaaaaattagttggacatggtcacatgcacctgtagtcccagctactcaggaggctgaggtgggtggattgcttgagcccatgggatcaaggctgagattgtgccactgcacttcatcctgggtggcagagagtcagaccctgtctcaaagaaaatagtaataataaataataataaattaataaaaatgtagaaatgattccaagctaaagtgctctatgaaaataggtttggcccactggctgttttggggcctagttctagaycaagttctgccccaaactaattgtgtgctttggggtagtttgtataattggttttatcttctctggctattttatgaagataatctagtagtcacttcatatgtgaagaatttatgaaatacctatatatttgcttttgttttctaattttagatacacactttactacagaaaataatttagtcatgttaagtttgattaatgctaagattagtatcatctgaggtcaagctatatggcatgtgaattcagtgtcagaaagtctgaatttgggtccttgatttgctacttactagactctctggttgcaggtaagctctgaaastctgagtttctacttcctgttcatcaaattgatgaaatgacactaactctgcctacctcttaaaattctttaattattttttaattgaaatgtgaaactaagataccgttataaagcacaaaacattaaatcatcattaggagtcattcttttaaactacatgttttcataactgaatttccccttataaattttattatggagaaaaaattttaatttaaaaaccactaactagtaaggccaataattcttcatagtatagcatctggcaaatagacactcagtggctagttatctaaggtaagtcagtagcttttccaactagaacttatacctaggttttaattatattgttcctttctaactaacccaatggtatcaaatgctctctggaatatagataatgaagctcttaacatagtgcctcccacatagtaggcactcagaaatttgctgactaattctaggwcttccatctgcctaggtattagatgtttccatttacctctcagctgtaaatactgcattttttgtgcttaaagtataaaactgttgtctttccttcttagtttgcatttgctccattccctcagtagttctctttatctcctttgtcagtgacagaagaataaaaagaaaaatattccctggggactggataggttctgtccaattgaaagatagttaattcccagtttacttttttcttgacccttcttccctcagttagttatttccaacaaaagccacttgaaaccaaatttcatataataaaagctgtgctttggctagtggtagctcatctgttggggagaaggaagcaaagaaggaagctccctagaaatctaagatggatttttcagttttatttggttttgcgttatacacagtttaaggggggaagaaaacagaaataacttagtacagtactttccaaatctagctgtacatcagaatcaccagataagctttgaaaaaccaaggatttcctggccatgaaccagacttattaaatcagaatcttggagggggtcagagctatcaatctataatttcagaagattcagccaggtttgagaaccagtcagtaccatggtttttagagtaagacagatgtgagtttgaaatctggttctgttacttactacctgtatgaatttcagcaatttatttaaccacccttcaaaaaagtaaaggtaatacaggtagtaaagcttcatttcattgaggtattttgagattaaatgaaataatataacatgtaaatgcttgctacataacaatcactcagtaaatcattgtttattgttttacatgattgtattatcattttctgacagatggtatttccttaggaaaaaagttagactaaatttaaattttaaatagaattctttaaaatagaacgtgaataaaagtttatttcatgacagtctcaaattagttatgctacatgtgcattatcagcattttattaatagaaatatgcaggtatagagtattcactctgtrgttttcttacaagacttgacactttttagagtattatgtacatgttgcacataggccaagatgatagtcacattcatttggcaaaaactatttagatttctaatctaacacaataaaagaaaaatggaaaagaaagagtataaaatttttttatgttggctgcttgatttacatgaggcccaacctggtttttcttgtttgttagttttgtttttttgagatagggtctggctctgtcacacaggctgggatgtggtggcatgatctcagctcactgcagcctccacctcccagactcaagccatcctcccaccccagcctcctgaatagctgggactacagacattcaccaccatgcccagcttgcttatttattcattcattcattcattcattcattcattcattcatttatggtagagatggggtcttgccatgttgcccagactggtcttgaactcctgggctcaagtgatcctcccaacttggcttcccaaagtgtggggattataggcgtgagccaccatacctggccccgacctgattttttttttaaactaaagccataactaagtaaagggaagctggtgtatgtaaaaatatgagatatacatgttgattttagcgaacatttaggtttctctgaaaatctgatatcaaataactctacctgaaacaaatgatactggtctgttttgtgttaaaataagtatctatacacactactatgattttggcattctaagtattctgagatcttttaaaaatattttttagacttttatgtttgtacatattttgagaaaataagtctgattgtggttcatgttccactcctcatacttttctaaagtgctgtccgacttaagaagaaaaatcttttgcccaatgttttggaattgttctatgatatttctgccagttatatatataaagtgcattccttttagtaaggtccagcatgatcatttcttttttyytttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctaggcctcccaaagtgctgggattacaggcgtgagccaccgcgcccggccccagcatgatcatttctaaagtgaaaataaacagtgaaaagccattagtaasttgccartaatgttgattctttggttagcgtgataaatcaaatttcccagaggcagtcacataaattatagcattatgttgctaagatgaatttggccaaattatgcttcatttgtagcagagtcaatcttaaaactcaggtctcgtaactgcctgccaagactatccctttattttgtaggtgaaacctaggcaaagccaatttggtgctcactcaccccttcccagaaatgaagttggttgatggctcttttgaaagtattaagttcaggtatctgaaaaattggaggaatattagtaatagttaacctttagctactgagttggtgctgtacctgtttatctcgtttaatttttattctatctcatatgaggtagatgttgttatgcccattttactgtkttttattatctatctagtattcaaagrttcataacatcaaaaaagtcataataactgttacaatagctactgtagatccttatttttgacactaccctttactctgttttacatatcattttatttgtcatgcaactctgtgagagtctaagtatgaatgtctacattttaaatatgtaccaccttacactaaataggttgaagtaattttgcccaaactcacacagctaatagctgaaataagtgaagttttaactcaggtctgatttcaaatttcatttctttcctgctactttatcttacttcacatatataattttacctcttaccaaaataagactagtgttacctaggaagtggggtaggcatgatagatatgtttttttcttatacatgaaggagttcttatgattctcacgctctgattttctaaactaaaaatatgttcctgttccattgttatcaaaatgtaaaaatcagttaagtaccacaatatatgggggctttaaaaagttacttagaaaatatgcattgtacagtgagccgagatcgcgccactgcactccagcctgagcaacagagcgagactccgtctaaaaaaaaaaaagaaagaaagaaaatatgcattgtattgatgtttctaattattagaaatctcccactatgtttcaaggggacttttgttaggtcaagttggaacatggatatttacggactatatcatggtgtcacataggtaattatttgttttctttgaagctaaacgaaattacaacagtatatcattcaaagtgctaagctttggatcataagtagttaatctgattaaacagcttagtcatgcattcatgataaggatataatgacaaaaattctataggttttaataataatatcttagtctaggaattctggcataagaattattttggaaatagatcatttatgtgtttctgttttcgtttacaactgaaaatagtgtagtaatattgattcatctaatatgaatattatgactacagaataattagaatcccagcaatggaaagtttgaataaaaattattaagtgtaaaagttttacttcttaagatagtgccttttcagaatgaggcaatttgacatcattgtttttgcctaagacagcttttagagtttagtctagaagttgttcaaatagaagttggtgacaygttgaagctgaatgccttcttttcttaaaaggtaggaaatgctcttctcatttgtaagttttagttttctacagtctaataatcttataaaaggtacatcgttttaaatttgaaatgtagttggaatgtcttattgaatgtcttcagtgatgacttctggttttctaaggtttcatttttgaaaaatatgacttttagggtcataaaaggaaaaaataaaaactgtatatacagttttgtgataaaagaactgaatatatatgaggttggtggtgtgcagtgtaaagctggcgggtggggagggttgtttctaagaagttaccttaattaaaaagagaataccctattcattggccattcaaagtgggaatatagatatgtggggtggagagggggacagctttgtacctgcaaagctctaatgaatgccactacatggtggagcttgagaactcactgagctacccaaaagactagtttgtcattgcagtggctcctagacattgctttaygaggaaagaaaagaggaaagaggatgagcctagatacaaagggaaaggcttgggaaaaagaaactacatccatgatttttatagtgcctcttttgttactattgttttgtaaataarataggtagcaaatccagtcattcaaaattataaataaccactaaagggagaagtcaatgctcactttagcttggtttctgctgttgttctttatggtgtgcatttgtgtttacggtactctccgaaatagctcttcacagctactttatgtataagctctttgtcacatctaatggaacttttttgaagttgtttgcatcaacttgaatctttagttgttccctaagttcattctggaatggctgaaaccacttataaagaagaaagtattaagggcattgagttacccaacgtattarttgttatcgctgaattctacttttaaccaggaatatactttggtcttcgttcaaaagcacatcatttttttgtaattaaaatatatatggagacaatatagtctttaatttagttattaagaatattggtattctgtttgaaacttggaaattctgacatcaaaattatatttattactgattagacataattgtatcatttggttatttttatatctaagctaaagtgatcctctctaatcctttatactctaggttttttttgtaaggatataatgccaaaaattttgaaaaaaagaaaacaggcactgtggctcacacctgyaatccctgcactttgggaggctgaggtgggagratctcttgaaccaaggagttsaagaccagcctgggcaacatggcaaaaccccatctgtccaaaaaatacaaaaattagctgggtatagtggcacatgcttgtagtcccagctactctgcaggctgaggcaggaggatcacttgagcactggggaggttgaggctgcagtgagccatgatcataccactgtactttagcctaggtgacagagtgaggccctatctcaaaaaaaaaaaaaagactgaactttagtcttttaatgttatatttctggatttaaataaaaacagaagaaagataatgaagtgtgctctttcattcttaatctttcatttttattcttatcattaaacatatggaacacatcttaggtagaccatatatatttttataattctatattttgttaaagatttatatattttagtattgcctccttaatagatgcattcctacaaagtttgttctgtaagaacttcctatttattgtagtgattttttcccagtgattttcattataatattaaaactataagccatttttctacttttgacatctaaatgtcataaaaccttatttgcttgtaaatatctatattcttaaaagtagtatatcttccataaaatattaacagtaacttgaaatattaataacatttctgcagtgtaccctaaagaacaaccagaatctttgactagaaggaggctcattctcatttttcttcacaaactgttcgtcgatcatagagcaatcacataagcttagtgattagactacacttgttttttgctagtgtggaactacattattgcttcaaatttatttccaagttagcaatatttcccccgtagcttttttctttccttgagatgtactgatcttttccaaaagtcttgattgacatcacttctgttttaaaatgctgatcataaaagatgattattgttttaatgtttgttttatctattataaataggattaatcataaaaggatagaatcatgaaggcatcatttggtaggtagacgtcttaatagtattggtttattgggcccgagaattctataaatatgctagtcattgtagggtaatgttgaagcagttgtcaaagtcattaaacttacaagtttatcaagtgaatttcttttgattatttctaaatgcattttcttcttagtacccaaatttctcacaattgaaaagcaactgggtgttgggacagaaatatagtatttggacattagagggtctggccttgacatttgatgctactacttaactggctcttatctaaaactggtatcctaaaagccttaatttcttagtgccagtgctgtctgtctatctcgcaggttcattataagtatatgaggtaatatgtgtgcaacaggaaagaactggcccaaaatgttagtgttgctgggattaagaaaccctgctctgcggmattctctctttgatatttccctgccttttataggaactctttttcacctaagattttccatttatgttttgttcattctttatcatctgctcagagttgtaagtttaccacaagtggagacctgggatgtacacccagggaccagagtcaccccataactcattttctcataaattgtttcctagagaagcctcctttttcagctagagccctttggatgccttttttcttttcttttttttaatttgactyttccaacktagttgaaacacagaatctccgttaaccctcaatgtacactggtcttaatcagatcaagtttttaaccacaaggtaaaatgtttcactttgctcatgaatcttaagaatgggccatccagagtggctgtacccagaacaacaggtttactgttgtttgtttcactccagttccctgactttgactgctctctttgagtattgccttagctttcatttctaatctgtgaaaagatgccttccatttgcctacagccacttttgcatagattaattgtactagtttagtctgagttaattttaatttaatccatttgctaaggtcatttgctytttttttttttttttttttttttggagacagggtcttgctgtcacccaggctggagtgcagtggcaagatcatggctcactgcagcccgggttcaggtgatcatcccacctcagcttcccaagtagctggaaccacaggcgtgcaccacacctggctaatttattttttttaagagacagggtctccctrtgttgcccaggctggtcttgaacttctggaatcaattgatcctcccactgcagcctcccaaagtgctgggattacaggtgtgagacaccacgcccagcttcatttgaatattggaaatacactgttcctaagtaatggtcctgggaactttacaacartactgtgactattctcttttcaaaaatgtgtatcggcttaaatatttaagagatgggaaagagaagttcctgatgacattgtatgcaccacggtagcaggtgatgtggtgactgtatctctgtttaggtaataacacttttggcctcatactagcgtttgaattagttccggaaacatatgtgtcacattttgtttcatcagctttccatctcagcattaatgatcaaggcaaaaaataaagcagtgtgctttttgtatctaacctcatctgatttcatggttgtggtgagattgcacagagatgaatagaggactttgaagtatcacttttctagttagattttcatctttcctgtgcatatttaatcgagccagaagaatgagaaaggcctgaagggtacctctatcttctcttcctacttcagtgaaaggacttcctctaatagattaatggacagaggttaataataaaggtattcacaggaatgaaagaagaattgactaagacagaaggagaytaggtgctactatggggtaggtttatcagaattatgacttccatagtgtactgtatattgaggcatttcattattcatattttttaacaaaacactctatttggttttgtgagtattgtgaagaatgttattaagccagtttgtaggtaaacactgcctcaggtttcatcaaacttggcacttaaagttaggattcaactctttcactgcagtattacagaggggctccatctatttgttacctgaaaattgcctggaacagtgtagagattttaaaaactacttccaagcaaaacttgcagtgatgtcactcattacccattgctctaagaaatgccctcatcttgctgtctaggaagcacttttcatggactgctaacttctgttagagctgtatcaattacaagcagtttggcagggtaattctgatatgtaaagctggggaggaacattgtttggttaattaattcatttggttaattaaaaagtgaaattatactttgattcatataagtgataccatgtagaagaaatataaatctgtgtttagatattactgtcaaatattaccaattctgaaatataaggatattcctattccttctcatattcctatgagaaggaatgtcatagctggtttaggtaaagaaattgagcatatgcagctaaacccactctggactcttttttttttttggcaactacctagacgcacagtggttccatagtgcctgctctaccatgctataagcttagggarggctttgctccagaaaaggaacctgtaattagctcatgtgagtgagtagatagccacatctaataaaaggttaagtattaggaaattcttgtgactatacatacaaggtacattctccagtaataaaatttgtattttgatatttttatcttcgtatttctttctcttctgtattctcattctctcatctatccatattctctctccctgtcttcatctttctctctctcttctatcctacccatcacctattgtatttagataaggaaaacagggttattttgtggcctccctataactttaacaacacccttctccattttttgttttccatgagtggttgtcattttcctactaatttgtagttctttatataatctgactactaatcctttgtcagttatatgttcacacatatcctctcccagtcctatttcttatctttatactttgtttatgttccatgtggccttttattgtaggagygtttaacatcatcagatttatcagtctgtttccttatgatttgtgggttttatgtcttcctaaagaaatccttcagtacacacaaaatcatatagtcttttcttcttttttttttttcttgagtcagagtctcagtctgttgcccaagctggagtgcagtggtgtgatcttagctcactgcaacctccgcctcctggactcaagcgattctcgtgcctcagcttcctgagtagctgggactacaggtacccaccaccacacccagctaatttttgtatttttggtagagacagggtttcaccatgttggccaggctggtgtctaactcctgagcttaagcaatctacctgccttggcctcccaaagtgctgggattacaggtgtgagccaccaccrctgctaaaatcgtattttattttaagtactttaaagtcttaccttttatatttaggtccttatctgaagttttcgacctgacattcagtgtacagtgaacacactcatacatctcctcatgcagatatgcaccrtctaaagatggaggctactagctacatttaactgtttaattttcaactgattataattaaatagaatttaaaattcagttccttagtttcacagtagccatattttaagtgctccatagccacggtagtgaatgactactctatcgaataatgcaggtaaagaacatctccttcactgaagtaagcagtcttttgtggtcccctaggacctttaccaggactctcctcttagcgggctttgagtctagcttctctccccctgtggcccagaagtgtattgaaaagtcagctgccttcctattcctcaatagcttcttcaaggaatttttgcccacaggcagyatatttttcttcccagatccaaatctagcttttattctacctttgatttggtctatcaagtaaataaactggcttatttaaaaatatgtcatattcagygttaactttaaacaaattataaaagaaagtttgttktatgtatctaaggtactcatgtgaataaatgagaaataagtaggcattaacttgttatctcttgtttatttatttgtatatgttttgcttgctcgatcatcaagtggctttaattcttctgagaatattagtaaactccttgtgtatctgagagttcttagaaacctgaagcttctagtacaactttgctgaaacatgatttgtcaggagaattataaacattgcacattaacccagtgagaacaacccaactttaagaattaaagctaaattgcctgatagtgatttcagtaaggctgttgtttatgcacgtacacattagcatccatagtgctaccaactttaaaaaatgctccagatttgagtacactcagaaagtttctaagatattgaaaacagtattcttaaagttcctctgttttctgaacattccctagtgtacaagattttatatatttatccaaatgaaacgttgaccttcaatgtaatattgaatataagattgcagataaactattattacaggttattcctaataaacttttagttgctgaatgttaacaataacaatctttacttttaaagcactatagacaaaagtktaatttttatttagcaccaataaataaatgatttaacattttaaagtatttaataagactgaaacccacagcaaagctgttctctggtgtacaattactggagaagttcactaggtcagagtaaaagcgaagaagatgtattttaacatctaatatgcaatgtaytttttgtttcttaatcaraatgtgaaaaagaacataaaatacagaattttattttcattacaacttaaaccagagtttaacatctataaaatatgcttcaaaaattagaagtttaagaatgtcatcacttatataagacaaaaataacacatgtatagcccatctaaatcattcttgaaaacagaccacacacagccttacatttttaagacaagagggctttaaaatgtaaaaggggagaaaatgagacttaatgacatattagaactaacatcccctgagtattgattgaaaggaaaggtattgtgtaataaggaacatgttcttccaattcttccatcagtctcagtttactttccactgcgtcctagggtgagaaagtaattaattctctgtacttattgaattataagtgtttatgaagcaacaacttgaaatgacttcaatccctacttaccggccataggaagcagtagtattggcagggagaaagcaagtttggacataaggactagacttcagggctgtccaatcttttggtttccctgggccatgctggaagaagaatggtcttgggccacacataaaaaacaaaataactctgacgatagctgatgagctttttaaaaaattgcaaaaatctcagtgttttaagaaagcttgctaatttgttttgggcccaggttcaaagccatgttgggcccaattcaaagccatcctgagccacatgttggatgaccttggactagagaaaaaaactcactgaagcctccatattttttatagtatcttttctgtgggatacttattaaattaaggttgagccatttttaaaaaacgtattttctctgtgaggaaaagcaaatctgtcttaatgagttacatgaaatkatwtgaagttatatgaaatctaagggatttgaaaatttcaaaaagatttaaaggaaatacatcagaattttggttgcatttcagttaacagatttatttatctagatttttgaataaagtgtttttgaatacttaattcagaattgatgatctgcccatgaccttaataaaatttcctggtttcatggcaatggcaaaaacagtttctaggtacttgggtgagacacatactagcaggtgtagaagtagtaataaaaataatgatttattatcagaacaacacttcttacacctattcaccaattttctttcaggatatccccataatattattattcctaaatagcaaataaagaaaataagccaaatgcaagtcaagtcactttatatcttcctcatycttccattcatttcctcattcgttcattcattaccctccttgtttcttaaacatcaaatggtgccttgaggcattaaacaagttgataaaataaaacaaaagcatgaatacttgacatatttctctcatcactaagacaacatgccagttagtcaattaaaaaacaaaaataaatgtatcaaamcacgtggtattatgtggagaagacttgatcccaaatgttcccttttctcgaagttatttgctgttgtccatactatccacgctatccaagtttacctggataaatagaatgcaatcagaattatgttgaagctaatttattgataaaatatataccaaaatgtattacaaacataaaacttcatgaggtcagtattattaatttcaaattttgggtttttttctaacattaaattattyaaaacttttatttaaaaatgccacattcaggtaaaaggtagtagatgggaaaatttcagcagtagatatttcagaatacaatggttgtagaaaaagggattatgagtttatttatgtgcagatatacagttatgtttttaaaatctagattataaaactgatataaaattcgagtttaacaacatatcttattaagataagaatcttaatgcactatgaaaagaaaaacaaaacaaagcccagataacaggtttcttttggtagtgatctacaaggtattagggatatgatttccctcttgttctgctgtctctctgtccctcagtgattacaggtagagcatcacttcaataactcttccagtcagtattggtggtgwcagccagtctgacctgaaaagaaaccaataccccttcccaacctggaaatgctggtaatttatttcaccatccccagcttccctatatttttccccatcctaccagcaaactttgtttatataaaatgcagccaaatacaattaagccaaatacaagtcaaatcttcctcatcmttccattcatttcctcattctttcatttgttaccatccttgtttttttttttttattgagacggagtctctgtcacccaggctggagtgcagtggtgcattctcagctcactgcaagctccgcctcccaggttcacgccattctcctgcctcagcctccctagtagctgggactacaggcgcccaccaccatgcccagctaatttttttttttttttttttttttttagtagggatggagtttcaccatgtgagccaggatggtcttgatatcctgacctcgtgatccgcccaccttggcctcccaaagtgctgggattacaggtgtgagccaccgcgcccggccacatccttgtttyttaaacatcaaatggtgacttgaggagttaaacaagttaataaaacaaaagcattaatacttgacatatttctcttatcactaagwcatcatgccagttagtcaaaaaacaaaaataaattcagagtacctctttcacatgttaaactcattggattatttaaatactaagtgatttaacatagtttttctgagcatttcacacacaaaacattttttttttccacatgagaccattacttctgaatwttaaggaatttcatatggtgcatgtttgaggaatttcgtatggtgcctgctgtaataggatcttggcttatttgcatttgttgatcagatgsaactaggtatagagattggatgagggaagagtaaagtaaaattacagaaaacttttaaggcttcccaagtttgttaccgtttgatagtattagaaacaatgtcactgtaatttccattttcaggcctatgtatagtgttaataagattcttgccatgagtctctttactatttatagattagyaggagccatttttatggcaatccaaagctctctgttaaacttaaaacactgtataaaatgagttgaaaagattattaataatcttacacagaatgatgtccttcagttcaaagatgttaccagtattaacagtggcacttgttttaaaagartaaatatcctactcttgtttttcattagaactctaagcaagactacaaacaaagttttcattgcaataataaatctttttgaaagggttttctgaaaccactggatttacatactttacatttgccctacctaagtttacggtaaggagccaaattcatttagcataaatattacaacccatgaatccagacatacagcaatttatgggggacattagtcttcttattatagaaaacgtttgtttaaataatgtgaataactaccaatgtttattataattttatattttttccttattcatctctaataacaatttccgttacttcttaaatcatccccgggttaagagaacataggcatttgtaagtagcaagtattacaaaaacaaataagattttttacaaaaagagaaacatcaaatttcctgttaggctcactgaccatgctctctagtgtcactctagttcctctttataagcatacgtacttaggctgcgcacagtggctcacgcctgtaatccgagcactttgggaggccgagatgggcaaatcatgaggtcaggagttcgagaccagcctggccaacgtagtgaaaccccgtctctactaaaaatacaaaaaattagccgggcacagtggcggcgcctgtaatcccagctacttgggaggctgaggcaggaaaatggcttaaacccgggaggcggaggttgcagtgagcttagatcacgccattgcactccagcctgggtgacggagtaagactccatctcaaaaaataaataaataaataaataaataaataagcatacatactttaccttcatggatgttttaaggggaaggcaggtgttaagaacttataaaaaatacaaagtgttaactttagaaattaagagtttttgaatgctgaacaacacattccatttaaataacgttaatagaaacagattttgaagcctctaacatcatggtgcattaagagcataagagaaacgagccgggcgtgatggcttackcttgyaatcccagcactttgggaggctgaggtgggcagatcatgaggtcaggagttcaagaccagcctggcgaacacagtgaaatcccgtatctgctaaaattacaaaaattagctgggcatggtggtgggtgcctgtaatcccagctactcagaaggctgaggcaggagaatcgcttgagcccgggaggtgcaggttgcagtgagccaagattgtgccactgcactccagcctaaacgacagagctacactccgtctcaaaaaaaaaaaaagagcaaccagctggagtcaccgagcatgtagctgcccagagcctcctccctacatcatgtgtgtagcttgttccatattgtgaagggtgtgtatatgtatatgtgcacacactggcacacaaattcgtatgcatttgtcttactaaagtgtttttgtctcccctacggtctttaactgcctggttgaaccccttctgagaccactactctgtttgaagggatcttgccagcctctccctagaattgcatctctgattctgtttcttctcagatacacattcttaattgaagctaggacttaacacagtcctaaaaattaccattaattaggaccattaaaagccaaaacatcttcctgccttaggattgggtcctttaattgaagctaggacttaaycctaaaagttcccaatgattaggaccattaaaatccaaaatatcttcctgccctagcctttccttgacctgaaattacctttgctaaaattgacctgcaatgtatttcttaatatattttctgttactcgttatataatggagtaagattgtggtgggaagaaacagactcaggaatgtgttgacatttgcaaggtttagaatctagatgaggcatgaacttgaattctggagcttcttgtggtagcctgatttaacatagttaaaggccaacataaaattaatactggcagacttgaggcacaatagtactggtgatgctgtgagtgagtggtagagaaggagtggtctcttgagcccattgatgaagsctggcggtctggggaagtgaatctaagtccaagtgtacagaattcatacttaacctctttggaaaagggcagactcctccacatcagagctactccttgacctctgtgagttcctgatattctgggtcagtaaatagatgatatagatacagatatagacatagtcataggcatagacatagagcctggttaggagtatgaagtagatccaaatcctgatttttaaatataaaataatgttaattacattatgcaaaatgatttttatgcagtatacatttggaaaatttaatgacccacagaaattgattttcagaatcattgataacatcattgttttggatttatgaaaggaacatagcagtaatgaaagaaactaaattatggaatcttttcaatgatatactcagaggtktttttttttttttttttttttttttgagatggagccttgctctgtcgcccaggctggagtgtaatggcacgatctcggctaactgcaacctctgtctcccgggttcaagcgattctcccacctcagcctcctgagtagctgggactacaggcacgtgccaccacacctggctaatttttgtatttttagtagagacggggtttcgccatgttggccaggctggtctccarctcctgacctcgtggtctgcccgcctcaggctcccaaagtgctgggattacaggcatgagccaccacacccggccgatatactcagagttctaatgttttatctgttatcttttcatataaatccagagctatatacagattagttaatcccatggcagaatgtataaaaatatctgctttcatgtagtttttattttatgtggaatatttacctaaaccaggatttagttttcatctttactaaatttttcagatatacatatgtatgtatgtatttacttaattataaaacatgttctaaggaagtaaaagatatctttggatgcctttgcagaacgtagaactacttttgtttaattctgtgcccttacatattttttgtttttcttaattcataatgtggaacaaggccttctttttttctctgttccaaattttgaggtaagaggtatggcaattcacatattatgattgttttagagatgaacttaaattcacagggctttaataaacatcagccctgaataaactgaatatgtaaaacactagcactgattactctattccaaaaggaaagtccacattttctatgttaatacattttctactgcaattatttcatatggtactcagaatcatgcgggaagttgcatttcttttctctactcttcctgtatgtcatcttgggagcccaagcgaattttatattcaaaagagcaatttatgctacttattaatacatgttttttaacaatctttagggataataagttgacatagctgagagtagctgagggactgatggcatacgcaatctgttaaaacatttctttgaagagaaagcttgtgcttgaccatggttgctcggtggagagtgctcctatgcataccacaagcttggccttcagtttggaatagctcttttcattgtttgagtttggttgcactgagaaggcaagcttgttactttactgtaaaaaataaagtgcttgtccaagcttgttgcatgttggcagttgagaggctgctcttttgctggctggaacgtggacaactttttaacctctccaaggcaacgtagctgtgacaagatgtcagttaccttcaaaaagtaaataaatcacagcctttgagtttcagcataataataaagatccaatgtcctcacatgagtttctcattccacaattttgaatcatatttttttgtggcaaatgctctaccttcaaagtaaagcgttttaaaaatacagtttagagagccaggttccctgagaggaagattattaactcacaaggaaagaacagtgaattatctttaataaaataagctaagaaacaaaaacattaaagttttgtttgaaatttaaccttccttgcctatgttctttaccaaatcaggaaatactagtgtagctgtagtgtgaacatccttgtatttaagagagtgaatttaaatgtttcaaatactttgtaagacaattaaacatttgctatatgtaagttcaccttagacttacaaatttccaggaattattctaaattcattctatagaacactacctgacaagttggaaaatatggacgtaagagtctttatggcttaactgtgttaactggctgatgtttaacaacaatctacgtttcccaagtttcactccaaacccgtaagttgtactgtttcagaacatcgacaaaaacaccaatcactagatgaatagagatatttgattgaaaacaaactgttctacaaatatattaagcttgaatttgctaatctttatcaagtaattcccagtgctcaaatgtgttttgtagagtgacatactttgctgagcaaaaatggggtgtttgagttttagtttcaggtgttcttttaaccttcaaaaatagtggccgagttaatcttgggtaacaagttatcttaaaaaaatgaagaagaggccaggcacggtggctcatgcctataatcacagcactctgggaggccaaggcgggcagattgcttgaatccaggagttcaataccagcctgggcaacatagtgaaactttgtctttactaaaaatacaaaaaaatttagctgggcatggtggcatatgcctgtaatcccagctactcgagagactgaggtgggaagaccatctgagctggtgaggtcgaggctgcagtgggctgagatgatgccgctgcactccagcctgggcaaccagagtgagaccctgtctcaaaaaaaaaagtgaataagaatatacaaaacaataataataacagaaacagtgcattagatgaaagttcaaagtcttttgtggctgattgaaaaatgtaataggacygctaatgccttttatggaaagaagcaatataaactagtaatttaatgctttactccatttctacatagcatcttttaaaatttatttttagtatatcttgtcttagtggtttatgctggkgttaatattctggagataatattacatcagaattctatatcacacattttgtttttcactgtttaagaaaggtaagtaaataatacttcagaacagtgatctctgaactttttcattgcatatacctgagtactttttagcatatactactaatatgtgcatatttatttattttattatatgcaggttttatgcaatgtatataaacatataaaacaggaatttaaaaggatgtgattttatgtcttaaaaatctattctaataattttatggccagcagatgacttttttctttcctcttattttgtaacttttaattttgacatatgatacgtacacataaagttgaaaaaaatagtacrtagtaccccataagccatagcccagcacccccaatggtgatatcttatatctgtagaacaatatcaaaaccaggaaattgtcattagtacaatattattaattagactacatagcttattcagttcttatcagtttttacctgcactctcatgtttttctgtgtgtgcaatgcaatttgacccctattacagattcatataatcactactacaatcaaggtagagcattatatatttgatcaccacaaggaaactctcttgygtactcctttatagttggattctcccatcttcttttctctgtcctctggcaaccactagtctgtgtccatctccacagttttgtcattctaaaaatgtcacagctgggcaygatggmttgcatctgtagtcctagctactcgggaggctggggtgggaggawcccttgagcctaggggttcgaggctgcagtgagccgtgatcgtactgctgcactccaacctggatgacagagcgagactccatctctaagtaaatacataaatcaaaatgtcacataaatacaatcatgcaatgagtattaaycttccaagattggcttttatcactaagcacgttgttctttagatctagccaagctgtatgtatcaatagttgtacttttttttttttttagaaggaattcttgctcttatcgcccaggctggagtgcagtggcatgatctcagctcactgcaacctccgctcccaggttcaagtgattctcctgccccagcctcctgagtagctgggattacaggtgckctccaccacgcccagctratttttgtatttatttatttatttgagacggaatcttgctctgtcacccaggctagagtccaatggcgcagtcttggctcactgcaacctccgcctcctgggttcaagtgattctcctgcctcagcctcctgagtagctgggattacaggcacccaccaccgtgttggccaggctggtcttgaactcctgacctcaggtgatgcacctgcctcggcctcctaaagtgctgggattatargcgtgagccactgcgcccagccagttgtaccttttttattcctgagtagttacactgctttatggatgtaccagagtttaaccatttatctgtctaaggacatttaggttgtttccagttttggactattatgaataaagctgctgtgaccatccacatacaaacttttatgtgaacataagttttcatttctttagaataaagagtacaattgttgaatcatatgatatattagtttcctgttgctgctakaacaaattaccacaggctggaagcttaaacaacacaaatgtatcacagttgtatagcttaacaatccaacatatgtctcatcgggctaaaatcaaagtgttggcaaggttgcattcctttctgaaggctttagagaagaatctattcctttcctagtttctcctgttattcttggcttgtagtctcttccttcatcttcaaaggagcaatgttgcatctctctgtgcctttccttcgaagtcacatcttcatctgctaactttcttctgcctcccttttccacttttaattcttgtgtaatgttacataaggtagttctgttttaaggtcaactgatcaacgacctggatttcatctacgacctttatttctctttgctatgtaaagtaacatattttcaggttccaggggttagaatatgaacatctaggggttggtaatgttgttctgcctactgcatatgataaattcatgtttagttctattttagaaactaccaaactatcttccagagtggcatgtgactttatattcccaccagtaatgaatgagaaatctagtttctctacatccctgccagcatttcatattctagtaggtatgtagtgatacctcattgtgattttaatttgcatttctctaatggttaatgatgttgaactttttttatgtgcttctttgccatacatatttcttctttggtgaaatgtccgctcatgacttttgcacattttcctttggatatgtggtttatacaagtcctctgaatatgtggtttgcaaatattttctctcattctgtagcttgtttttaattctcttaacagggacttttgcttgtgagaaaccttataaaatttcagttcttgccttacatgagtgatgccacatgctacagtcatgaatatctcatagggttttaaagaaaacattcatatgagacagtagtcattacttaaagctgtgtttgaagtaagactttgtgctgatttggatgtagttagagttggacccagtgatgtgcttgaactggctcttcccagtttgcaagaggcaygttytgaagtccaagaatgttgcaagttagtttttaaacagtcagtagcyatgttgggagtatgtatacaatggaaattggcaatcactataaatcagtgctcccctcctcactggagagtgggtagttaaatatttaccaactctctaccagtgagactggcaaagaatttgtcaagaaattgagtatttttttcctttaagtcagtgcccattgagatatatcataaataaatatgtcagggtattctcttcaccagcttataatatttgctttgtattttttgctattttatttttatttgtgtttcatcaattttgtcctgttctaattacaatttttcagaatgtcagggagtacagtggtatataagtagtatagtttaatggtgtagattagaccatacatttcagaatcagatagacttagcttacatcccacctcaatttagtagctgtatgaacctggcaatattgtcttatatgtaaaattatgacagttattatacataatrcagtcagccccccaaatttacaggtttcaaatccgtggattcaacgaatcaagggtcaaaaaaawttttaagaaaaaaaaacagtaaaaaataatgcaacaatcaaaaatttaaatgttaacacaaatgttgacaatacagtatagtaactatttacatggcatttacattgtgttagctattacaagcaatctagagatgattttaagtatagggaggatatgcagaggtyatacgcaaataactacaccattttatataaaaaggacttgagcatctgtggaatttggtatcctggtgggggttagggaggggattggaaccaatcctctgcagataccaagacaactgtatatactttgtaaagcttgtataagatgatactcataaagcatttaacagataatgtctcaataagtgttttaattgttatatcattacaactatcaccattataatctcaacagggaaagcctttcataatcacagctgattaaaatacctttttagtattcaggcatcccctgcttaacacttaatatcctaggaaatcagatgtcctacttgaaaattctaaccaggaacccattcccccaaatccccaaccaatttcctaaaagctaactaaatgcagtgaawtatytttaaagtaataaattataatttggggatgtaaaatgcttaaacagtggtttcctgatgacctaacaaatctagccttaaggaaccattgctaggttgatacactcagaggacttttcgaaatgtctacayatgatcagacctttctaccagttgtgtttggaatgtaacaggagacttccctccatacattcttttgtttaaaatgttatgttaaatttgaggaatgtaagtataaatttttcccatataaacatcagcaggaaaatgttgaatttagagacatatattgcctgagttatgggtgttaaaaccaagaggaattctatcagaaaatgttaaccacggagactctgtaagtgtgcccgatttttatttcctggtttatttactagatgaagtggatrtaactaacaggaaaacacctgattagtgctgcagactctgtgttcttatttaattctcatacaactttggaagttaaaagaccttaaattaattttgcaaagctgtacaactccttcatttctgagttgaaattcagttctactgcagtagctaatagctgtccaggaacagctattagaaaactggaaaagcatcaaggaaagcctactgaagtgtgttttcctttcgatccagtgtcttcttttctagtaaatgtcctgtctatccccccttcccctataggaagttttcttctctttcttcagatgctattatatgagatacaatttataaattcttttttttctcatctgacagtagcttttttctatacaatcagttacctttcactgtgtttttcacccatcctttttaaaatatttctgatrtcaggatttgctgcaaaagaattaacgaaaagtatcaagaagtttgctagagctttctttctactcttgcttctctcatggaatcaagtgraaaattgggctttcttattttatttcattcactgagtaactactcacaagaatgtctacttcagtaaggtagttgaaccaagcatatcctgacrgcctcatggaagcaatgaatcttttaatttatattagagaggaaaacgaattaatgaggaagaaaatcataagtagatggttaggcattctagagaattatatttaaaattagctactaggtcacttctgcatcagttgttctacgtaaaagtgatagggtatcccctcaaatgttaagtcacattctggccatcctttttcataggttgcactcaaattactttcaggttagttgtgtttccttttttttttttttttttttttgtgagacacggtctagctctgtcgtctggggtggagtgtagtggcacaaggctggagtgtagtggcgcaatcacacggcacattgccacctctgccacctggacgcaagccatcctcccacttcagcctcctgggtagctaggactacaggcacacgccaccacacccagctaatttttggtttagtttgttttgttttggtagaaatgagtttcgccatgttacccagggtggtctcgaactcctggactcaagtgatcctggcctcccaaagtgctgaaattacaggtgtgagccaccacgcctagcccagttgtgtttctgtacaccagaagtgaataatctgaaaatgaaattaagaaaacagttgcatttacactgtcatccagaagaatagaatacatagcagtaaatttacccaaggtgagatacttgtatactgaaaactacaaaacatttcagaaagaaattaagaaaatctaaataaatggaaagatatcctgtgttcatggattgaaagacttaatattgttaagatgtaggcactaaccaaagtgatctatgggttcagtgcagttcctatccaaatttcagtgacattttttgcggaagtgagaaggccaattctcaaacccatatggaatgcaaggggccccaaatagccaaaacaatattgaaaaagaacacagctgaaggactttcactttgcaatttcaaaacttactacaaagttaccatattcaaaatagtgtgctactagcataagaatagactatatgtagaccaatggaattagaattaagagtctggaactaaatccatgaatacatggatttatgaattaatcgaatatccacaaggatactaagaccattcawtggggaaataatagattcttcaattaatgctgctgggacaactggattttcacatacaaaaattgaagttggacccctaccttataccatatataaaagttaactccaaatggatcagtggcctaaatataacagttgccataaaattcttagaggaaatcatggggtagggatcttaaagactttggatttggccatgggttcttagatatgacaccaaaagcacaaggaaggaacacatttaatggaacctcttggcttataaaccataaacccagaccactatgtcaaaactattataaaaatcaaattagacccatgtaagcagactatatagccactgatttggatagtaatatgagaccaaatttttatttgttgacaattaacctatatacagtaactaacctgtagagtctgcatctaagaagttttgtcaaactttccaaagctaaccatcaatgtcgttatggatagaaggtaccaaagtctttagtgtaacatatttagacaatagaggtgttaggaatagtctccagatggatactaaattggttcttatccaacaacattaagaaatagccattcttctgtagttcattgtgcatgttattctcctctataatatagtaaaatatatattttgtcttccagctctgttttcctggcatgcaactcctaaaatccttagaatttccaaagtagtatctttttctatgctgatgagttgactagtggcttcagggtggggtcacaggagagaacaaggcatgattataggactgggacttgaagtccatcccacaaactccagggaggggagaggggctaaagattgagttgatcactgatgaccaatgatttagtcatctgtatcctttgtgatatctttaataataacctggtaaattaagtgtttttgctgagttatgtgagccactctagaaattaattgaacccaagcaggggtcatgggaaccctgatttatagctcatcagtcagaaacataggtaaaacaacctggggcttgtggttgttgctgtcgggtgtcagtctcctggggtcctgacactgtctctaggtagacagtttcagaactgaattggaggacacctatcaggtgtatgttgcagaaatgaatgattacttggtagtagggagaaatcccccatatatttagggttataaagtcttctgtattgattgctgtggtatgagagcagagggaaaaaaatttttttttcaactcatatcctcccactccccatagctgctcttgcctttatcagtgttgtgtgtgaaagtctgtataaggatagaaaaggagattgaggtggccctatgaactgcgtagccctggattccattccattgagttcagccaacgggatgcatcaagaattttttttttttttttttttttttgagataggtttcactgtcacccaggctggagtgcagtggtgcaatcatagctcgctgcagccttaaattcctgggcttaagcgatcttccacctcagcttcctgagtagctgggactaccagcatgtgcccctgcacctggctatcaacaggaacttagaaggtggaaggagaaagaggtcaggatatgtattccckctccctccctgccctagaacctcaattctagtattggctgtatccctttataactgtatctcttgtcctttgagccttcaccccacttcttcaacagcttcagctttgggttttgataatactgtctcctcccacttactccttccaggtcctaagcagtaatagcttcctgcagtccctagactttggttccgtcagcatgccttaacctttccagcactttgggaaatattccctaagttgatttrtcttcagagtctctaacaggaccctgactaattttctattttatttttacaagtaaaaattgtatatatttatggtgtgtatgatgttttgatatatatacacatttagaatggctaaatcaagctacctaatatatgttttacctcacatacttattttggaagatgagaacatttaaaatctactgccttagcaattttcaaatacatgatatattgttaactgtagtcatcatgacatacaataggtttcttgaacttattgctcctgtctaactgaaattttgtgccctttggccagcactacctaatcyctctgctaaccaccatttactctctctgagttcaacttttttacactccacatataagtgagatcatgggatatttgaatttctgtgcctggtttatttcrctttatgtgatgtcctccagggtcatccatgttgtcaaaacataacagactttccttctttttttaggctgaatagtattccattttgttgcacattttctttatccrttcatttgttgatggaygcttaggttgatttcatatcttggctattgtgaatagtgctacaataaacatgggagtacagatagctctttgatatactgatttcttttcttttcttttagatatatacccagcagtgggtttgctagactayataatagttatattttttattttttgaggaccctctgtgctgttttctgtaattgcttatagaaattgactagttgacattcccatgtagaaaaagggaycccttttttctacatccttgccaaccctaatttttttatcttccaacttaatttttttttcctgttggctaatacaactttggcctgtcaaatcatggtagacattctgtgaatagtaycactgtagtagaagccagaatgttttatagaggaaatgtagaacagaaattaaatctggggagtcagataaatagaggtagattaaaaggatctttcatattagtgttattgcatttttctcartgtctccaaagagtttgaaatgttgtatacgttatttagaattgtactcagaagataaagtattttaccaacaactgagcttaatttttatagtttattagtatcttcatttcctagtctccgaagaccatcttctcataaaagtgcttatatatgtaaaagtttgtttgcattttcaacctgtatcccttgatactcatccagaaacctagggtgagaatacctgtgttaactgtttttaaaaatttccatgacatgtttggtcaggggagaagaatgttctgtgacaagtgccagttttaytggtgaggtagaaaaggccttagaaggtgctagtaagacagaaaaagaactgtaggaagaaatcagtatcggagagcacagagatcctcaatccttggatatataccacccagtgaagcagatcagaaagacctatattttatagtgctgtcacaacatacaagctggaaagcaccctattatatgtgaattggccacagctaagagtaaatgattgaaatcttttaaaacttttagttacattgtttacaatttggggtaaatgtctagataagtcatktaaattttttcacctaaactcataattttgcttctagagtcctaacgagtagtgaaatggagattaatcttgaaaatcccattascttacatcactagaagcactttgtccacctgcttcctggacctagaagagtaaacctgtggttgtccagttctaggtggtagctttaagatactgcaggcgaagacatatatttgtgaccagcagattacaaacaagcaagaaagtgtaatcccattctgctatatttttaatggacaggattggatatatctttctaatcatagaagacrtctggaagaaaatggtttctgcagagggaaattaatgtattgaaggtgggaacaagattttggtttttacatacacatttctgtactgtttgttgttgctattgttttaccatgagtttgtattactcaataaaataacaaaaatggtgagatcaggaaggacaccttttcttgctatgtagattatttttgcctcatccttggttccttagtttccatttccttacagtattttccagttactcgtttttaacaatctgtggggtctgtccatagtttttcctttttcttgtcctgattaatagcctcccaatttattttctcatcgcctgcatacaactcagaccctcctattgaacgtgaaaccttctacctattcacccctctacacagatcacgcatcattttcttgtcttaactgtttcagttgttccgtgatttttgttctatgcctttgaggatttattgtttacaaagaactaaagtatttttagtttatttgtttaagctaccctcaaaagataataataggcaaaagaaacaccgtaagaacataccaaaattccactgaaagctaactagggaatgttggcttccaatcttagctagaaaatgatcaaaattcgatactggttgattttttaaaatatgaattgtgagtcatattcaaaaagagccacagcttgcagttgtagtcccaaactaaagtaggtatagatagatagttccaagagatcatctgtattacagggatcaggcaaaattgctttcacctggagagccgtttgcatggaaatacagcatggttagaggtagccctctggatccgactgcttgcttcaaatcaaactgcactttcactgtgcttaacctcagtcaagttacttgcttcttttggctttaatgttatcttgcataaaaatcagkatatttaaaatacctcactagtttgttacatgattaaatgagacaatgyatataaaataacacagagcctgttatatggttacttttagccattaacagcataatcataaaatatcacattataaagttgcaagagattctttccatacctcctcaaaagagtttttacttggaccttccagcatttgaagctatgtcaccagtggcagtctttttgacttcatataccttccaaataagtagttttattttcaaaaagctgaatgctatagtartggtgtttatcaaatatgttaccaatatttgaagttttgataccatttcttatatgcagattgatcttcgtgtacaagctaaagctaaaccrtgctaacaatatttaatgggtatayatcctgtatagaataaaatatttcctgaatttcattttccttttccagaattttatacatacatgctcatggaaacacacacaagcacacctctctgtgccctaacaacaacaaaaatcttataagtttagacttcttttgattaaaatcatatggttagtcccaaaactacaaatatatttttaatttaagtaaaagaggacactccaacaaaactagtattcactgcacctctgagcatagcacacatcctttctgagttcaggtgggtacaattagctgctastaaaaatgaaccattagtgaagtcagtgaatattaaatgtgggacttacaaggctaggaatgacaaataatgggaaaaaacattttgtactctaattttaaaaasaactatttaggagacagctgtagctggggtagctttctcttgtagaggcatttgctccattgttgagggttggtactgtctaaagttaaaccatttcagtgatgcctagcatggaacacttgacaaccaaccttccagstaggaaatgagacktccttgccagcaagtccatataatactacaatttttatgactagactatttttgcagaagtacttattgcttaattgacattaaacttaagtaagtctatctctttctcttaaaaataatcttaataacaaatagaaatctttagtatcccagtctaactcagtttagtcctatttagtttgggataagaaagtaatgtatcagttattttggcaaattatttatagaagctatgtggaataagctgtatctatttagattttatataatttggtaattagcatacaatagcttacatgaaataaattcttkaaatagtagaaattatgagtaattccactgggcttactcttgtcttagattacatagatataagtattcttgggcattttgatgctagaccaatgatttataatatcaaatacatttatttttaataccaacaaaggtcactggggttcaaagaagtaagattaagcagtcaaggaaacgtgtgggacaatagtaacacaaatactacttttaatgccctcagttgctttactgttagtagaaagtttagtaaataaaacagatgacagatctcatatcagagtaaacctagcaatagggcattaacattgatcttattaaaatacagttgaccctttgaacaccacaggtttgaattgcacaggttcacttatatgtggatttttttcaataaatatattggaaaaatttttggacatttttgataatgaggaaaaaccatgtggcctagaaatataaaaaaaattaagaaaaaatgtcatgaatgtattaaatatgtatrtactagtctattttmccatttactaacatgaaatatacacaaatctattataaaaagttaaaattatcaaaacctacacacacaaacactactcagccttaagacgataaggatgaagacatgaagacctttatgatctgcttccacttaatrwatagtaaatmyaytttatcttctttatgattttattaaccttttttctctagctcactttattataagaatacagtatataatacatataaaatacaaaatatgtgtcaggctatgttattggtaaggcttccagtcaataataggctattagtagttaaattttttggagagtctcaggttaaaggagaatttttgatgtgtgtagggtttggcacctctagcccccatgctttttgtgcatcaactgtaattcattttgcctgcatgataactgcttattttttaagatatattttgaagactcaaaataatatcatgttgatatagaaacattccatttccatttgtaattaaaattgaaaaaattttaattcttccatttaccttgactatcacaaatacatgtaatgattttttaaacccagtctagagctgaaccarttaagacaaaattgacataacagatttgcccacttttccattaaatatttttatccctaatcaggccctcaagttacctgctaatgctaattgtatgacttggggtaatatggatcaattattgtattttttaaaggctagaaattattggataaattgtggaaattttaattatttctagacctcatttgtagaataaagtttaatcagaatgtttgagctaaaggaaatcctagatgtcatggtccagtccctctccttttacagataagaaaacgtgaagctctagaaattaatatctttgccattatcatcagtatatgagaacagacctgcaaaagtgaactcatttatttcaatagcccatccttttttcccccttatgccacaatgcctcttaacttttaatttcctaccagttcactcttcttcccaaagtgctccttctgttaattactatttttcctaccttccctccacaccaactaaagaaaaattcctagtgcctatttcctctcagcctctagggatatttattgcctgaatgaatctcttcagtagcattttcaaaagtgtgacaagatgaaaaggacattctaatgtcagaggaactctttagggctttactaatacgaaaggtattctgtctatgaatctgccctagttacagtctttcttcttctctcttgttttttacttcactcttgaactacatgggttctctaaaaacttaggttatttttggttttaactatatgatctcctagtagggcaagtataaaaggacaaggtatacatatgtttaaagtcttgtccttttatgcctgccttacctactgaatctaaaattggtaattaagtattatagacattgaggtcccagaattttatatctcaagacaaaaaaagaatataggcagcacaatgtcatgagatttgacctatgacaggtttttcttgaatgtttctaggaggtattccactggctttttttcaatatcagacatcaccatattatgcttttttaaacgtatgtagataaaagtgaatgtggaacataaatttgcacagtcttcctggaargtggttaatatataatataaaaacttcaagtactcaccttttgtcctataaattctatttttaaaactttgtccyagataataagacaaataatccaagattgaatctgccttagagagttgctttaaggattattgcatatacactatatctacataacagaatgagaaactattaaaatggtgatacatatatctgtatgcattaacattaaaagaagttcatgcatttattaactggaaaagtagattacaaaactataaataacacaacatttatgtaaaactatgtatgttacaatggtctggaaaattrttccccaaactgctaacagagccatcacgtttattatttttactttttttttttttttttaaagaaacaaagcctcactctgtcacccaggccagagcacagtggtgcagtcatagttcagtgtagcttcagactcctagtcttttgcctcagccttctgagtagctgggactgcaggtgcacaccactttgccttgccagttttttcaaattttttttgtagaggtggggaagtggaggggctcactttgttgcccagactggtctcatgtctcctggcttcaagtggtccttccaccttggcttcccaaaatgctgggatacaggtatgagccaccatgtccagacaatttttactttttaattaatgttaatcaacattatagcaatattgtatataataaatatgaaccacttttatagtcagagaaagcaatgaaattatttttattttaaaaacaaaccaaatgtacatagccttggtatttactagcagtatgacttttaacttgttacacacttcctcatttgtaaaagggtgtaaatgtcagtcatattcccatcccatcttcctccccatttatgaatcctgagcccctgttggctccattaacagctggagtaaatgccttttgacagatgtgagggtcagatttctcatcagcaacttccttagcagaagcagtgttgttaaatagaaaaggtggagggaaaccaagatgttgacagagcctagaagagaagttagcatgatgatctaaaggagtatttgcaaagtccagaattatgtggctattttaagactgtctttagttttattgtcattaacttaatgagtttcaggaaagagggaatgtctcttttgattcattttgattcaacagttttatttttaggtatatacagaggagaattctcttggttaaaaataaaaaaggaaaacttacacagctgaagtgaatggtactctgaagtatctgtggggagactgtagttagtgacttgtgtcataccccttccacccataccagatcctttcctttgagacatgggtgcttttccctggctagtcttagaagcaatcacatttttatataatgaactctgaggggtttaaaaatgagtgagacatggtatcctggagtgcagcatatgwctgctcagcatttacaggtttgtttgtttttttcctctctttacttttccatttagtagacactaggccataaacccgttttaatttattcactgagaaggaaatgacataatattcactgctgtggctgcataggtcatcaattccctgggactcaggattacatctgagctgatatcagactscctcttcccaggatagtaaaatttgaagtctgtgtgtcaggggcctgcagtgtaagtattcgagaaagtttgttcaaagtatttcctttccaaaaagcaggaattagagaagcaagaatacaggagcaggatggtgtattaggaattttagcttaagattcctttacaatttcttctcctaagaaattttagctctctttaacagtgtggttgtcaagtatgctagtgaatcttacaaaaattatgcaactggagaaatgaaattatttgctatttgtactggcttatgtgcaggcaaaataaaagtaggcaatggatggaagaaaacagagacttttgctttattaaggtgaagtgaatttcacctccttttatcgtttgaagtattgagaggtttttgttagagtgttttgtttggaaaagttatacagattttgcctttaagaacaaaattttaaatctctctaagaggtttagtattgagtggcaattattttgtttacttgtctgtcttctctgttgactatgaactccttcgtggtrgagatggtgttgcttatgtttgataagtccaatcccagactcataaatgtttatttggttggataattagcaaattaattaattttgcctgttaatgcagataattttgcttaaaaatagttttacataaacacatatacatacatacatacatacatacatacatacatacatacatacatacagtgggcctaccttctattttctgctgctttcaacttaagcttgggaatatttttgctatagctatttacaaagtttttgcattaaaggattaaatcactctaagttgagtgggaattggaaggagcaataatattggggctatttttaaaatgtctgtatgctggagaataggaaatggttaactatggccagacctataccctagcatatctaaatctattacaaaagtgaattaaccactgtattaaagktttctagagagacagatccaataggagccatttattatctagatctatatatgagtttattagggagcactggctcatgtgataacactgtgaagtcccatgataggctatctacaagctgggggaagacaaaagctgatagggggcccagtccaagtcataaagccttaaaaccagggaatccgacagtgcagttatcagtctgtggctgaaagcctgagagcctccaggaggccgctggtacaattccacagtccaaaggctggataacctggagtatgatgttcaggagtagtaagagaggaggcaagcgtctgacacaggtagaaagagaaagccagaagtctcagcaaactgcttataccccttctcctgcctgttttgttgtagctgctggcrgccattggatggcacctgcattgaagggtattgctttcagtccatcaactcaaatgtcagtctcctctgacaacaccctcacagacacacccagtaacaattctttaccagccatctaggcatccctcggttcagtcacacctaatattaactaaccgtcacaaccgccattccccatattagtacttagtgtgctaagtcagtgcaaaatgtgggacamttaatttacataatttctttttatattttaattcctgtgaataatatgtgtgctcttaagtatttataaacataaacatagaaaaacaaacacttgtgatttttatattcttgagtttaaggaaatatatttaatctatttcaggcagttaaaatataattttacttgtgcatgtgtataaaatatttctcaaagtagtactctgtaacaagaaaaccttgaccctgtttcttcaaatgaatataagctctaataaatagacatttgttcaawctctgaactatttaactgtaatgagttgaaaaaaaatttttttttttttgagacagagtttcgctcttgttgcccaggctggagtgcagtggtgagatcttggctcactgcaacctccgcctttctgtttcaagcgattctcctgcctcagcctcccgagtagctgagactacaggcacatgccaccatgcccagctaattttttgtatttttagtagakacggggtttcaccatgttggccgggatggtctcgatctcttgaccttgtggtccacctgcctcggcctcccaaggtgctgggattacaggcgtgagccactgcacccggcagaaaatcttaaatctatactatagagtctgacaagaatttgggacccaaaagcaatataattctattacatatttatcttaacaagtaacattttaaaagtccatgtaatttatagatttatttgctttctctaacaagtaatgcttytaataaaaatctgggcctggtggggtggctcatgcctgttatcccagcattttgggaggctgaggtggacgcatcacaagatcaggagttccagaccagcctggccgatgtggtgaaaccctgcctctactaaaaatagaaaaaaaaattagctgggtgtggtggtgcacgcctgtaatcccagctgcttgggaggctgagacaaaggaagtgctagaacccgggaggcaggggttgcagtgagctgagatggcagcactgcactccagcctaggcaacagagcaagactccaactcaaaaaaaaaaaaaaaaaaamaaaacctggagttaaaattaaatttagcatataacttaacaacaacttaaaattacctctgttgtcacatattctagttgctagtgatttttagcagtgattcttgtgttattaatgagctaaaaacttcttcagcttataatggttaatcagtttttaaatgaatttaccaattttgtaattaaacaaaatcaatcattttggaggctcaggtagtcataatattgtgtaagattggcacatgtttttatgaggttaatttatgtggtgtcctaacttcataaatttgatacatgaaygacataggacattttaaaaaacctacatagtgtcttacatcaactatgtagtatcctatgtagtgtgtatctctgggaaatttctttagtgattgtctccgtagcactgcagctgcctgtctagttggtagccactggccacatgtggctattgagcacctgaaatgtggcttttccagcacctgaagtggggcttttccaaatggagatgtgagttttttgttgttgttttgtttattttgagacagggtctcactctgtcacccaggctggggtgcggtggcacaatcatagctcactgcagcctagacctcctgggctcaagcaatcctcccacctaagcctcttgagtagctggaactacaggcatgcatcaccatactcgggaaattttttaatttttatttttttgtagagatgtggtctcattgtgttgcccaagctggtctcaaactcgtaggctcaagcaatcttcctccctcagcctcccaaagtgctagaactacaggcgtgagccactgcacctggcctgagatgtcttttrtacaccagattttgaagactattcaaaaacaatgtaaaatatttttaaacaattgttaacattgatttttaaatgatgatattctggaatattggattgaatatattacatttgttttacttttttaaaaacctttaaaatatagtttcttaaaaaatgtaaaaatggccaggcrcagtggctcacacttgtaatcctagcactttgggagaccgaggtgagcagatcacctgaagtcaggagttcgagaccagcctggccaacatggtgaaaccccgtctctactaaaaatacaaaaaaattakacrggcatagtggcacgtgcttgtaatcccagctactcaggaggctraggcaggagaatcatttgaacccgggaggcggaggttgcagtgagccaaaattgcgccactgcattccagcctgrgcaacaagaacaaaaactccatctcaaaaaaaaaaagtaaaattatatttgtagctcatactatatttcttttgaacaacactgatctaaagtgctatgtttttcattgtccgtttaaatggattatgatgtaattagactagagatctcatgggttttagaactaaaatgttctggggtcagatgtggcttctggcttttacttatttgtatttctggcctcagttgtacccgaaaataaatttttgttggaaatacagtttgtcctgagctaatagaggaacatgatttaccttcaattctggagagctagtaaaataatttagaacactatgtcaagaatgattctttctcactcataacactttcttgtgtgtctgttattttaagtatcaaaattctcctttaaaactctgggatagatgtttcacatgtttcttcttgacctaaaaggtgtcattttcaggcaccaaaagttcttaaacactaatattctggtatgtagctgctgatgaaaaatgtacttcttagcaaatcctaagctggatacacataaaatcacacaaggcatagcatgataaaattgtataaaaccaatgataaagaggaaaatttttttagttatgttatggtaagaacatttaacatgaggtctacctttaaaaattttttttcagtgtataatacagtattaccaactgtaggtgtaatgtcatacagtagatgtgtagaacttaactgaagcattgcttcactgaagcattatgsctgttgattagtaactcctcatttccccctctccccagcacctggtaaccatctttctactctttgattctatgaatttatctattttagatacctcagttaagtagaatcatgctatttgtctttgtgtgactggtttatattacttagcataatgccttcaagtttcatccatgttatcccatatggcagaatttccttctttttaaagactgaataatataccatcatatgtatatgccacattttctttaatccattcatctgtagatggacatttaagttgtttccacatcttggctcttgtgaatagtgctgcatgaacgtgagggtgctaatatgtctttgagatcctggttttrattcttcttgacaaatacccagaagtgggattgctggattaatatggtaattctattttaattttttgaggaacgttcttactcttttccatagcaggtgcatcattttgcagtctcatcaacagtgtgcaaggattccagtttttccacatcctcaccaacttttattgccttttatttctttgattatagccatgctgacaggtctgaggtgaaggctcattgtaagtttgatttacattccctcagtgagtactgacattgagtaatttttcatatacctgttgcccatttgtatattttctttggaaaaatgtctgctcaactccttagcccatttttaatttgggttgtattggtccactctcacactgctataaaaaaatacctgagatggggtaatttataaagaaaaaaaggtttaattcattaatggttccacaagctatccaggaaacatggctggggaggcctcaggaaacttccaatcatggcagaaggcaaaggggaagcaggcacatcttcatatggccagagcaagaggaagagagaggcagaaggtgccacatacatttgagcaaccaaatctcacagctaccacaagagcagcaccaaggggaacattctcccccatggtccaatcacctcccaccaggccccacctccaacactagggattatgatttaacatgagatttgggcrgggacccaaaccatatcatgggttattggggtattttttaaattgagttgtaggggttccttatatattttggagactaacccctaatattggatacatggtttgcaaatgttttctccaattcagtaggttgctttttcactctgtcgattgtttcctttgccttgcagaaactttttagtttgatacagccccactagtttatttctatttttgcattctgtgcttttactgtcatattcatgaaattatcaccaggaccaatgtcattaagcttttcccttatgatttctgtaggagttttacagctttaagtcatatgtttaaatctttaatcctttttgagttgatttttgtatatgatgtaagataagggtccaatttcattgttttgtttktgggtatctagttttcccagcaccatttatttatttatttgttttgttgagtcatctctcctttttctttttttcttttctttttttaaattatactttaagttttagggcacatgtgcacaacgtgcaggtttgttacatatgtatacatgtgccatgttggtgtgctgcacccattaactcgtcatttaatttaggtatatctcctaatgctatccctccaccctccccccatcccacaacaggccccggtgtgtgatgttccccttcctgtgtccatgtgttctyattgttcatttcccacctgtgagtgagaacatgcggtgtttggttttttgtccttgcgatagtttgctgagaatgatggtttccagcttcatccatgtccctacaaaggacatgaactcatcattttttatggctacatagtattccatggtgaatatgtgccacattttcttaatccagtctatcattgttggacctttgggttggttccaggtctttgctattgtgaatagtgccgcaataaacatacstgtgcmtgtgtctttatagcagcatgatttataatcatttgggtatatacccagtaatgggatggctgggtcaaatggtatttctagttctagatccctgaggaatcrccacactgacttccacaatggttgaactagtttacagtcccaccaacagtgtaaaagtgctcctatttctccacatcctctccagcacctgttgtttcctgactttataatgatcgccattctaactgttgtgagatggtatctcattgtggttttgatttgcatttctctgatggccagtgatgatgaccattttttcatgtgtcttttggctgcataaatgtcttcttttgagaagtgtctgttcatatccttcacccacttgttgatggagttgtttgtttttttcttgtaaatttgtttgagttcattgtaaattctggatattagccctttgtcagatgagtagattgcaaaaattttctcccattctgtaggttgcctgttcacgctgatggtagtttcttttgctgtgcagaagttctttagtttattagatccyatttgtcaattttggcttttgttgccattgcttttggtgttttagacatgaagttcttgcacatgcctatgtcctgaatggtgttgcctaggttttcctctagggtttttatggttttaggtctaacatttaagtctttaatccatcttgaattaatttttgtataaggtgtaaggaagggatccagtttcagctttctacatatggctagccagttttcccagcaccatttattaactaaggaatcctttccccatttcttgtttttgtcaggtttgtcaaagatcagatagttatagatatgtggcattatttctgagggctctgttctgttccattggtctatatctctgttttgataccagtaccatgctgttttggttactgtagccttgtagtatagtttgaagtcaggtagcatgatgcctccagctttgttcttttggcttaggattgacttggcaatgtaggctcttttttggttccatatgaactttcaagtagttttttccaattctgtgaagaaagtcattggtagtttgatggggatggcattgaatctgtaaattaccttgggcagtgtggccattttcacgatatygattcttcctacccatgagcatggaatgttcttccatttgttcgtatcctcttttatttcattgagcagtggtttgtagttctccttgaagaggtccttyacatcctttgtaagttggattcctaggtattttattctctttgaagaaattgtgaatgggagttcactcatgatttggttctctgtttgtctgttattggtgtataagaacgcttgtgatttttgcacattgattttgtatcctgagagtttgctgaagttgcttatcagcttaaggagactttgggctgagacgaaggggttttctagatatacagtcatgtcatctgcaaacagggacaatttgacttcctcttttcctaattgaataccctttatttccttctccttcctgattgccctggccagaacttccaacactatgttgaataggagtggtgacagagggcatccctgtcttgtgccagttttcaaagggaatgcttccagtttttgcccattcagtatgatattggctgtgggtttgtcatagatagctcttactattttgagatacgtcccatcaatacctaatttattgagagtttttagcatgaagsgttgttgaattttgtcaaaggccttttctgcatctattgagataatcgtggtttttgtctttggttctgtttatatgctggattacatttactgatttgtgtatgttgaaccagccttgcatcccaggaatgaagcccacttgatcatggtggataagctttttgatgggctgctggattcggtttgccagtattttattgaagatttttgcatcgatgttcatcagggatattagtctaaaattctctttttttgttgtgtctctgccagtctttggtatyaggatgatgctggcctcataaaatgagttaggaaggattccctctcttcctgttgattggaatagtttcagaaggaatggtaccagctcctccttgtacctctggtagaatttggctgtgaatccatctggtcctggactttttttcrttggtaagctattaattattgcctcaatttcagagcctgttattggtctattcagagattcaacttcttcctgktttagtcttgggagggtgtatgtgtcgaggaatgtacccatttcttctagattttccagtttatttgcatagaggtgtttataatattctctgatggtagtttgtatttctgtgggatcggtggtgatatcccctttatcattttttattgcatctatttgattcttctctcttttcttctttattagtcttgctagcggtctatcaattttgttgatcttttcagaaaaccagctcctggattcattgattttttgaaaggttttttgtgtgtctatttccttcagttctgctctgatcttagttatttcttgccttctgctagcttttgaatgtgtttgctctttcttctctagttcttttaattgtgatgtcagggtatcaattttagatctttcctgctttctcttgtgggcatttagtgctataaatttccctctacacactgctttgaatgtgtcccagagattctggtacgttgtgtctttgttctcgttggtttcaaagaacatctgtatttctgccttcatttcattatgtacccagtagtcattcaggagcaggttgttcagtttccatgtagttgagcggttttgagtgagtttcttaatcctgagttctagtttgattgcactgtggtctgagagacagtctgttataatttctgttcttttacatttgctgaggagagctttacttccaactatgtggtcaattttggaataggtatggtgtggtgctgaaaagaatgtatattcggttgatttgaggtggagagttctgtagwtgtctattaggtccacttggttaagagctgagttcaattcctgggtatccttgttaactttctgtctcgttgatctgtctaatgttgacagtggggtgttaaagtctcccattattattgtgtgggagtctaagtctctttgtaggtccctaaggacttgctttgtgaatctgggtgctcttgtattgtgtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcwctttgttttgagcctatgtgtgtctctgtacatgagattttgagaykagtttcctgaatacagcacactgatgggtcttgactctttatccagtttgccagtccgtgtattttaattggagcatttagcccatttmcatttaaggttaatattgttatgtgtgaatttgatcctgtcattatgatgttagctggttattttgctcgttagttgatgcagtttcttcctagccttgatggtctttacaatttggcatgtttttgcagtggctggkaccggttgttcctttccatgtttagtcccagcaccatttattaaagaggaaaatcttaaaagcaactggagaaaaaaaaaagataagatacagattaataaggtaataattcttattccctatagaarccatgcaaagcagaacacaaggaaatgacatatttcaagtgctaagtggatgaatctcagtcagattattcggaatactaatagcgttcatttatttagtacatattgtaaaccagaaattatgctgattattttaatatgcattatctcatttaatccttacagcaacccggagaggcarctagaattaacacattttagaggtgaagaaaatgaggctaagagaagccaagggacttggctaataaatgttacacacttagcaaatggaaaattcaggatttcaaaccagatatgattaacataagccatgtctcctctyactattaaccataactggtagaacatatacataacttaaatttgataggtaagctgattggaggctatttgttgtggtacgaatgtttgaaaattgctgtcagtcagcaagtatttatcaagcacattagatattccaggctggaactggaatggaatcatgaacaatacaagtatggttctttatccttatggagcttataaatgtctaaggaaaagaaatgtggtaattctaggtacttctgaggatggttctaaggattaaatgatatattaaaaaraaccagcacaatttctggcatataacatttatgttcaataattttaagtatttaaaaaaatagttataagtagtctaagtgttctgaataagtgccaagtgctgtggaaggacattggagggaaaaagctaacatagtctgggagattaggaaaggcttccctgagttattgatttttaagcagaatctgatgagtgaataatctgttagccagagcaaagagattggacacaaaagatcattatattcaaagggctgcacatttgataagacattgcagaggttgaagagagcatagtatgttcttattctaaagacagtgggaaacaaatgaagctttttaaggatgtgggtggagggttgctggcaataatcatgttagccttaaaaaatcatttcatcattccagcaacctctaagaacagtctttgaggaatgtggcaagagtagacacgaggataaatgtgaggaagtggttcaaacagtgggaacagaacaaagtggacaaagctacttacatggaatatacaaaatttggcaattttggatgtaggaaaggagaaagaagatgcacagttcttaggtttctgggatgatggaaatgccgtttcctgagaatggaaatatcgcaagttttgagagaaaattattagatatctttatttggatatacctgtatgctgtgtcagttagagagatatcaagtaggcagtttgacacactggtgctctgaggagaaatttggacccaatatctagattttgggaatcatttatatgcatactttagagatatcgtatgttcggttccagatcagcaaaataaagtgagtttctcaatctattaaatgtgcaaaagaattatgtctaaaaaaacaattttttttattgtttcagaatactttattgctaaaaaaatgctagcaatcatctgagccttcagcaaatcatagtctttgctggtgggtcttgcctccataaagatgactgctgactgatcagggtggtggttgctgaaggttgaagtggctatggcagtttcttaagattaacagtgaagtttgccacatccattgactcttgttttcaggaaagatttctccatagcatgtgatgctgcttggcaacattttacccacaatataacttttaaaactggagtcaattctctctgccactgctttatcaactaagtttatgtaatatcctgaattatttgttgacatttcagtaaggttcacagcgtcttcaccaggagtagatttcatcgcaagaaaccactttcttggctcatccataagaaacaattcttcattcaagttttttcatgagattcctgcaattcagtcataatttcaggctccacttctaatcctagttctattcctattttcaccccatttgcagttacttccctccactgaagtcttaaacccctcaaagttattcstgagggttggaatcaacttcttccacacccctgttaatgttgatattttgacctcccctgaatcatgaattgaccttctcccctgagtcatgaatgttcttaatgacatctagaatagtgaatcctttccagaaagttttccgtttactttgcccatattcattagaggaatcactatctatgactgctgtagccctacaagatgtatttcttaataagacttggragtctaaattattctttaattcatgagttgcagaatggatgttgtgttaacaaggcttgaaaacaacactaatctacatctccatcagagttgttggctgactaggtacactgaaaatgatcagtaatattttgaaaggaatcattttatctgagtagtaagtttcaacagtgggcttaaaatatccagtaatcatgctataaacaaagtgttgtcttgcaggcttggttgttccatttatagagacaggaagagtagayttagcatattcttaagagccctaggattttcagaagggtaaatgagcactggcttcaacttatatttaccaactgcattagcccccaacaagagagtcagcctatcctttgaagttttgaagccaggcattgatttctctctagctatgaaagtcctagatgacatcttcttccaatataaggctgtttcatctacattgaatatctgttgtttagtgtggccaccttcctcaattaccttagcaacatgttttaaataacttgctgcaatttctgtatcatcacttgctgcctgaccatgcacttttatgttataaagactgcttcttttcttaaacttcatcaaccaacctctgctagcttcaaactttcttctgcagcttcttcacctctctcagccttcacagaattgaagagggttagggccttgctttggattaggctttggcttcaaggaatgttgtggttggtttgatcttttatccagatcactcgaagtttctccatatcatcagtaagactgttttgctctcttagtattcatgtgttcactagagtagcacaattyccttsaagagtttttccttagcattcacaatttgcttactgattggcagaggaggcctagcttttggcctttctcagttttcaatgcacctgcttcacaaagcttcatcacttctagctttttatgtaaagtgagagatgtgggactcttcctttcacttaaatacttaaaggccrttgtagggttattcattggcctaatttcattattattgtgwctcagggcataggaaggcccaaggagaggragaaaagcagggaacaaccagttggtggaacaatcagaatacacacaacatttgtcagttaagtttaccatcttatatgggcatggtttgtggtgacccaaaataattacagtaaaaacatcaaagaacagtgatcacaggtcaccataataaatattataataatgaaaagtttaaaatgttgcaaaattaccaaaatgtgacacaaagacaagaagtgagcacatgctgttggaaaaatggctgcagtagacttgctcaatgcagggttgccacaatttacaatataatacattgtattataaaaaatacaatatctgcagagcccagtaaagcatagtgcaataaaatgaggtgtgcttgtatttatagatgatatctaaagtcaaagaatgggtggaacagtgaagacgaagaaaaagaagaaagttaagtataagctctgaggcacttcaacttttaaatttagccagagggggaggagccagcaagtaacaatgcatgaataggaatatctagagaaataagaggtataatgtggagygtcagaagccaaaagcgaagtgtgttaagaacaaargtgtagttcatcttttccaatcctgctgaaaattagggcaagatacagacagaaaaggcatttcttaaaattttaacaacctggaattcattcrtgattttaacaagaatcattttggtggagtgagagggacagatttgagtcagctgagaaaagtgtgacaaatgaggaaccagagacagagcttaaacaattctttagctatgagtgtggaagaaagagattgggcaatagctaagacaggataatgtgttgaacgagggtttttagtaggcaggagatatctgatggaaaagagcaaatagagaacttgaagatactgcattgggggatgattgcagtgcaatgttatgtcgtggcagaatgaggtgggattgggagagattgctcttagataagaagaattgctggtctgatgtaaagttaggcaaaatattttaaaacatactattaaagctaactgtcaattcttagcatcacaatgaaatcatgaaaaccccgcaggtgcttcgcagttcctacagggaatcttccttgttacaacaacaacaaagcaaaagaagacaccaaaccgaccaacagcaaggagtaatattgaatattcaaaaataaaatctattccttgacttcaaatcattaaagtagarctgcctatttaagaacttttatttgcacagtcctrttaattttaatgcctaaagcagtgttaatcgcatgacccacgtgaaaagattttaaaaattgctttgttagaaaatgtaatagacttgtcgttaaagttttcaaactcttttttaaagatttgtaatatttggctagagttccatttattttctttaaaaaaattatgtacacacacacacgcacacacacacacacacacagtcactcctatcccgcaccctcagagaaagtttgagattatacagccacatctgtcagagctgtgctaacctatgtcatccatctgttctggttatattttccttccctttcctctctttttcttccattctccccagcctttaaaagaaaaaaagttgagagtaaaaacaaatcacctctttttatattgaaatttaaggtggaagaaaagtggttataaaagcatctatcatcatagcactgacttgccaagttaagtatttaggttggaaatcatgcctttccaactgcttaaaaacaggaagtatctctgctaagtgataaatagctccctgttgctggaaaggaaggcctcttttatttctttctacatttttgagcaataataaatgagttctgcattttcatacatgggtgtatgtgtgtgtgtgtgtgtgtgtataatgcagaaatccatttgcagtgtttatgtatacatatatacctcagtatatgtaaatatatgtgaaaatactttccaagactttaagcatagaatctcttctcataagccagcccaggcacatcttactcaacaattcaagcaaaacctttggatctgtcagaaacagcttataggtckgcattaggtgattaattgccaggagaatctggttctatattttgttacatataattattttcttttctaaaggtgttcttttattaagctcccaccataaaagaggggaaaataagcacrcgtcttacatgcctgatgtttagcacttcttacaaaagaaagaggaaaactttaacataatccactgataaaagcatatttgtcttggcttcagacagttttctcctcatttttaccaaaactttaataatattttaacttgcttagaaattagtcttgggatagcagtatggaataatggaatatactttggttatacaatctgacggtataaaattaaaccttagttcacattctatccttaatgcttactaccactctgaccttttacaattacttaacgtcttcaagcttttatttccctttttgtaaattgactataagaatacatatctccttttgagtgttactgtgaggattgcactaattaccatagtaaagcacttattacagttctgaaaatatagtaggaacccaataacattaccattttaaacattattagtttgcttattctaagctctgccacttaatcatgtatgactcaatatcaatattacctccatgggcctcagtcttctcagtaaatacaggagtttagaaatggaagaattttttgtgagactaatgtcctgtgattctctaattatcttcatatcaaatgaagaaaaagtattttcattttagatacaaattattcttatccccataactgacaaagcaaggaatatggcttctacaatgtaatttctgctttacttttgactgagtattcataagacttcttttggtgttgattatggtctctagagcgagactgccaatatttcaattctggctccccaccacttaccagctatgtaactttaggcaaattatttaacctctctctaactcagttttattatctataaagtgagactaataatagtacctcgccttccgggctgttgtgcagattaaaggagttttatgtaaactcattcatgaattttatgtaaaagagtttgaacaatatcaagcatattgtacatttcacatgcacatattattgttgtcatcattgtcattgtctggaataacatcaattgcctctaaccatagcatgggaatactgtaatagatgaataagagtttgactatctgaaatgcagttctagcaccataggctttgataagtatcttactaatgacagatctctaaatatgcatgcacataccaatagagtgagggaagaaaatttagaaacatactcatgactattttatgtaccattctttttaatgtacacttttgtgttgtatacaatataytaatacaagaaggcatgtgtatgctttctgactaaacattaaaaaatgggggaaaagtgctcacatagtttttactaatatgaatgaatgatcaaaaaactttggagacagctgtcctaggagacagtgtcttccaaaggtggtgttaacttgacctcgccatcagtctcagttgtctgccctgtactagatggagatgaacatgtattgaagaagcaaatcaaactttcatgactccagagagtctggaaagaccacaacgagtagtcctttgctaaagatagaataagtgtagtatggaatccaagttattctgactatgtcaactacttggtgtgactgaataatcaaatacctgagagatgtcaaataaatcattccttttcagtactcatatttggacttcaccatggaagaaaatactgctgttctcagtgcccagggactacaaaaccacattcccacagaataaccaaattccttttctgcttatgtttaacagcagtgcaactgggcttttctaatagattttaaactttttgttataaatattgttacctccacggaagtgaggaaattatattttttaactattctgcttagaaaataccacaaataaaggaaaatcaataaatttctttcttaagtggatacattttaaagcagagttaccagtatttgaaaataactcaaaatgaacttctttctctctaagaagttctcataatgggttgatatgacccatgtgttagtacatagatacctaggagtaaatgcccccacctcctttgggtaatgtatttttggggggaatctgatagatacactctcctgaaaatacaaatacaaaatttttacacgtaaaatttagcctacagtttcaaggcttcatagatactgttttccctaaacgcattcaagaacctttaggtaactgagatcttctggatgtgaaagggatgtagctacatatacattccaacccataagccactgtgtcatcattgcagtttatgataagctttctgtaaacccttcattttctaggtttggcttcaaaagtcattggtgcaattcttaattacatagttacgtcttgttttttaacgcttgaaatagtgttaaaatgatggcatctgcattatctctttgctgtgtgatatttgcttattatgttttaattatttaaatttttatgaggccaccatgtaagttataatctgaatcttcccaaagatatattgtcttacattctgccacagaattaaaatgacaaaaatagtgcatctcatagcaaagacatagagttccactttacagatgagaaagctaaggcttaagagcacttagagtgatttgattcatttatgaggtaagggactgtccacgttcacctatgaggcttttttaaactaacttgtacaagccatatctctcaaagtctagtctaggaactttctctgtcagagtcagctggcaagcttattaaacatgcagggtctgacctctccctccagaccaaatgggatgtaaatggggaacaagattcttctagatgagcagataagccagatgattcctgtgcacattgaggtttgagaaaccctgaaaattggtttaactttaactgcacattagaatcgaagaaaataatttgcctggacctagactgattgattgtcactggagcaaggaggtggaggtaacctaggttcttaaagttcaccaagtgattgtgatgcacagtgaaggttaaaaaccactactctaaagtatttagaaagttttcctgtaaaaggccagatggtaaatattttagactttataggctacatctgttattccttgtagctactcaactttgctgacttagaatggaaatagccatagataatatgcaaatggctgaacagggccatgttctaacacttcatttataaaaacagctggtgggacagattgtagtttgccaaaccctacagaggggggtacagtccctgccatgtgcctcaaaggtgctgttagactgtgttctaaacctgagatgtttctagttgtttgaagtaaaggtggaaaactaccatattaaaattcaattacgggctgggcatgatggctataatcccagcactttgggaggagatcatagtgacgccacttgaggccaggagttcaagaccagcctggccaacatggtgaaactgtgtctctactaaaagtacaaaaattagccaggtgtggtggtgcmtgcctgtaatcacaactacttgggaggttgaggcatgagaatcgcttgaacctaggaggtggagkttgcagtgagctgagatcatgccactgcactccagcctgggcgacagagtgaaaccttgtctcaaaaaaaaaaaaaaaaaaaaaaaggagttccattccaagagggccaaataggaacagctctggtctgcagctcccagcatgatcgacacagaagwtgggtgatttctgcgtttccaactggggtgactagttcatctcattgggactggttggacagtgggtgcagcccacggagagtgaactgaaatagggtggggcattgcctcacccaggaactggaaggggttgtgggatttccctctcctagccaagggaagccatgacagacrgtacctggaatatcgctacactcctgcccaaatactgcgcttttcccatggtcttarcaactggcagacaaggagattctctcccgtgcctggcttggcagatccaacacccacggagccttgcttgctgctagtgcagcagtttgagatcgacctgcgaggctgcagcctggcagggggaggggcatccgccattgctgaagcttaagtaggtaaacaaagtggccaggaagctcaaactgggtggagcccactgcagctcaggaaggcctactgcctccatgwactgtacctctgtagacagggcatagctgaacaaaaggcagcagtaacttctgcagacttaaacgtccctgtgtgacagctctgaagacagcagtggttctcccagcacggcatttgagctctgagaacggacagactgcctcctcaagtgggtccctgacccccatgtagcctaactgggagacatctcccagtaggggctgacagacacctcatacaggcgggtttccctctgcgatgaagyttccagaggaaggatcaggcagtaatatttgctgctcggcagcctccgctggtgatacccaggcaaacagggtctggagtggacctccagcaaactccaacagacctgttgcttagggacctgactgttagaagaaaaactaacaaaccaaaaggaatagcatcaacatcaacagaaaggacttccacacaaaaaccccatctgtaggtcaccaacatcaaagaccaaaggtagataaaaccacaaagatggggagaaaccagaacagaaaagctgaaaattctaaaaaccagagckcctcttctcctccaaaggatcacagctccttgccagcaacagaacaaagctggatggagaatgactttgacgagctgacagaagtgggattcagaaggtcaataataacaaacttctccaagctaaagaagcgtgttctaacccattgcgaggaagctaaaaaccttgaaaaaaggtgagacaaatggctaactagaataaacagtgtagagaagaccttaaatgacctgatggagctgaaaaccatggtatgagaacttcgtgacacatgcacaaacttcagtagccaattcaatcaagtggaagaaaggatatcagtgattgaagatcaaatgaaagaaatgaagcgagaagagaagtttagagaaaaaagagtaaaaagaacaaagcctccaagaaatatgggactatgtgaaaagaccaaatctacatttgattggtgtacctgaaagtcacggggagaatggaaccaagttagaaaacactcttcaggatattatccaggagaacttccccaacatagcaaggcaggccaacattcaaattcaggaaatacagagaacaccacaaagatactcctcaagaagagcaacmccaagacacataattctcagattcaccaaggttgaaatgaaggaaaaaatgttaagggtagcctgagagaaaggtcagattacccactaacrgaagcccatcagactaacagcggctctctcgggcagaaatcatacaagccagaagagagtgggggtcaagattcaacattcttaaaagaattttcaacccagaatttgatatccagccaaactaagcttcataagtgaargataaataaaatccattacagacaagcaaatgctgagagattttgtcaccaccaggcctgccttacaagagctcctgaaggaagcactaaacaaggaaaggaacaaccagtaccagccactgcaaaaacatgccaaattgtaaagaccatcgatgctttgaagaaactgcatcaattaacaggcaaaatacccatctaacatcataatgacaggattaaattcacacataacaatactaaccttaartgtaaatgggctaaatgckccaattaaaagacacagactggcaaattggatagagtcaagacccatcagtgtgctgtattcaggagacccatctcatgtacagagacacatacaggctcaaaataaaggaatggaggaagatctcacaagcaaaaggaaagcaagaaaaatcataggttgcaatcctagtctctgataaagcaggctttaaaccaacaaagatcaaaagaracaaagaaggtcattacataatggtaaagggatcaattcaacaagaagagctaactatcctaaatatatatgcacccaatacaggagcacccagattcataaagcaatctgggagactttaacacaccactgtcaatattagatcaacgtgacagaagtttaacaaggatatccaggacttgaactcagctctgcaccaagcagacttaatagatatctacagaactctccaccccaaatcaacagaatatacattcttctcagcaccacgtcgcaattactctaaaatcgaccacataattggaagtaaagcactcctcagcaaatgtaaaaacaggaatcacaacaaactstctctctgaccacagtgcaatgaaattagaactcaggattaagaaactcactcaaaaccgcacaactacatggaaactgaacagaacagcctgcccctgaatgactactgagtaaataacaaaataaggcagaaataaggatgttgtttgaaaccagtgagaacaaagacacaacgtaccagaatctctgggacacatttaaagcagtgtgtagagggaaatttatagcactaaatgcccacaagagaaagcaggaaagatctaaaattgamaccctgacatcacaattaaaagaactagagaagaaagaggaaacatacaaaagctagcagaaggcaagaaataactaagatcagagcagaactgaaggagatagasacacacaaaaaacccttcaaaaaatcaatgaatccaggagctggttttttgaaaagatcaacaaaattgatagactgctagcaagactaataaagaagaaaagggagaagaatgaaatagacgcaataaaaaatgataaaggggatatcaccaccgatcccacagaaatacaaactaccatcagagaatactataaacacctttactcaaataaactagaaaatctagaagaaatggataaattcctggacatatacaccctcccaagactaaaccaggaagaagttgaatctctgaatagaccaataacaggttctgaaattgaggcaataattaatagcctaccaaccaaaaaagtccaggaccagacagattcacagccaaattctaccataggtacaaagaggagctgttaccattccttctgaaactattccaatcaatagaacaagaaggaatcctccctaactcattttatgaggccagcatcatcctaataccaaagcctggcagagacamaacaaaaaaagagaattttagaccaatatccctgatgaacatcgatgcgagaatcctcaataaaatactggcaaacygaatccagcagcacatccaaaagcttatccactaygatcaagtcagcttcatccctgggatgcaaggctgtttcaacataygcaaatcaataaatgtaatccatcacataaasagaaccaatgacaaaaaccacatgattatctcaatagatgcagaaaaggccttcgaraaaattcaacagccgttyatgctaaaaactctcaataaactaggtattgatggaaatatctcaaaataataagagctatttatgacaaacccacagccratatcatactgaatgggcaaaaackggaagcgttccctttgaaaaccggcagaagacaaggatgccctctctcaccactcctactcaacatagtgttagaagttctagcctgggcagtcaggcaagagaaagaaacaaaggttattcaatttagaaaagcggaagtcaaattgtccctgtctgcagatgacatgattgtatatttaaaaaccccatcgtctcagcccaaaatctccttatgctgataagcaacttcagcaaagtctcaggatacaaaatcaatgtgcaaaaatcacaagcattcctatacaccaataacagacaaacagccaaattgtgagtgaactcccattcacaattgctacaaagaaaataagatacctaggaatccaacttacaagggatgggaaggacctcttcaaggagaactacaagccactgctcaacaaaataaaagaggacacaaacaaatggaagatgggaagaatcaatattgtgaaaatatccatactgcccaaggtaatgtacagattcaatgctatctccatcaagctaccaatgattttcttcacagaattggaaaaaactactttaaaattcatatgaaaccaaaaaggagcccgcatagccaagacagtactaagcaaaaacaacaaagctggaggcatcacactacctgacttcaaagtatactacaaggctatagtaaccaaaacagtatggtactggtaccaaaacagatatgtagagaacagaggcctcagaaataacaccatgcatctacaaccatctgatctttgacaaacctgacaaaaacaagaagtggggaaaggattccctatttaatacatggtgctgggaaaactggctagccatatgcagaaagctgaaamtggatcccttccttacaccttatacaaaaattaattcaagatgtattaaagacttaaatgtaagacctaaaaccataaaaaccctagaagaaaacgtaggcagtaccattcaggacataggcctagtcaaggacttcatgactgaaacaccgaaagaaatggcaacaaaagccaaaattgacaaatgggatctaattaatctaaagagcttctgcacagcgaaagaaactaccatcagagtgaataggcaacctacagaaggggagaaaatttttgcaatctacccatctgacaaagggctaatatccagaatctacaatgaactcaaacaaatttacaagaaaaaaaacaaccccatcaaaaagtgggcaaaaggtatgaatagacatccctcaaaagaagacatttatgcagccaacagacacatgaaaaaatgctcatcatcactggccatcagagaaatgcaaatcaaaaccacaatgagataccatctcacrccagttagaatggtgatcattaaaaagttgggaaacaacagatgctggagaggatgtggagaagtaggaacgcctttacactgttggtgggagtgtaaattagttcaatcattgtggaagacagtgtggtgattcctcaaggatctagaactagaaataccatttgacccagccatcccattactgggtatatacccaaaggattataaatcatgctgctataaagacacatgcacacgtatgtttattgcagcactattcacratagtaaagacttggaaccaacccaaatttccatcagtgatagactagattaagaaaatgtggcacagatacaccatggaatactatgcagccataaaaaaggatgagttcatgtcctttgttgggacatggatgaagctgggaaccatcattctcagcaaactatcagaaggacagaaarccaaacaccacatgttctcastcataggtgggaattgaacaatgagaacacttggacgcagggcagggaacatcacwcactggggcctgtcaggtggtggggggctgggggagggatagcattaggagacatacctaatgtaaatgatgagttaatgggggaagcaaaccaacatggctcatgtatacctatgtaataaacctgcacgttgtgcacatgtaccctgtaattaaaaaaaaaattcagttacaaccaggtgtggtggttcacacctgtaatctgagcaggaggatcacttgagtcctggagtttagaccagcctgggcaccgtagggagacccgtctgtccaaaaaaataaaatttaaatgttagccagatgtggtagcacacacctgtggtcccacctattcgggaggctgaggtgggaggaccgcttggaccctggaggtcaagtctgtagtgagccatgatcgygctactgcagtccagcatgggcaacagagcaagaccccatctcaaataaataaataaaactcagtaagtaatagagccagaattttgaactatgaataggtaagattaaaaaaaaagacattattttgtaatgtcttgtattatcagacaaggtaycagagacaaggaaaaagaaaggtgcactgaacagccaaagcaggactgacggaactcagaaatgggctgggaccagcctgggagaaagaaaacgcaaggcaaagaaaaggataaaacagccctgctgcactctggtgggactgataagaaatagcttctgtatcttggtattttgtaccttaaaaaaaattgaggagtggcaggaatagaaaacagaaacaatgtctctttggggtgagagacagaaacacgctgttcctctcagaggatgtggaaacattgatgacctctgcaagtgcaggcaggcagtatccacagctctgcatcaccactcggcgtcaccactgtgcaacccatcagtcctgtggtgcccgttcaagtyacattgtataaatctgtcctacggcatctgtatcctcaccatctaataactttagcacagaatattgtttaagaatgatggagagggaaaagaagactttgagtcaacaaaacctttgtttgtttacatttaccatatcatccattctttgtagtatatatcagaagactttcattttaggtttttaaaaatcgtttatatgtaatgagttaaaaaccttagttatccagaaacatattctgagcaacatgtttttggtaccacctgctgtcttatatatttcttgtctgcatgcttctgtatacctagtaggtgtctgtaggcagatcaccttacattgtgatttcttttaaattgggaaaaaatatatgtcctttgaatatcttatggttcagcaggggcattagaaaatataaacaactgttgtgtgatatgtgcaaaagaaatgtgaacaatgtttaggagtaatatagagaagaaaatgacagtttctttgtatagaaatgatttgaaagaataactaggattttcctggagtacatggcctgggagtagacaggactgttcagataaagagatcactatttataaattagagaggtgtgaagaatatgctcatagcaattttaggggaagtacaaggagttcagtattggtagaaagtaaagggcctggaggggtcaaataacaggagacgatgctgggaaaagaagcagaggacaggccatttgtccccactgccactactcccttacccccattaagaacccatgggtttatatatttttaaatatcttaaaatatgtaaatatctaagkaagttcttcactcctattctatcttatggagaccctttttaaagagtgaattttatagagacataggaaatgttagtttgcattgttttcactttgcccctatagttttttaaaaagcagattcactttttacaagaggaagaatttggattastgctggatacatactgttttgacttgtaaaatgactctttaatagaaatggacaaagaaaatatgctaataaaayamcttaagtatgtgtatgtgtgtgcatgctaaatttttttttcttctgttctcttcattttgtgctcatcatcaattgctgctatttactgtggtgcatttttcctgaacacctgctgtcaaatgcatcaagtcttttcttgcacagtgctacaggtttttgcagaactgagcaagcccaacattagacagatagcctaaagactgattgatttatttgttttaatacaaatataygctmacatgttgacatacagaaatctgtttcaaatgaattattttttaaagaacaaagaactttataaccctagtacctaatcctatgcctgacacatagtagatactcagcaaayatctgtgggactgaactgctctgtgaagcctagctaagcactaaagactcccacaactttttcagctttatggggaagtgattatcttaaatagttttaatgcaaattgaattattgtttaaaaagcatgtccaccagttgaaaagtcaagtcatggaacattgttaagatccaggttttaatttagcagatattgttctctttgcagaataattacgaatctatttaaaataaatgcttttttatctttatctccctttgcacaatggagtggcattgtcaaaaggggaaagtgtctaataataagttgaaaacattgtgcagttatacttcaaagacatctcttaaattgtcctgttcaggwtcactgcctctgctattattcatgttctaatttagggcctcgaaattgtattagttgcctaactggaagttgcacttcgttcctgtgcttcttccacactgctgccagaatcatttactttcttcaacagaaaatcaagcctgtctctttcctcattaaaaacctgcaatttgctacggactgtgagataaggaccaaactccttggcattacataccatatgtaatgtaattatacctgtggattttttttctcaatctaccttcatgtccccatgtttctaagcatcctcwaccagtgcttcccaaaatttttcatgacatgtcacacatggaataataaccagatgataccactgtctgactgcctgaagtctctggcttctctgagctttctggcccttctgagatctgaaggaaacaatatcttaagcataccctctaatccattcccagtacaaccactgggaaagtctgccctacatgtgaccacagtaaaccttttcrcctcccaggaatggtttgtgcactgcttttcttctttgcttataatattcattctgccttttcacagtttctcaatctggtaaatttcccctccttgtcatttaaagcccggctcatttggatttgggaaatgtttctggaatttttttaagaatatgtgaagctctttgtttccaattaaagccttatcttaaatcaattaattttgactcttagaaattctctttccattttctgacccatttgtaataacttaattttaaggttacacctactgtaccaataatgattttgtttttaaaaatacaaataaaaatctcccttccttggctttttggaaacagtttctttcccccgtaarttatattgcccatggtttcataaatacacatctcaaatgggttacttatgtaaagggtgtgtgtgcttacttgcgtgcgtgtgtgtgtgtgtgtgtgtgtatcactactactaatactaacataaatatatatatcattactacccacttagctataytctaaagttaaaagatctcaaaatacttcttgtgaaaaggtttactaagcccaaagttctaagagaaaaattatgaaaattggtttcctttgtttaacagagcctattgcttattttaagggtaattgatcttttgttttgagacagggtctcaccctgtcacttaggctggagtgcagtggtggatgcctccctaggcstcaacctcctgggctcaagtgatcctcccacctcagctgggactacaggtgtgtgtaccaccacacccggctaatttttatgtttgtttgtttgtttgtttgtttgttttgtagagatggggttgcgccatgttgcctaggctggtctcaaatgcctgagctcaagcgatctgcctgccttagcctcccaaagtgctgggattacagttgtgtgtgtgccactgtgcctagcctgattgattttgatctctaacacattcctctcataactatttctgcttttccaaaaaagttttatgtatgggttaggtaaatgtttctggttttatctcattaaatgattggcttttagtatcagcatgaatcaagtataatttgactyacctcatccttaaattcttacttaatttggtaattattgtgtattttatcattttctactagtgtcttagcctgttgatcaaagcttgctgcagttagttgtttgcgtgttgatctttctctactttttagtgttcttaaaggtaaggaccaagtcatatgcttctgtattttcctcacagtgctttgcamavaaaaaaaamattgtctagtaggtgtctttttagttacttttaaagtatcttgtgggtagttaagacttttttattcaaattttatataaaatctgtttttgttttctgatgcctgttcagcagatgcttacccagactgaagtagtttacattctttttcaatgtcccaaaagcttaattagcaaataatataatgcagactgctccttgcataggctctcatggattttacatactactgcttattttattagtctctaaagtcattcttctcccagtgtaattacacttttaaaaattactaaattgcataagagatattatgaaatcgtattcctggaacattgagaatttcaagctttaaaagacagcagctaaagtcaaagatacagcaacattttcaaaagttagctttgtacatctcttggctgagtaatgtgaacccacacatggaaagatttaatakatacaggaatgttctgggcctctgtaagagctgatccctctatcaggtttctgtgcagacaagcatgtttcttctatctattaggaaaggkttatgaattgagcatttcagaggctatggtaagaagcagggagagaagggggcaagtagagaattgctraatatcaattctttttaaatattgagatttagaaataaaaatcaagaatctgtattttgacttgacttttcaatctattattctaacctcgtagctcattgttccatttattcaaagaacattaacatctgccatatattaggaattcagagattgctaacattgcctatgttcaaggatctcataatcaagtactgaggataattatacaagaagagtaatcactataatagcatttaatacttactgaagcatacatgccatatgccaaacactgagctaagcacattatatcaatatagatataaaaacacctgctgatttgtccaaacacacagctaataagtttttgagctagaattttcctccagctaagctgattcttttgccctcacttttaaccttgtatgccaaattacaagtttaaaattcatttatgtacttggaagagtcatagaagtttcaataaaagagaagacttttaagctgagacttgaacaagaagtggagcttccctgatagacaaagagataaaatgtcattctgagcagakkgagaaatatgtgcgaaaacagggaggcagaaagcagcgtggtgagttttactaactgggtgtttaggtgctcctaagcaagtccaagttcaagtatagcatttcaagtttctatgattttagtgtaactcctatcttatctacagctccttttcttttctcacagggtgagaaatgctatacttgaacttggacttttttctttgatgtgcaattaaatgattagaaaataggaagttaaggtatttgcagttaaartgatcacrttagccatgatgtagataaagcaaggaaaaagaaggaaagaataagactgcaggcagaaaaacaactagcacagcagttatgatattctagacaaatgattgtgttggcttgatatcactgagtaaacatttattgggtgccttatatgtgccatagctgagcttacagtgttgaataaaatgaatatgattcctgccattacatacagtctacaatctgttgggaaagacagacagtaaacaaacacacaaatacacaataaagaagaatgggtagaagtgacaggtttaagagagatttaagtagtgttagccagrtctatgcattagttggatttagaggaagaaatagatacctagaataaatccaaggtttctttgagataattcagagccgttaccaaagatccacctttctccctggtttctggaactattctctccatgaatcatgattcattgatatgtttttattaaagtataaaggctcagtgctgctttcctttcctagaggaaggcactccctatatacacatacacacccttgttgattattttaaatgaatgggagccaatgggacctgatttttcaaggtgtctattttaatacttttgtctgaacaagtatttctatgttaatgaaattagatttgagcatttgatagaacatgaaactataagtgttgaatttcagaatttataaaaaagaaaaggcagccttataattgtggtataaggtttgatagttaagactccttcatgtgaaataccagatgttttgagtccttgatataaaggtcagaagaaaagaaggatattggtttcataataaaytaacatgtttacagtaatgactatgcagtgtaagctgtggatattttgttatataagaatggcagggggtcctagaactgggggctggaaggcccatttaaaaggtcatcyaatacgataatttttagtctggagcacacaagcagagttcaggtgaactccctggaattatttgcaaaattgggagtatttttygtatgtatagtttgaggggaatttctgtcaaatgcacataggcacctgtaattaaagagccgccttcattttcacacatgaggaaactgaggctgttacagatgtagagacttgcccaagktcttgaataasttctcagaaagggagtttgttctatgatttgtgttttttaataaagttttaatggacagaccacgatatccaacatggccttggagccatagggttcagaatattagaaagccttggcttcttttttcattgagttgtcatatagtgattttaataataatagaacatgctattattcagaatacattcttccaccctaatatcccaaaacagtatttttaaagaaattctaggaagggtgtttactcattcagagttctacaggaaggaaggctctttcctactattttttaagcataactttcactgacaagaccaggccagaaaaagcctagctggctgttggcccagacaatgttataataatcattgaagtatactcaacctgcactgcctgaggatagctacagctaaaaaaaataaataaataagcacacacagatgtatgctgagtgttccagtgacttagctgacatgtatgctgtatatcctttgctgtgttcyttcaactattagaaaggaaattttaaaatagcctagaatttattattccaatagggtgaaaaggacaacttcaactttaaaaaaataaccaagctctccaaggctgtatccccagcaagtaaatcaatctggcatatagtagatgcttaataatttttttgatgagagaattgttgaagtttgttagttatatttcagaaagagaattttgtttgttcatcaataatgagtatcatgtagtgtcaaaatagtaaaattaaaaaggactgcttcaacatttagaaaccccagatttcagcgcagtttctgtaagttattgtacgaccttgggcctcattttctttgtcttaataaggatataataatatctaattcccaaaatttgggggaatattaaatgagctacagtatgtgaaagatgcttcatagatccttaagtgctatataaatattaatgttatttgtcttagataacattttcaattttttaaatatgtatttactgaaatcatctttatttcctaagtcctgtatttgttttaggtagaaagaagtgatttccatgattgaaatggagttttgaattctttgataaaatacattttaaggtrtacagaattgtctgcaaagaattaaaacactcatttttaagcaagggaaatatatttattttatgattttcctaattgaatttttgccagctaatttgtacgtaagttaaggattgattgatatatatttgatagacaatcaccctcttctaggtattataacatatrcaaaaagtatacaacagcattttccaaagtggaaaagaaatattagtttttgagatgttccatgattagagtttgggaatttaaaatagaatttttacatactaccataggtttctcctagatatttttattacccattaatataatttccaaaaattccttcatatagaaacctatacaaaccttttattttgtttctacacagtgttatccaaatttatttaacaagaaaacccttttttccattacatttgttaacattcactcgagtattttataaagcactggtatgagatatgatgatatgaccccatggatttgaacagtctgtttggaactstaagtatgaacatggtgaagtacattaaaacaaaacaaaacaaacaaaaataaaacaaattaactatgagattgtgaaatggttgtaatatatgtcaccaaattcatggctaaatcatagaaattgatctgtcacagcttgttaaataagtattctttctcttacatgacttcttacrtgattttttccaaactgcttagtcaaagaagataatctttccagatagagaaaattttaaaatatctttattcctctttaaatttactgatttataaatactgggagtctaacaaatgcaagttactactctttattaatcccttttatttagtttcagtttacacacaataattgtatcaacttatatgtacaagtcaattaatttagacttgtgtaaacctgtgaaaccacctctgcaattaaggtgcagaacatccccatcaccctcaaaagattgcttttgcccttttgcagtccatttttccctcttcctcaggttgcagtcaaccactagtctgctttttgctactatagattagattggactttgtaaatattttatataaatgcagtatgtactctcttatgtctgttctatttgactcagcatgatgagactcatgcacattgttgagtgttcagtatttcctttctattgttgagtagtattccattatatattttgactattcactcataagttggtagacatttgggttgtttacaattttactattgtgaataaagctactgtgggctgggcacagtgactcacacctgtaatctcagcactttgggaggccaaggtgggtggatcacttggacatgggtgtttgagaccagcctgggcagcatggcaagaccccatctttactgaaaatacaaaagaaatagctggggctgggcacggtggctcaagcctgtaatcccagcactttgggaggccgtggcaggcagatcacctgaggtctggagttcaagaccagcctggccagtatggcaaaaccccatctctactaaaaatacaaaaaattagccaggcgtggtggtgggcgcctgtaatcccagctacttgggaggctgaggcaggagaatygctcgaacccaggaggcagaggttgcagtgagcaaagactgcaccactgcacttccagcctgggcaacaagagcgaaactccacctcaaaaaaaaaaaaaaaatagctgggcatggtggtgcatacctgtggtcccagctacctgggaggctgagaagagagtatcacttgagtgcrggaggtggagattgcagtgagccaagatcacatcactgcactctagcctgggtgacagagtgagactctgtctcaraaaaataaaatttgtgaacttccatatacaagtctttgtgtagatatgggttttttcttcttaggtaactacctagattatttcacaataattgggttgttatgatgtggtgggtttaacttcttaagaagctgacaaatagctttccaaagtggttgttctattttatattcccattaacagtgtatgtaatttctagttgctccatgtccttgatcggtctttggtattgttagtgtctttaattttcatcattcttataatgtaatggtatctcattgtggcttaaatttgcattgatctgataactaatgatgttaagtatcttttcacatacttacctcacaaaggaagctgtgtggttagcaagtatgttcaaatttttagtccagtkactttggrttattttcttattattgaattatgaggattctttatatattttggatacaagccctttgcaaatatgcatattgtgaatattttatcccagtctgtgacctgtcttttcgttttcttaaaggtaccttttgaagagaaattttgttttgatttttgtaaagaccagtttgtccatgtttttcttttatacttctagaagttttrtagttttagctcatamatttcaagtttatttttcagtatggtgtgaggtaagggtcaatgttcatttttttcatatggatttctagtattcacagtaccatttcttaagataatttcctttttgagtgccttaaaatcagtatggacttcctttttctattttatttatccgtatctttatcctctagatactctcacactatcttgtttctttagcattataagttttgaagtcaagtagtgtaaatttttccaatttgttctttttagaagttgctaaaagttgccacattgcctctgtagatacacacagagagagatttagacacatacctctttttaaccactttgagataattcacataccataaaattcactatttgaaatatttaattcattgatttttagtatattcacacatatgtataaccatcaccatagtcaattgtacacatcttattcatgctttctcctattaccaagagcaatgtctggkatgtaatacatgctcaccaaatttttctgaataagtgaatccattagttgtwaaataatgtaggcattagcctctagtaaaatattaagaaggctcatttgactgcattcagctctagaactattcttttattagaactctgctattttgagggatctctgaaacagctaacagcttaactcagatatagatacagatatatatatatggctacagatttttttttttaaatggagtcttattctgtcacccagactggagtgcagtagtgctatcttggtttactgcaacctccgcctcctgggctcaagtgatcctctcaccttagcctcctgagtggctgggactacaggcatgcaccaccgtgcccagctaatttttgtatttttttgtagagatgtcgttttgtcatgttgcccaggctggtctcgaactcctggactcaagcagtctgccctccttgcccttccaaagtgctgggattggccgggcaccgtggctcacgcctgtaatcccagcactctgggagaccaaggcaggcagatcgaacgcctgaggtcaggagttcgagacaagcctggccaacatggtgaaaccccgtctctactaaaaattagccaggtgtggtggcatgtgcctgtagtcccagccactagggaggctgaggcaggagaatcttgcagtgagctgagactgcgccactgcactccagcctgggtggcagagtgagactctgtctcaaaaagaaaaaaaaaaaaacaccaagtgctgggattataggcgtgagccaccatacctgtccttaaaccatattttagtagttatttaaggaagttacaaaaaaaattccttttgatataatgagtgcaaattatttgcrcatttttgaaaagagaatagtcatcttttattcacctgataattgctgagaagggcaaacctcccataagtactgcttttctwtttttttttttttttttttttttgagacagagacctcctgctccacccacctcagcatcccaaagtgctgggattacaggcgtgagccaccgcgcccagccttctattttcaaaagtactcttgacattgtttgtatcggtgacatagattatggaatctctggtacttgttttatttaccaattacgaataatagtggattgttcgtgaaattccagacatctttccctaggtatctttgagatggaatgtcagttctgagcccagttaattcatgttgcctcattttctttataggctttgatgcggcctggaagaattgatagaatcatctatgtgcctttaccggatgcagcaacaagaagggaaatatttaagctgcagtttcactccatgcctgtcagtaatgaagttgacctggatgaactcatccttcaaacckacgcatactcaggagcagaggtaagatagttcccttcaaaataccttagtgggaggaaagcggtggctcagggtcattaagcaaaataaattgcttgccctgaggtgttttaaatgaccatactaagaaatcttgaaacaggaagtgcagtacatgacatagtcactaagttaaattgcactttacgtggcttctattatatcacaattgttttttacttgctcctattatttctcaaaatgtagtcttcagaggaatagcataatatagtgagaagaacactagactagaagtagattcttccactgggcttcttaatacagcagtttctaaccaatcacacacttctctaactttgcgttctttacccatcaaatggaaatgatactactaccttccctcctgtttcctcatggagagcatagaaataaaattaggatatcatgagtataaagggcaaagcaaacagattgtatcattatcatctttttgtcattttggcaagttatctcagtctaattttgtattaaacattctctcacagtaaaagggaccatctgcccttacctctgaagataaactcttgacaagaacagcaagacctctgtgaaaatatgaaaatgacttttatgtatggcagattaacattttttctctccttaccaactctttacttatgctatttttatttaccaaataaaattccatgaaataattctgcaacttttctagctgcatttcttaaggaaaggaccaactatgtacctcgacacagaaatagcatctgtcacaccaatgatgtagacttttaatgggagattaatatttttttaagtacaaggttacagattatttttattctgaattactcagtaggctaggactccacattctgttttgcttgctattgttttcattcgtcttatgtaaacaccgaagagattaccatatgacagatcattagtggtactccgagagtctatttggaactgaacttagtgtatcatgcagtcatagctaataacaacaaccaaaataaatcccagatctattcattgttttgccccaagaaccatagatatagatatagacagtccccaacttatgacagtttgacttaagattttggggctttacaatggtgcaaaagtggtacacactcagtacactcctcaacttacaatacagctacatctggataaatccatcttaagttgaaaataacaagttgaaaatatcgtaagtcaaaaacatatatgcatttttgacttagacatattcaactgatgatgggtttaccaggacatagccccatcataagttgaggagtatttgtatttgattttcctcctttatatttttcaagtccactggaataaaaagccatgtggaaagtagcttgagaagcagttgaagtgcgctcacctttaactcctctgaaacagtgatctttatgaccatccataaagttaaaatgaacatacagttatggttaactgactgctccaacatttctagaattcagtttttgatttgagacgagggctggcatcttgtatgatgatatggcaatttgcaggaaacagcaagaggaagacgaagaaaccataaatctctcacttgagccgagtaaactagaagagcagttagcaagatataaatatgcctttctcactttgaagtaattcatggtagtaacatcgaagtgcaaaacaaaaataaaacccagtgagattctatctggctaaaaggaaaaaaacctcatttggtgccagcaattattgtactggcttgctaattcttatgtagtgcacttcttatttaatctaacatgtaagcacatttatgattaatttttatatgagatcttctgaaaatcgtcacaggaaaagtagcagaaaattctatctttcctcaaattatattkttgtgttccataatgcttggattggggagggcatcccattgtggtcctatttataattagtatattattacaacttcatagaaattttgctaacagctacatcttagtagttctgtggtttctaatttagatgaggcaggtttgttccctgttgagggtttttgttttgttttgttttggtctgaataggtaggcagttcacacagttgttttaggaaaattattatttctttaaaagtcttaaagttaataaacaggagatttaggagackttaaktaatgcttaagataaaaggtttcatttctctctcyctgtttctctgtcttcacacagaaccttctacatggtgtgtgtttaacaagcacttgataaactgtggggaaaaaagatttttaaattagatttaggaaaaatagacttcagttctcatttgttacaagaggagccctctaactccctgctgtagacacagccattttctcagagttggagtgtctctttggccactttgggtataaaaatgaaactactatcaatttattgtcctcacaagagaatagtatattatattcaagattatataaaattaattttatttaagtgtatactattagctatatgaacaagaatttgggcaggaaagccagagacgaggaatttcctggcactctaattgttttttagaaacaaaatgttgaagtgtagtgagcattttttatttttagtgaaaaagttgtagaggatgattaagatggaaatgatactggtactttttttttttttttttttttttttgagacagagtttcgcccttgtatcccaggctggagtgcagtggcacgatcttggctcactgcaacctccgcctcccgggttcaagcaattctcctgcctcagcctcccaagtcgctgggattacaggcacccaccaccacgcccagctaatttytgtatttttattagagacagggtttcaccacattggccaggctggtcttgaactcctgacctcaggtgatccgcccaccttggcctcccaaagtgctgggattacaggcatgagcctctgtgcccaccactggtacttttaatggcagggatgagaagaggttactttaaaaaattattttcttttcacttggttatttattttgcccaatcagcattgttctatgaaagcttagaccagctcagtgtttgaaatagctccttctggtcaaagttactccatttttccttcgtggagagggtatacagagaattgaaacacttttgtaagcctcaggaggctctcaagaggaagtctgtcaccagctggaaggggaatacagccgttagggagcagcctctgaggggagactgaagcaggttgcgtcttttagccatctctgccacctgccactcattgtccctgtggctatggccctcattgtcctggcttcttgactgtagctgtcagttaatgaaaaaacatgtgccatttaaaagcagaagggaatttctctcaggaggaagtaagtctttttggttatcactattgttttcttttgctctgatttttgttttttaagttatttgtagcaattccacctcatttattcatttatcttttatcaaattatcctggttacttttggaagagttttatctgtaacagaaaatcaactgtcacaaatatatttacaaaaaaaagcaataactgggctcattaccccatatgccctatgcttgggaacacaggtgatgagtaagatgcataatttcttctgtgtatcagaatttgctgacataggccaaagactgatatctgtaaaattggggttgaatttttatttgaatttggatattatcctcctttcagtgaatcccttgggatcaccaatttgtgagggagtcaggcccttcttggccagtttgtaaatctcctcccttacatcttcagaggccagcttcagccaagtggggacactgcagtgacagggaggagccgattgggacaggcccttcctgggagcaggcatgcaactcatgatgtggcagtcaggagcaaaaaaaacacctycttttctttaaaatgtaaaaatttgcttactatagtggtttttttattgcaatcttatgaatgtagctctagaagatctttttaaagcaattcattagagttaaatacatttcacactgagttttcaaaaagctttaacttcatgtaaacttagtctgtttgttttatttttaaatgatctgtcatgccctgaattctgttttgtagtctatgccttcctgggtctaataatagcacaagatcttcatgccagcttgacatttaaaaaatcaccttctagtttgcctcattaattcaagaagggtcctattcactatgcttgagctattatagctaataaaaggagagccttaaattacttttctgtctcactgattaacgttttttctgacatctctttttctcccacacagtgaaaacagaaggagcaattatagccacttaaaatgtctgtactcttcttatgtgaaatctcttgtgatagtattccccaaactaaaatatcagtcattgtattagaatctggcatagattgttcatctgaccagtcaaacaacacatgtgagataggaataaggattctaaggaaggaccatttgacctggtcttaagcgctctacttattattgttagaaagcagctagcagcagtgtacttgtctccaaagtgaagcagagcagcacagtacttagcactctcctacagaccaggggtccccaacctcctggccacggaccagcaccagtactgcatagcatgagtgagtggcagacaagtgagcattactgcctgagttctgcctcctgttagatcagcagtggcattagactctcataggagcacgaaccctattgtgaactatgcgtgcgagggatctaggttgtgtgctccctatgagaatctaacgcctgagaacagtttcattccgaaaccatccccccaccccatttgtggaaaaattgtcttccacaaaaccagtccctggtcccaaaaatgttggggactgctgctatggactgtctgcaacctacttttcctgcctaatcagaaactgccctatgaaaacatgctgctatcaccaagtagtctactatatttgagatcttctttgctatctctctattcttccttgtgtctttacactaaaattctgtatctgtgccccagaatttcaaaatactcagtgctctgtatctgcaagttccatctgcaaattcaaccaactgggaatagaaaatatcagaaaaaagcaacaaaaaataacaatacaacaacaaaaagtacaaatttgaaaatatagcatgacaactatatagcatttacattatgtcagttgtcataagtaatctagagatgatgtatacaagaggatgtgcacaggttatatgcaaatactatgccattttatataagggacttcagcatccttggattttggtatctaaggggctcctggaaccaattgcccttggataccaagggacaactatattctttccttacacgacctactgaaataactactttgtcattaaaccataatgaccaccccaccaataaatagcctattcttttgtactcttttacacttatttttgttttccttgtttagctgttaccatattttgtagttattttatttttttagagacagggtctcattctattgcccaggctggagtgcagtgtcatgatcataccttactgcaactttgaactcctgggctcaagtggtcctcctgcccaagcctcctgagtagctcagaatagaggtgcatgccactgtgcccagctaatttttttaaaaaaatttgtagacattgtcatgttgcccagcctggtcttaaactcctggcctcaagcaatcctcctatctcagcctcctaaagtgttgggattacaggcctgagccactgtgtctggcctctgtagwtattttaatatgagcagctgcctcatctccccaaacacagattctctagggcagagatcagttcttgtacttcttaaagtctggcaaaacagctgtctcacacacactcggtgggcattaatattagatgggtggtacatttatgtattgattctaagtcattttaccaaccaaaaatgtcagttttaacatttgctgaagtggcactttctagttttaatcatattttcatatacattatctatttgagtaccctaactctatgagagcagtgctgtagcgaaagaactaaagtcaagcaaaagaaattggcttgtctgagatcccacagcaaataagtgacaaacctgggaccagaaaccaggtctctcagttccacttgaaggactccacgatctcctaatgcctctgtgtcaacacaacgttctttgaaactttcatagttccctttgacgtctctgaatatttgataaaagtttgtcaattcctgtgaatagtgacttagcaaactaaacagcagttatgaaacatctgtaccatttttatacctttttctcttacagtaattgtctttacctaccttgttttcatcttctccaaaaaagtataagctacctaaagttaggaaccttgtttttatcaattaatttcttttatttcctaggtattgtgaataatgtttgcaatttagaatgaaaagtataaacaacgaagttttatataatgtatttatgtggcatgatctactgatgtgcagaatgctataggagaaaggaggaggagtaactcacactacctgggattaaatgagatagatgatacccagaagaatttttttctgagttttgatgggcagatggaaaggcagagatgaatgaaagaacatggtgtggtctaaaatcagttaaagtttgaatatgattggcagaaagagtcttcatgtagaagtagtaggggatgaagcagaaaaagtaggtcagacttaaatatgaaggaacttgaatatcatccraacttgcttttctcctttcagcaatggaaaaccattgaaaaatgtgatcactgttgtggtcagatttgtattattgaaagatttgtggcatttgtgtccaaagccaccactagctagccttccaagcaccattacacgaattagaaaaaggtgttccttcaccccacttggtgacagctttttgttacagcaaaaagcttgtcagagcatgagcaacatttcagcccctatttgccccccttggctgggcacccttttgtagatacaagctttacatctgtacaaggtgtcttatttttgtcttctccacctttatctccctcacaatgcctagcatagcaccttatatagagttattgtcaytaaataaacaaatggagaytttacatctcaaatatataaactactttctgtaactttaacatttacctcatgagcccttggataaaaataaattgggactattaaagatgtcttttgtagaagatacagaaatggccaacaaacatgaaaaaatagcatcactaatgatcaggaaaatgcaaatcaaaaccacagtgcaataccactttattcctataagaatagccataatcaaaaaatcaaaaaataatagatgttggcgtggatgtgctaaaaaggggacatcgttacactgctggtgggaatgtaaactagtacaatcactatggaaaacagtgtagagattccttaaagaactaaaagtagaactaccatttgatccagcaatcccactgmtagtatctacccagaggaaataagtcattatatgaaaaagatacttacacatgcatgtttatagcagcacaattcacaattacaaaaatatggaaccagcccaaatgcccatcaatcaacaagtggatacagaaattgtggcatatatatacaccatggaatactacttagccataaaaaggaacgaaataatggcattcgcagcaacctggatggaattggcaaccattattctaagtgaagtaactcagaaacagaaacccaaacatcttatgttcttactcataagtgggagcaaagctatgagtatgcaaaggcataagaatgatacagtggactctggggacttgggggaaagggtgtgaggggagtgagggataaaagactacacattgggtacagtgtacactgcttgggtgatgagtgcaccaaaatctcagaaatcaccactaaagaacttatctatgtaaccaaacaccatgtgttccccaaaaacctattgaaataaaaaatgaaaataataataaaaggtcttttgtgcaaactttaacctgccatgaggtacagcacttgttgtaaattgctagaatattaaaagtaaggtggattatatcctctgagccatattatgtaactttgaatataaactctaaggacaaaagcacaayctctgcacctgtttagtggctaaaatatggctctctgttgtaaatgaattatgaagggatctttcagagcaaaaatcagcatgtgctaaaagtagatatttaggactgtaacttttgagctagtcctgtaccactccccttttcccttcttcagcattttatgatctacatgctaagtgaagaaatttggtaaaagccaagacccatcatggccacctagaacaatatgagtttagccaaatcatttatcatttgtagaactcactttcatcttgtaataaggggataggaagatggtctttttataatcctttcaagtgttaaaaatctgtgtggttatatacctgtcataaattaaattaattgtataaggaatcccttagggattggacctccagggatatgtagtatggttatgcttctcttacagtctgtccagaaagctgggatcttgggatcttagtcaatgcctctaaatattttcttctgtggccaaaagatattaattatggcaccagaagaatggggaccttaaatgactctgacagtgcacagaacttggattttaataaaattctccttagcaaactttaacagttttccactaagtagaaaagaaaattttacatgctcagagagttgaaggcctagtgatttttttaccctgagatctttggttgttatgcttttcaacttccttaagaacagctaatcaagttcactatctatgattttggggatacttggataaaaagcgttatagaatggaaatatacagcagccgactttttccttaaactctttgttgggaaaataaatgaaggttgcaaaattataatattgttcattttaacttaacaatttttaaaacttcaatgtatggagatacaatgtacttacagtgtatggagattctctgtatttccaaacttcaccttctgcttaaattggcaacaaaagtacattcagcttacctgaaggctattttagataggatgtttacaccaaagctaatcatactccagaacaccttgtgctgccatacctgtattgctaactctatgccaggtatttaaaagtgctgtgagtttacaagaagtattagtcagaaaggaaatggatatgaatgagaggctggttagcaacaaacttaatagaactttttacacccaaacatggaagcctttttatagggaagaagtatatccagtgaacaagttagtcaggacctaccagataatctagtccccaaggctgatatccagagtaaatctgtatctgtggagaattactcaagccaatgataatgccgatttgagcattttaacattccaccttatttctcttcttccaaattctcagtctctctatttcctcattctttttctccaatattttatataaaccatttaatctgtgcttcctcatcttcagaagagtgataaaatggaggtgggggttaggttctgttaacctgagaggagcttatgatgttaaaaaagagatgtgcaaagcatgctgttaactctgtagcatagattctgatagtgacagttatttttgtttggttatttgaagtgatggaaggctgatttctaataacaacctaatctgtatatgaaaagatacacatgtaaaagctgtttctccttttaggaactctttttactatatgaaattgaattatggttaagtaccctgggttatggaatgagaaagctgtgaacccaaatgccaagtcttccatttcctagctatgtgacctttttattcatatgtaaataaggataagagaggtccttaacttcacagttgtccagattagatgacataatttatataaggtgcttatcctagtaagcatataacaagtgctcagtaaataaattttgttataatcagcaaatttaatttgatatctagtttaaaaaatctacaatttgcctaattttttcacattgtgttgccatagattttatgaatactcataataaatgtttcatgtatatgtcttgtttttagttttaatggtgtgttctttaaactatatttcatagtttacatgcagcatttatttcatctgatttatatttataaacatctgtaatcctatttttattttttccttgttaaagatgtatactattttttacttttcaaatgtgtaaagctaatgttttacactttcaaatgtgtaaagctaatgtttttttataaactccctgtgtaatatccctatttcggcatattctttagttaattgctactttctcacctatagcttattcctaactttttttacatgtcttgttaattaaaaagaaaaaaatagtaacccaactttagaaagttgagggtttctgtgtccactagaataattgtttaggaaataagcatacctcattattttgctctttctttgaagttaggattggaccccagtgtttaggtaataaggctgagaagtctaatgctgaggacagtagcaccacatatctgttattcagtgtatgaaagacacaattgacatgttctcgttcttcatccccaaatgaccataattctgagaagagttctgaaagaagtcattctattagaatgttattaaactttataaaatggttgttcagagctgcaatgcagtggttaccttgttcttaaggaaaccctccactagtttttggaaactgaagaacagaatttaaccatgccttagactgactagaaagaaaagtagaaagaatttagattcatagggttttctctttttattttatttgtgtttcaaatttccaaagattatttctgatgttctttaataatagctcactccctatttactattaaattctggaaaatgggttttgcttttatatttatagcaaagtttccctgtttaggagcaaaagaactttaggtatagtaaacatgctactttaccattgtggaagttccacatcataaattagatattttcccttttccttcaaaatgaagtcacactacttttggcacttggacaggacaatctttcagtgacagcaaaattagccttttggcatatttttattcactttgaaagaatccttaaggagcggttttatgattgaaagcaagaattgtatttactttgcctagggtaaatttcttgcctgaatatgtaaaagaacgtaagtcaaacactgttagataaaaacaaattagtatcaaaagatttcattataataacttgtctatattttatgacataaaatagtatataactaagttctgtattattttgaacttttatttctgctactaagtagtgatacatcttgaggaactccaaggggcctaaacataagtttacacaggtatttgaagaatcarttgactcactatctgaactgagtatgtctgtaaagctatgtttaaatatatccctatatttaaactgatcatggcttataagctaatcacccatgaagagtgtatgttgtctttcttaatgccagtatgttagacaatcaatatataatttatgtttatattaatagacacacacagtttccaattggtatttcgatgcctctttcctaaatatgaattgaaaactaaggaccactaatatttgaaaaaagctaaaaatagacagtctaaaacaagcacagggaggatagacataattagggagcagatgaaaagagagacaagaataatatggccacaaaacaagcaccagaagctctaaaatagaaggctcaattgttccttaattgaaaatgtaaaacattcaggtagaaataaaaaataaatggaagaattggatgatcaagttgmaagtctcccagaaagtcaaacaaaaagacaaagagatgagaattgtagacatggtaacatctgactaatagaggtctcagaaggaacaaagaaatcagaagagagaaaactatcaagacttctttccaagatttgaacattaaatttctagattgaaagcctctaccaagtgtctggcctcaaaccatcacattcaaaggactaaaaatttggagtgccacaaatttatcaacagcagaagctgtacgacaggagagctattcttgaaatttctgaggggaaattatttccaacctagagttctatatctagccaaaccatgaaatcatatgtgaagatggaataaattcattttagacatgcaagacctaaaacatgtttatcttcatgcatgtctttttaggaagttactagtaaatgtgttccaccaaaaaaacaaggaaaaaacatgggatccaggaagcaggtcgttcagcacatgagaatagtgaagagaattcccagagcaataaagagaaatcctggaaaagatatttttaagcttttctataaatctggcaaggaaattcattcttatcaagttgtcactatttgactctatttttcaattgagaataaataataagaaagactagtaggtgaaaattgaatcagccacactgggaattataaaagcaaagtattgtctgaagaaaccatcatatattcttttcacctctttattccaatccagaactgtttctccatgaaagctttattttagaattcagtgttactgttttctataatttttaaaacttcaaatgtgtagttcctgaaatactttaatagcagaatctttcccctccatcaaataaagccgtatgtgggaagcctattatattggatctactttggtggggtscctgtcctgcatgcctcttcctcctgcccgggcatgctgcatcctgtgaggcaccttggagattccacagagcagtttaaaaactgttactgtagcaaaaacactgctgaacacatggcttcattcttatttctcagaaacataacatgagtacccattagtttcatgaactcacagaaacaaaacattcttgtgacatggcttgcatagtgggttgtatacctgtgtatctgtgaaatgaacactaaaagtccatcttgacaagtttgcacctatctgaatatattagtttccttttaaatgaaaagtcattgccttggtttcaaataaaaattggaacctctagtttttacattcctgacattttaaagtttgaaattagtaactcatgtttcttttcccttgtaagtatgagctgagacaaacatgaagcaccaaaatagcactgtactttgggtgggggaacctgcatttcaactgctccttgtaatacatccttcgtcccccttaatgcatcttttctttttccgatgtcacctttgtaaaagaagctgttcaaagatgtatagtttgttttgttttgttgagatggagtctcgctctgtcgccaagctggagtgcagtggcaccatctcggctcackgcaacctctgcctcccgggttcaagcgattcttctgcctcagcctccggagtggctgggactacatatgcccgccaccacgcccggctaattatttgtattttagtagagatgtggtttcaccatgttggccagggtggtctcgatctgctgatctcgtgatctgcccgcctcggcctcccaaagttctgagattacaggcgtgagccaccacacccagccagatttatagttttaaataactttccagatataatcttttctggtaaataaaactaagagatagggctaaaggacaaaaacagactaacaatactacaggaatttgactttttatgtagttggtcattatgggatgtctgtcacatcagaattgaatcttcctgtgcaccatgaaaatgtaaaagataaaatagtagagcatgacaataactatttagtctgaaaaatgatttatcattggtggatatttaaaaaatgccaactctgtgrcctttactacatgtataccttctgtggggaagggtactccctaactgaacattttgtgaattgattaatgtttaatattgatttgcaaggcttagaaatgtaatgaagaaatagctataaaccttgtgtgctttgtgcatcaaggaatttaggtgcatgttgctttcccatttacttaytctttttaggttcttcagcgaaataatgcaaaaaacatagctcatggaattaaagaggaatacttaagcaggaaaaaaaataaagattttaaaaagaaagaggaatataacatcttaaaaacctcaccttttatatccttacttataattttaagaattgaaaccttgagcaagtgcctatcttggcaggcaaattatttgacataaagtttgatcaaagtacaattagaagaaaactcagaatcatagctggaaatgttattatcttcttaggttcaacctaaaaagccagtgtacatacaggttagcatttcaaactcaaaggatttgttttcatcttaaagacgatgaaaggccagctacgtttagaaatcaacagcaatccatcatttttatccctcagtcattctctaagggtattttttgtgacacctatgaagaagcaaagccatgaaggtatatcatatatgccaaattttcactactgatgatgccattgtagacaactgcagaacaatgctggagactgaatatagcaagaacaatgctagagagtgaatatagcactccagaaaagcctctcacttaggtgccaagttcaaggccaaagaattacttagatattctcagggaaaacttggttatgtacaatatcatgaacatataaacttcccccttcatgctcatttgccgtttaccaaagataaattgtgatttcccaactttgtaagaaaataatagttggaatggcttgaggatgttcttctatgcttttttgccatcttctggttcttttcacttgtgaaaacagtatcaatctgttggggttttttcgttttgttttaattagatgaggatcattttattatcaagaattgaaggcttctgtgaatttctgccagcagggtgatagctgccagcagtgcacagctttggtgtgaggtagtagggattccatgtggatattgtccctagactaagggaaagccccattgctgtggcttgttcggtgattctgcctgccagccccattttatgtagcttatcatgcatggttcatggcttgtaggatgtttattcctctgggttaagttttcctcttgttcttctttggtttctagctgacttacttgtgagagcagaaaattacctgggtgcttgagacccattgttcaygtgatggaactgtgatgcacatacatttgaatacatttaagttttttatttgccgtttgtaacttacactggaaagctaccctggtcctacagttaaaattttcccctgagtattattcctaatatgttttttttttcatgccccaaaatgatgtttataattcacattttctcactggcacatgagtaagatttacttacgctggttttgaaaggtttagaataatcagtatttcacttgctaagacttgaaacattaacaataatacactgtaatacacagtgaaattctttgaggaaaagacaccaatgatctttcctattaacttataaatgcttccactgatcagcaaaggtagttcaaaatttcatcactcagtcctgatgctcagataataccagagtagtcagggtgacactgttgtgcttctgactggtagaaaatgttttgctttccatttttcaaagacagttgttgacagataatccattctctttgtgtatgtatgtatgtaatgaaaatagccaccgtgagctcagtaaacccctccttactaaatgtacacaaaagtccattttcagrtgtttgttatttgtgaaacttggttatgtacaatatcatgaacatataaasttcccccttcatgctcatttgctgtttaccaatatgattccccttgagactccagcattaggtgctatatggctgtacaaattggtttgggattgctttgcttacagtcatctcacctcagaaccccacttagcagtttctatgattctcagggaaagtgcttcagcagaagtagacctttaggaattagagacaagttacaaccaaaggagggacattcacctgcagaagcttataaaagcacatgagatacaggcatcgtagcctactcagattgacatctacttgcagattctggtcatcagtgacttcawtgagcactgagagcagtttcattgaaggagcagtaagggcaaaaactagatcgtagagaactgaagtcaaaataatagttgagatttattgtggatatctcctttcaagaattttgaatgaaaaagagaggagagagattagattggtaactagagagatagtggtgggggcagggtatattcatagaatggaagagacttgaacatgtttataggttgaagagggagagtcagcagagagaatakagtgaaaatatccaagagaaaaatgagaaaggggataactaatgaaggaagatcacagaggactgtggtcatggacacaaagaaaggttttgccttcagctgaaggagactttattctcttatattattcagaaagaagtaagaatgattgtaaatatagacaatttcttaggtagagggctagaaaggtgaaaagggtggttaaactcagtcatcgctgatcctcaacttaaaagtctgttccactaatctttattttgtattactgaatgcatatataatgagctacgttaacattgggttttactgtacattatgcgtagtataatatatagaaagtctgatccctctttttaaataatatatagaaatccaaactttatcartgtaaacatactgagtttgaggtgtctatagatcakcttaatggagatgtcatacagattagttttcatttttaaatttctccctatttcattgaaaatatgattcactatataaaattgtaattaatatagatatattacataaagacaaaggagaagctctatacatatggatgatcacatactaatggaagattttttaaattgtaaattaatattgtttcctagacaagtcagtaggattgagtatacaagttgaacatccctaatctgaaaatccaaaatccaaaatgctccaaaatccaaaactttttgagcacgggcatgatgcctcaagtggaaaattccacacctgacttcatgtgatgggctgcagtaaaacattgtttcatgcacacgattatttattgtataaaatttctttcaggctatctgtataagatgtagatgaaacacaaatgaagttcatgtttagacttggatcccatccccaagataacttattatgtatatgcagatattccacaatccaaaattcaaatacttctggtttcaagcattttggaatagggttacttaacctgtactgaggtgacaggtaatctcttagtcttctggctttatatgattactggttagctaaggacctgtctatgttagaggccttgtccatgccacattttttcccaagttaagcttctactgtagctttttcttattttctgacctgcttgataatctattcttatattcattctcacagtgaattagtctatatagtgtattagttataactcagtgtattcttaaagggtttcctcaattattttaatatttgacctgcaataatctgagaacsattttcattttctatacataatggctttgtagttcagtgttaaagctttggaatcttcagagtgaattgattgataaaagaaaactaatagtgcctggcccccagtttgcacttaataatgtttgatgaatgaaagaccgaatgcatacaatttcatttttgtgaaagtttaccatcctaaaaactctgattttttttttttaaagaaatagtacatgttctttttggactgtctgaaaacattgactcttaaccataataacaaataatttttatgagtcccaagctakagataaagagacctagttacttcattttaccttgggtatgagttttgatatttgatgataacagatttggatcgttgctggtttgggcaaggttcggattaattatataaaagagcacataattaaaaaaaaaaaaacctatcatatcctgttacccaattctctggtacaagagctttaggcactgatttaatcttgaaatgataattggacttcccactagattagcccatatgttttgagaggctgtctgggaatgagaggatgtcattcctatatgaaggaacatgaggcaagaatccagaatgaagaaccattagtctgtcttaccagagttctgacaacactgtgatctgaaaatgttttggccaaagtcagatttattgagggccataattttcaataaaaagaatcccagaggaagttatttgatggttggaataaaaatatgacttatacactacatgattcagctgctttggtgttgttttttgagttgtacccatatattcaccttcacatccaagtgtgctggaaaaagtttgtgttctgattgaattatgttcaccttaatttcctctgcagtgcttttccctcaggcagacccttgagtgattgtcttttttacctcctccaatttccaccattctcattttatgtgttcaagttaamtgtgaacaacagcaaacagctacactctgtaaaacataccatttctttccttgagtcaatgcattcacttttctggtaaatgattttgggggcctgcagaaaccaaatgatgagacccctgtaggtggtgaagaggagtttgcaagcaatgtttgcataaagttctcctggcctcttctgctcgtgtttggtttgttcttttaaacactgtcttaactacaaaaaatttttttatgactttggtctctttggagcaaggaaaatgacctggagggacagtcctatggcagtccagcttatattcttatgtaattgacttaactgacatatgccttggttttcctttttttaatttaacttttattttaggttcaaggagtacatgtgcaggtttgttacataggtaaactgcatgtcatgggggtttcatgtacagatcatttcatcatgcaggtaataatcacggtatctgataggtattttwtctgatcctctccttcctccaaccccctagcctcaagtaggccccagtgtctgttgttcccctctttgtgtccatgtgttcttgttgtttaccttcttataagtgagaacatgtggtatttggttttctgctgctgcattagtttgcttaggataatggcctccagcttcatccatgctgctgcaaaagacatgatcttgttttttatggctgcrtagtattccatggtatatatgtaccataatttctttacccaatctactattaatgagcatctagattgactccatgtctttgctattatgaatagtgctacagtgaacatacatgtgtctttatagtagaatgatttatattcctttgagtatctacccagtaatgggactgctggcttaaatgataattctgttttgaattctttgaggaatttccatactgctttctacaatggctaagctcatttaaactcccaccagtagtgtataatcattcccttttccctgacacctcaccagaatctgttatttttttgctttttaataatagccactctgactggtgtgaaatggtatctcgttgtggttttgacttgcatttctctagtgattagtgatgttgagcatttttccatatgcttgttgccacatgtatgtcttcttttgaaagtgtctgttcatattctttgcccactttttaatggtgttgaggtttttttgcttgtaaatgtaagttccttatagattctggatattatatcttttgtgggatgcatagctgcaaatattttctcccattctgtagataatctgtttactctgtcgatagtttcctttgatatgcaaaagctctttagtttaattaagtcccatttgtcaatttttgttttcattgcagttgcctttggcatcttcatcatgagatctttgccaggccccatgtccagaatggtatctcctatgttatcttccagggattttataggtttaggttttacatttacatctttaatccatcttgagttgatttttgtatatgatgtaacgaaggggtctagtttcaatcttctgtacatgactagccaattatcccagcaccacttactgaatggggagtccttgctctattgcttgtttttgttgactttgtcaaaactcagatagttgtaggcatatggtcttatttctgggttctctattctgttcattggtctatgtttctgtttttgtaccagtatcgtgttgttttggttactgtggccttgtagtgtagtttgaatttgagtaacatgatgcctccaactttgttcagtttgcttaggattatgttggctatttgggctcttttttggttttgcatgaattttaaaatagttttttctaattctgtgaagaatgtcattcgtaatttgataggaatagcactgaatctgtaaattactttgggcagtatggccattttaacaatattgatttcttcctatctgtgagcatggaatgttttctatttttgtgtcatctttgatttctttcagcagtgtcataattctccttgtagacatctttcacctccttggttagccatattcttaggcatattttattatttttgtggctattgtgagtgggattgcattccagatttggctgtcagcttggatgtttttggtgtatatcaatgctactgatttttgtacattgattttgtatcctgaaacttttactgaagttatcagatccaggagcttttgggctgagactatgggggttttctagatatagaatcatgttgtctgcaaacagggatagtttgactttgtctcttcctatttggatatcttatttcttcctcctgcctgatttctctggctaggacttccagtactatgctgagtgggagtagtgagagagggcattctggtcttgtgctgtttttcaaggagaatgcttccatcttttgcccattcagtatgatgttggttgtgggtttgtcatagatggctcttattattttgaagtttgttccttccatgcctggtttattgagggttttttaaatgaagcattgttgaattttatcaaaaacgttttctgaatctattgacataatcatgtttttgtttttagctctgtttataggattaatcacatttattgatttgtatatgctgaaccaaacttgcattccagggataaagcctacttgatcatggtggatttgctttttcttgtgctactggattcggtttgctagtattttgttgaggatttttgtatcgatgtctatcaagtatrttggccttaagttttctttttttgttgtgtttctgccaggtttgggtatcacaatgatgctggcctcatagaacgagttggagagggatccctcctccctaattttttggaatagtttcrgtaggaatggtaccagctcttctttatacatctggtagaattctgtctggtcctgggcttttcttggttggtaggcttttttattactgcttcagttttrgaacttgttattggtctgttcagggattcaatttcttaggttcagtcttgggaggttgtatttgtccaggaatttatcagtttattctagatcttctagtttgtatgcatagaggtcttcatagtactctctgagagctttttttatgtctgtgggatcrgtggtaatgtcccctttgtcatttctaattgtgtttatttggatcttctttctttttattagtctagctagcagtctatctgtcttaattttttcaaagaagctactcctggattcattgaccttttgtatggtttttcatatctcagtttccttcagttcagctctcattttggtgatttcttgtcttctgcaacctttgggatttgtttgctcttgatactctatttcttctggttgtgataggaggttgttaatttgagatcttgctaactctttgatgtgagcttttaatgctatgaacttccctctcaacactgccttagcggtgtcccagagattcaggtatgttgtatctttgttctcattagtttcaaagaatttcttgatgtctgccctaatttcatcatttacccaaaagtcacttgggagcaggttgtttaatttccatctaattgtatggttttagcaattttcttgatattggtttctattttattgtcttttgccttaattttcatttatgaaaatataaaaaatataaatataatgcatgtgataaatgcatgaagtacaatactgatgctttttctttggtatgtacattccagaaattagttatgtttacacattagggtgagtcatgtgctgagcctttaaggggaaattttaaaccttaatctgtatatttctaacgtaaatggcaccatatatctctaggacacagtaatagaccccagaatttaggaccatgtcaaagaaatctgaaatgttttaatttttctcctactgtgagtttgcttcatctctacttgaaaaatgaagagtttcttttaggccaggcgcggtggytcatgcctgtaatcccagcactttgggaggccaaggcgggtggatcaccttaggtcaggaattcgagaccagcctggccaacatggtgaaaccccatctctactaaaaatacaaaaatgagccgggcgtggtggcaggcacctgtaatcccagctgaggctggggcaaggaaatcacttgaactcaggaggcagaggttgcagtgagccaggatcatgccacggcactccagcctgggtgacagagcaagactccatctcaaaaaacaaaaaaaaaaagcttttatagaactaatgtatataaaatatacatacaagttggaagtatagcaaagagataaataactcagtttctgaaattaggaaaaggtaaatttgaatcccatctctgccatttactaactctatgactctggaaagttttctaataggtatagtagttataataatagtactttcttcctagggtcattgtgaagattaaattatatcacctatagaaagcacttgtacatatcatgaaccaaagattataactaatccaatttttcagttcactgaagaaaaatggaagtgactgtccaatgtagatgtcagcacatactgaagggttcaagaaatgagagttgtaattatcactgctgttatcagtagatcatcaataagtagaactgatcagttagctcaaattgagcaatcaatacatgagttactagaaagcaatattttttaaaggtttattacaatataaaagtgatacaactaagggattgggaataaatgcgtatacatttacctaagaacaagtgtttaactccaatttcttttaattaagttagttcgcatttatgatagagccatacatattgcagaggacaataccatgtgcaatsctaagtaatattttcttatgaggtttagtgtcaggttcttcaggtagaagaagcacaagcagctgcatttagtagacctgggttccaatcctagctctaccatttatcaactgtattacattgagtaatttagtgaacctatctgagactctgtaaaatggcaatagtaatacttcattactatgaagtaatactttcataggcattatgaagattggaaataatatatagggtacttagtaaataatagctattggtgttattctaccactactttttttaaattaataaactgtgtactaccrccattttaattaataaagttcggttcctttacaaataaacattagttttctatccctgctgtaacaaattgccatacacatagtagcttaaaacaacaaatttattatcttatagttctggaagccagaaatctgacaaaggtcttattgaactaagattaagatgtcagcagggctgtaatcctttatggagcctcttgggaacaatccatttctttgcctttttcagctttctgaggccccctgcattccttggttcatggccttttcctccatcttcaaagctagcagcctagcatcttcaagtatccttctgtttctgacctatgcctccctgttccacatttaaaggacgcttctgattacgtttgacctatccagataatccaggataatctccctattttagggtcaggtgattagcaattttaattccatgtgtaaccctaattctcccttgacatgtaacataacatattcacggttccagggattagaaggtggatatcttgggggtggggcattattctgtctaccacaataatcaaaaaaagcatttgttgcatagtattgtatttgccttaataatcatgagaaactggcaaataaagatcagctggtaccataaattttcagatattaccatttttttgttttcatttttgttcttttttttaatgttattttagtatcttggttaaaagtactatcattttggaaattcacatttttggccactatagctgtattgtgttttttatttaaattgatatagttgaaactctaaagatacaactgcaagaatatatgtgggcaaatttttgaactattttgtggataaagggaaaaagggtaggaatcrgatgtttttcatcagtttttaggagtaattacaaagctaacaggaaaatatgtctcccttctaagataaaaggaacctgaatatttgtccctaatattagaaagcaaatggctcgcaaaaattctcaaagatagtgtgaatcatattcttttataacactggataaaggggraaaaaagtgacatttggggtattaaacctgagatgaacatcctaatccagagagtagctgatctttagacctacaggctgccagtgaggkgttgtcagatgttggagtttaggcatagacaaatgcactgggaagagaacagtgccactggctagtcacttcacttctgggcctcagttttctcatacctattttgtggattatgtgggttgctaattaagacacccatctacctttgatgttctttaaagtagaagaaagaaatttaaacaaatgaatgacactaaaaacagaacagaaaccaccaagatgtccttcaacaggtgaatggatgaataaactttgggaagtccagacaatggaagattatccagtgctaaaaagaaaatgagctataaggccrtgacagtgcatggaagaaccttaaatatatatgactaaatggaagtagccaatccaaaaaggctacatactctgtaattccaaatatatgatattctggaaaaaacaaaactatggagactaaaaaagatcagtggttgtcagggattaggggaagggagggakgaataggcagagcacagaggatttttagggcagtgtaactactgtattcactacagtgctgggtacatctcactatatacttgacaatgtaacaatgtaggttcatcacttataacaaatgtaccactctgatgtgagttattgagtatagtgggcaggctgtgtgtatgtgagggcaaggagtatctgggaactctgtactttatgcccagttttactgtgaacctcaaactaccctaaaaattaagtctattttaaaaattaaacagggtgggaggaaatggaaggggagaaaataaaaaggctactcactgagcctttcctcatctccactgcctgtttcacacacttggccttttcactgtctgtagtttttcctctcctccaaccttagtcactttcacgtggatagttaggacagctttttcactctagtggatacagtatgctctaagttcactaaaacaagcatgtttgtctttcttactgggttagggagaatctgctgtatgatccaaataatatactcaatacattaactgggatccagtataacatgagtgattggtccataaaaatccaactctggaagtatcaattcgtgttttacaactatttttggatactgtatttctttctaaaccttccttagatcattgttacccttaagaatacaccctgtctggatcagcaaggtcacacagccaccgctgtgagacagggctctatgactggcttatcaaagagttggcatagctgaggggcagttccccaaagaaatagttcacttgttcaaagaactaagaagtcttgttatttaaaattaaaaaaaaaaaagtacaagggaaagaagcaggggggagaaaagaagaaggaagggaaaagaaaggaaagatgaggggaagaaaataccatgtttcttgtatcaagcctatcaagacacctaccaggatgttttataagattttctttgacacagaaggggaaagtcagtgtttcttctgtatcrgaacacttaatatatgaaaatgattttgcttcacaaaaactgtgaatataagtgtcttgcacttttatgttttgtccctggaagtctaggtcagatgctccataaaggttttggatgtgatctctaaagcatatgttccaccaagaagtctttctatattcaccatctctctggtttccatggaggtgatgatggaaacttatgtataatttcagactagcattgtgctgcgaatgatgtttataaaatattaaattctgataaagggaataatatttttaagtcattcttaattcctgaataatgctgcatgttaatggttagatatcatttgacttcaaagtctttcacaacataaactttgatttcatactagtataagtgacccggtaggaaaaaaaaaagagagagagagagagagagatgtttgtctttcttatagggttagggagaatctgctgtatgttccaagtaaatgttttctaccattaccatcttgttaagctaatgcaaaaaaagaacagcagttttcttacccagaatcccaaatttgagtcaaggccaatttcataggaatgtcctcctatgtaatggggagttaactgtctaaatcagggatcattaaactacagtttgaggattaaatatggcccacaaactgtttttgtgaagcccacaagctaagaatgttttacctttttaagggattgaagaaaaatcaaaagaagaataatacctcatgacacatgaaaaatgtatgaaattctaattccaatgtccataaagttgtattggaacacagccacactcattcatttacgtattgcccatggctgcttccacactgcaagggcagatttgagtagttccaggaggaactgtgttctccgcaagaccaaaacacttgctgtctggccctttacagcataagtttgcgcacccctgatgtaaataattgtttcaccatcttcccacctctgcaccgacacacatattcttcctatcatctctttctccttccttcccttcttctcttcctcttcacacacacatacctcattttgaatttggcaattatgatyacttacagtaaaggtaagcggaaatacattttaattttcctttgtcatttctctcctccctgtctgctttccctttcctctactgcctttatatagaatgtctgagggctgtgcccttttcccaaaatattttgttttaaggtgggggttagatcttggtacattttttgacttccatggaaagttttgtgttagtatgtggtcccatttttaacctatttgcagacacccccgattatctaaaatcactttcacatggggctgaggttaagctttatttcttttggcatgtccctaccacagcagacacttcctctttgccttgaaaggacaaaacgatgttcagctgtctgggcttaggcccagtatttgatttatacattatttaatttcctcctgaaaattggaagcaggactttcaggaatagaagtcagtatttttcatttgttttagaatacttctaggtstaatataatcatcagtggtagatgtcagcatgattagggggtgacttaaggtaaagcaaataaaatgtgaatacaaaggaaaattatttgacaatggagaagttccgaagtttttgaataatcattattgtatatgttattaggttttgggggtactacattttggggcacctgtcttcactttacccattgaaggaaagatgtctattatgttatagttgcaattgttgggggattagaagtttgaggaaaatgtaatgtaacccttccagtaattttacagaggatttttggattctctgtsagctgctactgcatttgtcttcacaattaagttcatacgaatgccaggatgtgaatgccaaaatagtttgagattttaacagcagtgaactcaggaaattaaaaattaactctggaaatactatttcatgttttacaaccacttttggatrgtgtgttcctttttaaaccttccttagatcattgttactcttgggttacaacctgtctcctttttaccaccaaagttcttaaaagtctagcacacctactgcctctacttcctcactcataattcgcytctcaaaccctggcagtmtgggctttccctccctctgcacactgctaagctgacctcactatttccttctctccaattataataaccagctctaagtcctcagctttcctgacctttttgctccatctgtcagaattcgtaccctcttcctaaagccctctttcagtttttatgtgggactgtcctaatttcctctacttcttcctgtcttttatagacccatctccctagtatggagctgggcttaagtgtcccccaggttctgtttcttggaccatttttctccctacattcttaggctttcccttctcattttttctcattacctgagacacttcaggagaactcagagggctgcaaagagcacagtttgaaaatcaccccggtcctgtcagactacttttgagtccttaatacagcccaccctatgccacctctgtgccttcacatgagagtgtaccttagtgtgggagtgtgcactcccatggagtgccttgccaccaacaccaccagtacatctcttcacattcttctaaagcttattcctaaagcatctactcttttatgttaccaggctcccagtagatgctttccctccctcatctgagctatggtgggtaaagaaaaggtaccagagtcagacagatatggatttaaatatggatccaccacttacctgtgtgtgatgttgaacaaatttacctaaaggctttcaaatcagtttcttcatttataaattgggggtagggggaaggattttacctaccacattrgattgttggatagattcggtaacttatgtgaaggcagagaacacttggaaatcagtggtggtggaggtggtagtgctaatagtgctawtatcaccatcgtcaatataattatttccacagcagcattttgtttctcatatgtcagttacgtcactgtacttattgtcttgttctcatttcagaatttcagactcctcgaggttttatttatattcccctgttccccaagagcatagaacaaggacttaagcataggttttcctaagtgagttgagttgcatagaatagctmttctcccctaaaggaaaatactgactcyacagtgttcttaaaagtcagagctggtaagtttgtagctgtctcttcatattttaatcaaacattatcacactaaaaaaaatcattgttacattttgtcactctaaaacttgaaactaagtagtctttaaattttaaattttaatttctccaagagttaatgacttatatatttagatataggtggtctgaagtaattatttttaaaagaactacttttgtatttgatgcataaattatatcagtagtaaaatattcagagaagaaaaattaatatacaaacattaaattgcttttgattttatatgtttgattctgtgtcyatcttatttttgattttgtaaaatcaatgccaactgcaaagttttttagcttaaataaccagcagtttttctttttacatgtttttacttacaaaacctttatcctctatctctcaacatatttctggaaaacagattttctgcttctgggaaacatcactttttcacaaatcacacatcgacctggttataaaaacctataactgctttgtttgttgctctgagggccagagttgtagattaggttctgctgtggatttctgaaggctaaagtagggaaggagtggttgtgctattccgatctgaacttctgtaataggagagtagcaaagcagtgaggagttgaaaggcctttaaaraaaaaaaaagtataygttcacatggagtccctctgaataagtaccagcaccccaaagtcactaaaattactccccaaatcaagcattcatcactcagaaagcctttatggatcaccagttttgcagggctcggtatttggtggtgtcctcacagctttgaaccagacatgcttcacctgagttaaggacacctctaccggcaggcccctagagagtggctcagggtactgatggggtcagaaaagggagggtgtgaccaaagagcagattgagtccacactttgaatactttcaggaactacttgcagccactcaggaatataaactagtatcacagctgagagctttatttaacattccacttagttataatctttacctaatctctactgtttttatttggctactagctatttagtgtaaccccatttttgtggaaggctggccaagagcacacttcaactcaatagtagtcaaakccagctctactgaacctacatgaacacatgagcacacaaattgtgtggttctgaagtttgtgggggtattttttagttcttgataaatgttcatctgcctaagcagtatatacaatgtaaagttaaatgtgacacctgctataaggcatataaattccacattcggttaaaaaccaacttgttaagactaaagtcctaaattagttaacattaagtcagatatcttattttatgctcttcatatattttccttctttccttcattgttctttttcattctttcctatatttgttgaccatgtactatgtgccagataaggttctaggcactagcatctaatattagcaacgaaaataaagaagtctattttgtgagaggcaacagaccatcaacaaaataaaatatagtatgtggcaataagagagaaggagcaaaataaagcagggaaggagaatgggattacagggagrgctgcaggttttaatagggtggccatggaaaaccttgccgagaaggtggcatttgtgtaaagacttgaggcgagtgaactgcaattatccaaaggaagcacatttcagggagagggaacaagaagtccacatgctccgaacacgagtgttctttgcacattcaagaacagccaggaagccaatgtcactggagtgaagagtgtgagggggttctagrgcccagttgaaaaaaagtgggagtaagtgattggtgtcgcatgctgctgatagattaaatagattgagaactgaggattgaccrtaggattagtgaccttgacagagcamttcagtgggggagtgttcagaagtgtcatttcaatgggtttaaatgagaatgggaagagaggaaatagaaaatggaaaatgaagagagctcttccaaggagagttgctaatgggaatgaaagcagatatggagacaaggaagggactagattacatctrtaaggtgagaaattacaacgtgtttttatggtggtggtaaagcttgactcaggtaaaaggaaatggaaccccatgcataaatagaaggattgatcttggcagcacagatacttcatctattgaaacaggaaagaaagttgagtrtgtacatacaagtagagggaaaggggtagactcaatggtgatagcatgttgaaagttcttctctgccacatgaacaaactttctttccagtgcttaaacaacacctgcagtatccttctcatatggtcatttgcatattatctctacagctgtcttatgtttggccagcttattaattgttaatatatctcttcctcttattgagcaaaaacctttcttctagaacattgatcctagttctgcttcccatagcctcccaagatggacagttctaatttttctatagaagagcctttgaaggactggaggactgatgtggtttctcaaggccgacctcattcctgctgattctaacacctagcccttcagtgtttctgctggcatgtgtggtttcaacccctgtcacattcagacactctcatctaacagggcccagggtatttaatcagtttcatttgctaatcaggcctcattggtcccggcctttggtatctgtttttctcccaggcttttttctacatatttagtgtttctcacaaatactaacattgaaccagcatgccattaagatttatttatttatttcagtagctttaggggtacaagtggtttttggttacatggataaattgtatagtggtgaagtctgggcttttagtatacccatcacccaaatagtatacattgtacccaataggtaatttttcattctttacccccactcccaccctaccccgttctgaatctccagtgtccattatacaattccatatacctttgtgtacccatagcttagctcccacttaaacatgtgagaaatgcagtatttggttttccattcctgagttacatcgcttagaatgacctccagttccatccaagttgctgtcaaagacgttactttgttattttttctggctgggtagtattccatggtatatataccacattttctccatcctcttattggtcgatgggcacttaggttgattccatacccttgtgatggtgaactgtactgtagtaaacatatacatgcagatgtctcttttatataatgatttcttttcctttaagtagatacccagtagtgggattgaaggatcaaatggtaattctacctttagttctttgagatatctccatattgttttccatagaggttgtactaatttaccttctcaccactagtgtataagcattcccttttctctgcatcctcatcaacatctgttgtttttctgtttttgttttttgtctttttagtaacagctattctgaccggggtaagatgatatctcattgtggttttaatttggagttctctgatgaatagtgctgctaagcatttttttatacggttgttggccatttgtatgtctttttttgtgtgaaaaatgtccatctgtgtcctttcccacttttttttttaagttccagggtacatgtacatgttgtgcaggttacataggtaaacatatgccatggtggtttgctgcacctaccaacccatcacctaagtattaaacccagtatgcattcactgtttatcctgatgctctctctccctgccctccaataggcctactttttaatggggttattttgttgctgctgttgagttgtttgaattctttgtaaattctgggtatcagtcccctatyagaggcatagtttgacaatattttctctcattcttcaggatgtctgttcactctcttgataatttcttttgctgtgcagaagtgttttagtttaattaaagttccatttgtctatttttgcttttgttgcttgtgcttttgaggttttagtcatgaattctttgcccagaccmatgtccagcaatcttccttaggttttctttagtatttttacagtttcagttcttacatttaagtatttgatccatcttgagttctttttttatacagtgagagacaagrgtccaatttcattctcctgtgtatggcaatacaattttcccagcaccatttattgaaaaaggtgtcccttctccagtgtacgtttttgtcataaaagattgttggctatagatatgtattagtccattttcacactgctgataaagacatacccaagactgggcaatttacaaaagaaagaggtttaattggacccacagttccatgtggctgaggaggcctcacaatcatggtggaaggcaaggaggagcaattcacatcttaaatggatggcagcaggcaaaaagagagcttgtgcagggaaactcctgtttttaaaaccatcatatctcatgagactcattcactatcacaagaacagtgcaggaaagacccacccccataattcaatcacctcccaccgggttcctccyacaacacaagggaactgtgggagttaaaaatcaagatgagatttgggtggggacacagcctcaatgatccatctactgctgttggtggagcgtttaagtctcccactattattgtattgctctctgtcttttcttaggtctaagagcatttgttttatgaatctgggarccctggagttaggtgcatatttatttaggattgttatatcttcttgtggaactgatccctttatcattatataatgaccctcttygggttttttgtttgtttttgtttcgtttgtactattattgatttaaactgtttaatctgatataagaaaggctattactgcttgcttttggtttcatttgcatggaatatttttttcatccccttaccttgagtctataagaatctttaccagttaggtgggtcccttgaagacaggagatatttggcttgtgtttctttatccattccaccagtcagtatcttttaattggagcatttagatccactatttagacccgtattcaacattaatattgatatgtgaggtacaattctaatgatcattttgattgttatctagttgttttgttttcttcattatgttactgttttataagctctgagttttatgctttcaaatgtttttatactggtgcatattgacctttcattttgaaatttagaactccttttagcatctcttgtagggctggtcaagtggtgacaaattccctcagcatttgcttgtctgggaaagtttctctctcatttatgaaaattagttttgcaggatagaaaattcttggctccccatgggagaagcaccagctgtgtctacagtgatgggctgacagttattctgcttttgagaagattaaagataggacaccaatcttttctggcttataaggtttctgctgagaaatctcctgttactctgacaggttttcctttatctttcctttcaagttatctgatgcttttgtctcactactcttagaattccttcattcacattgacgttagatagcctgatgaatatatgccttgctgatgtccattttgcaatgaatctcctaggagttctttgagcttcttgtatttggatgtctaagtctctagcaagaccagggaagtttccctcaattattctctcagataggttttctgaatgatttgcttttcttttctctcaggaacacttatgattcttaggtttggacgttttatataatctcatatttcttggagactttgttcatttcttttaattcttgtttcattatctttttctgatttggttgattcaaaagcattctcttcaagctctgacatcctttcttctacttgatctagtctgtttttaaaactttgcattgcattttgtaattcccaaaatatgtcttcatttttagaagttctggtttttcttcaaaatatgtctctttagaaaactttccattcatattctaaattgttattgtgatttctttatgttggttttcaattttctcttggatctcatcgagcaacttaatagtcagcattttgaatttttttatctggcatttcaaagattttgttttggtttggatctattgctgggaggttagtgagatctttggagggtgttgtagaactgtgctttttatattgcagaattatttttctggttccttatcatttgggtagactactttttcttactatttttgaatttattttttattctactgggttaaaaaaaattccccttgagaatgtgactttaatgtttgcggtatagtcacctagcttaggctctgagtgctttcagtggcaaagactttccaagttccttggttataaaacatctttgcacagtggctttctcatatgctggttgtagtaccagtgtgctgggtgtgtgaacaggttcactgtctcgtggggctggaatggcagaggtcccatgaagcttacatcattctccggtggtgtgtacttttcagtttttttcccataatatttttcactgagttgaacagttcagcttttgggccagtaggaggtacccacaggtaaaaacagctgcagcttaagcagatggatatatgcaataccccagtggtggacagaagtcccagccttgacagaagcaactgggggagctctccttgaaaggcactgaggtctttgcaggagaaagggagggagccacctcagctyctcttccagaccagcacgaaagcaatctgcctccctgtcacactcatgtcgcaatgttctggatattcagatcagacgaggcacttctgtggatctgcagaaatgctgacattcatgtagagagggattgtgaacctaccccaaagtgctccagaaaggccatccataggtgcacccmagccaagctcctgtggaggagtcccagcsacgtctgcagtgataggcaaagggtagaagtccccttctccaggtcccttcacgagcactggggctgcccaactgctggggtagaatgacagtctttctaccacttagcccagcactgcatctgtgcctctgctgaaagaaacttcccacaagcagaaagttctaggactcaaaggctgcactctaattaattttgtcccacagggtgctcccttgatatggtaccctttcccttcccctaggagtgacagtcccttagggcaagactactgtaaatactgctgcttctctaggtatagccaccctgtgggggctgccacaatccaggctggtgctggggaatgtctacaagggatccagtgatgtgaagatacaagggttgaaggatcctgagcagaacaaagtcccacaacctatgtgcacgaatatggcagccgctactacagctcaggcctagggcaagagggaagggacactatgcaracaaggcagtgccctcaagaagtccccaaatcgcaatccactcctgtacttgtgcttacaagggcagagacactctgcctgagttcagatgccagcagtctgccacaagacctagagatgctgagagcactcccacctaccctttccaaagattactgagcctctgggggtttgacctctgccagcttcttgtaaaataaagcacactttattttgtggctgtatcatagattctcccagtgaactctgtgataggctctagcactctccccttaacactccatttgggctatgattattcacctataactttggttcttccttctgaggagaattggtcacccgtgtctcttatcagcaagctggagaagttttctgatgccacaggctgtggacaggtctgcaggatgtgcagtggcttgggctctgctcttagcttcagaggggagtgatgttgcgtggagctgaactgaacttcctctggtctcccaraagcaagtgcaagcaccagctctgatgagggtggcaggggagcgacataractctgtaagatttctttggttttaaatagccctagtgtggctcagtgagtgagaactcactgaatatagttctcagatgccagctatggaagtaatgtgctgggcacatgaacagtctcaccattaagtttttatctaatgtgtttatccttaggatgaggccaaggacaaagtacaaccatcaaagratcccttccaaacctatctttacccattagttaaccccatctagacaggattgtaatttctaagtattcacatgatcccaggtaaatcaacatcaaaaccaggagacttggtcagattaaatggtatggggcaaagaaaaaggggcatatttccagtgtgttgaagccaacatgcctgggagtatagtgtatcactgaaacactatactctgaaacactgagttagtagggcwggcagttttcaaatcaagatgacacatctaatgttgaacactgtgggttgtaagtacccaacctgagctaaagatgaatatttcacagttatttgcataggagtgatacttaaaagacatgagagtaaattcattctttgagagattataggtaaagactaaaaaccaggggccaaggataatacatcatatgtctatggcatataagtatatgatcttaggagaattagaagctagtcctagcacattatcatgtacatgaaaagttgatgtaagagaaccatactggtttgcagcacctgtataaatacaaccatcctaattttcctattatcacttcctcaagcccatgattgctgcttctgacactttagaagcagtgtctgagctgatcttagtaccatgaccagccccattagcactgctacctcctttaccattacaacagagtatcagcagcagtggtgatcaccagaagactgagtgtgagtcagctccagtagccaagcttaggagaaaaggcaggtcagttcgatagcatgaagccacttggagatgtggaaaggtagagctgtgactagagctggcagaggcataagccttggaaggctggttggggcaaggtgaaaaatgggaaggacagaagsaggtaaagaagccagaaaaggcaaaattttaccaggttctttcctctttactggaatttgaattttgtcctacttgcctgtcttgagactttgactgacataaataaatcttaagacgaaaagggaacaaaagactgaaaacagctcaaatatcttttacttgaaactgggttaaataaactatgctcctataaaaggaatgagaaatagctctctatatagccgtgaagttgtttctagcataaattgttaagtgaaaaagacaaagcagagccagacgccgtggctcacgcctgtaatcccaactctgggaggccaaggcgggcagatcatttgaacccaggagtctgagaaagttgagaaacagaaagttctaggactcagagcctgcactctaccaaacatggtgaaaacctgccagcatggcaaaaccctgtctctaccaaaaatacaaaattagccaggcatggtgatgcgtgcctgtagtcccagctatttgggaggctgaagtgggaggacggcttgagcccaagagatcaaggctgcagtgagccagcatcacaccacctcaccagctgagcacgatcttgtctcaaaagcaaaacaaaacaaaaaaaagataaagcagagaaaagcgtgaatactatgctaacatttttcgggaaggtggcaggagaggtgggaaagcgtccctttatcaatatatcccagctaatgaatgaagaaggaataacagaaataggatagcatcattttgcagcccttcatgaatcaaaagacctggacaatcrtaagtggctaytaacacatgaaaagaagagcagccatacattatgtgcawctcagcaatacctatgaagtacttgttcaaaaaaaaaaaaaatcaaacctgaaactccccaagcctctagatcttaatacaagttaataagaaatacaggaggcaggagatgttaaataacaccagagggatgcrggaagcaaaataaggaatatgggagactggataggatatataattctgtttcttgaacataaattttaagggaaaagagaaagagaaatcccttagatatgagatatagtaactaaatgtaatgtgtcacacctattctgatcccaattcaaaccaaccatctgtgaaatatactgactggtaaatgtgaacactaactaaatactgataatgttaaggaaatgtagctaattttaatgtggcataaaagtgttacagtatatctttagaaatacactaaaatatttatgggttaaatattgtgattctgagatttgcttcaaaaaattcagtgcagtgttggagataggattacagtgtagatgcaacaaaattggtcatgagttggtcattgttaaagctgggtagcaggcgagtgatttcactstatactgttctctgtactgttgtatgtgtttgaattttctatcgttaaaaaatattaagaagaaaacaaatagcattatcttttccctaagtgttcacaatctcctctgtctcccctttctcctattttctaaggagaaagaattgagcaagtttacaaagtggggtggagctgttgtgaaagatacttcaaatcattttttagctactcagaattatagcatgaagtcaaagttctctaggcttgaaatgctgtgtacctcattcttcccctccaacacatatttccagttatacgcacaattttaattgactgtagggactatcttcaaataacatttccataaacttccaaactgaaccgccccagattggagttttgtaatctattagccattcatgacccctcccctacccacaaaaaaagttgtttttgtttgctttctcttctgattttcatttagacttctttctttgccaatagatttaacacaaagatagcattttctaactttgaccataatccatactggaatcatcattcaaaaataatggcctaattgttcctacaaatttcataatcattttcaaagaagttsattggtggcccttgaggcttttcaactttatcctattttggatgatatctgtggcctagaaatcagttgtatagcccaaaatgttacctagactactaatgaacagcaaggtctaaggaaatggcaactagaggccgggygtggtggctcatgcctgtgatcccagcactttgggrggccgaggctgkcagatcacaaggtcaggagatcgagaccatcctggctaacggtgaaagcctrtctctactaaaaatacaaaaaattagccagatgtggtggcgggcgcctgtagtcccagctactccagaggctgaggcaggagaatggtgtgaaccccagaggcggagcttgcagtgagccgagattgtgccactgcactccagcctgggggacagagtgagactccatctcaaaaaaaaaaagaaaagaaaaaagaaaatggcaactagaaacaagcagccccattgcagcacgctgaacaccgttttttggaagcatgcaccactgagcaggaattccaaaatggcacctttgcaatagtacattttgaggcattgtgttgccaagacagaaagaagagaggaagcagtgtataagcaccacaaatttacatatacatagaaaaggatagagggcagtttttacatcctctctctcatttcctccaccaaccaacaatcggcctgactcagattacctatccagccctcctaaggatcttcacttcctccccctagaaaactacagagttgctctgttgtcacagtgtgaaaacacacacacacatgcatgcgtgcrtacacatacacacacacacacacacacacttgatttggtgcataggaagtgacctaattcagtttgtcctcatcatagtgacaactagactgagccaatcagagactttctgtagggttttgattactggaattgagaaaatgagggctttctggtgggtgaagctgtgagatgtaaaacacagcaactgttcctggtcatgtgaagccaaagtacggagagaagcagagacaaaaactctcttcatcgagacggaatcccgatggcatcccaggccctgcttccagctggtccgctgaggcccagccacactgctttctttaagttcagttcgacccaataatatcattacaataaattcctccttttggattcaaattggctttccatccctagcagttcagccctaatatacagcagatgtcacaactgatttcacatatttggagaaataggagtagctgagacagaatttagtctrccttgctcagagacattcacagatagtgtgaaaaccactcatgagtcccctttgcttaaagttaccctggtcatgtttattacagcatgtaaaggtacatagccttaaagtcttttcaggacttgggatttttcttaaagaaaacaaatcaagagtgttcattaaaagattgatataaaaaattaataattctgaagttaacccaaaacttaatgtaatcttccattggaacatttgttgatgtgtgtggggggtttaaattccacaaatattattaaaatgagcaatcagcagcaagatgttttaaaatattttgtttcmgcatgtaaaatctcgttttattacagaattattttgttaaaggcacagctatgccaggttgctgccagagtgataggatcataacagcccagttaattttaaaagactcacaagtggtaggccttggaactactgatggcaacatgtacatcacattttagtataatgcttaaacttacaccacatcttgtgaatttatatgcatctgccaatgtgtgtgtgtgtgtgtgtgtgtgtgtgtgtgtgtgtctgtgcacgcatgcatgtagatacacatatatttatttcaaagagaagagagttggtgggaagtaggacagacttgtgaagtaattaagaatttctactggctctcacattcttcagtgtaacttaaaatgtgtacaaaagatatcttgaatacactgtgtcaaaactggtctggtttcatttccagttagttgccagcatgctaaaatggagatgcttgctaccaaggtgtagcttgtctaaagtttagtgattagatctccaaatgaaaaagtacagcctaaagaggaaattcttggcacttgtttcaattatctcctctttacaacattatagggtgctttcatgtgtatgtattatcattcatartagagagtacattgactaagattgcaaaatagtttccattgtrtcataatccccttgtgtccagttgactcacatctctgaaaaatttctgctcagttacaaatgtctgctggtctctttccaatgatactttgtttgtttgtttgatggkwggaaatctgaagaaagttcacttakttaaaatggtgatgtaaagtatatgagtacagtccwaawatttactmaawgtacatactcaaatttactcmactttaggtcttcagattttaaaaactagatgaataatctatcctttaaaaattmwccattaattcttcaagtataccaactgctgcatttctaatacmawaacaaccttatcaagtgatwatttaattacaccttttaaatgaaattttaaaacatgatttawtcatgaaaaacaagtagtttcatccacccttctttttctacaactctttgcatatctgtggcctgctatttattwcagcctttctcataatttttagtgtaggcttaacaagcatatagttttaaatctttctttaggagactttctggcttttctcattgctgaattcgacacaaaccttattctcttattagcattcttgcaagggagtttaggtaataatagttaagaaagaatgtttaagtttgatagtacattaaataatagacaatgatcagaagaggaaaaaaatgcatgggtattttggttaaggttttcaaaacctaaatcatctttattctccaccttggcctgaacaaagaataactataatgaaaatttggcctatgtggcttttacacgtatgtgttatttccttccgttacctcacatatataattttttgttgttaaaatgcaacagctggatctcgctattggctttcagatcagtaaaatcagagattgccctttctttgcttcctttttagtggacctgcaggaaatagagttcagagtgtacctcactccttacaagacaacagcccatataattttgcagataaggaaacaactccttcagtttctaaatacccagtatatagtgttgttatcaaacatcaacacctgtatgcatttaaattcactcacagtttaaatgaaattacacatagttaatacatgccacttgtaaagtctaatcttatcttgggaacttggattttgcattccttaactagtgtgcttaaattttcagttgtattatcctatgttttttttgttttttttttttttagtagatgaaaataagacacaggtgtttaggtttctcttcatgtcgataaagatctaaacaagcatttagttatacttaggagcagctgttgaaattttctagggtacaaaagaaggatctaacaaaataaaacccactcacctctagcatgattagctccattttgtattttctgtactccccaactgtgataattccagccaaactgtattctggcctaagtcatctggaaagggggaaagcaggtgttattatgaagcattcagaggatttaagaagatttgaaatatagttactatagagcagtgattcctaacccctttttggttttrgatcctttttagactataatgaaagttttgaaccttckctatagaaaaatatataatatgtatacatgggtrtatgttttcataagtttcaatgtattcttagatccatctagatatccrtagactctcagttaagaatctttactatgtggccaacaaacacacaaaattagtgaaataccaattgaaatagtatctagttcatgtaacaaagattgctttattatttgaaattaaaacaaaataatataatgtgagcttctaaataaatggcttataaacaacataagtattacaagtcagaggaagcagagaccaccttaaaaatataaaaataaaaaagatacatgagtgtatactgggtattttcagaatatcttatgtaattgggatgatgtgatttcacctcatttacatccttatttatttatatgctagatgggaaaaaaaagaactttcttccaaaaagcataccactgtcaatgagtatgacatgcataaaataagtgtaatataaataatyctattttcttctcactctatgttatgtgctaatggtatacttattggttactcacaaggacctatcttcatctgccccttagctagctacagattgtcaagtcattttttccccctgtttaacacagatagccattaacaccatgtcatcttctttaaatgtaaaatcatttagggatgccaagcaaatctgctgattagctcaggccagcctacaccagattggagaatgggaaagtagtgaaagacacgcattacagattaagactgggtataaagagaagactctaacaacccacccccaccaaatatgccacacaagtgctcagagagaccagagtcccaaactagactacccaggtgaaactacagagtttcacaggaggcagctttatgtgtgtgtcaatggggcaaaatgtgagggctggcagtaaagaagtctgacagatgaggaaacatggggaatattaaaaccagtttaacacacttgcccacaccatcccccgagccgcttcctcccaagctcccagagcaccagcaaggaggttgagacactctagacttggggaggagtcttgaagtttttcaggaactttgcttgctttcttctcccaaggacatcccctgtcctcctctcctctttgcccaggaccaacctcaagctctcccattacatgagtgcttttacccaaagtgtggtgcctcttccagagctgtcagctttctggctatagcttggatatcagccccacaaggacccacaaatacaaacctcaacataggatgacttactgtgcctgatacgtttttgcctttttagtccatagtagacaattatcttgactataattgtcccagcaggagctgcctctgtgtctgtgtatatgcgtgtgtattttttttttctaaggcaaaaactagtttatatctttgttcaaagatgaccttagcaggagacctttttttttttggagttgatcggtaggtcaagccatgtgctaacctggcttgtctgggtatgtctgggaagcagagcaggaccaaggctgcagggcctttatggaatttctgtgctaggaagggagatagacatttaacacaaatatctctatatcttgacatttgcgatatggcaggaaagtacaggcacctatgggactataaaactgatcctaaaacaagcaggcatgaggaggtagtgaggtcacctctaggaatgcctcctcaatggaaacatttgcactgaaccttgaagattaggtagatgagccagtgcttttgcacaccttgttccatgaaagcaagactgtttttttactgttgtattccccagtgtctgcttccttgtaggtgatcaataaagatttcttgaataaatgaaagaataaggggctcccaacatctgtttgctctcttatccctctccttccctacccagtggttcctgttctctccattcccttaccaactggtatgttatttttaaaactaaaaatactctgttttatcatattattattcaattaaagttagaaacatttaaaatccccatagatgcaaatgctagaacaatgaaataaaagctcaagattttttctgcccccaaagctctgtggaataatcaattttataaatttttaaaaaacaaaaactatttggaaggctgaagcaagaggattgctccagcccaggagttcaagaccagcctgggcaacattgcaagaccccgtctcctaaaacaaataagtaaatacaattttaaaaaggaaaaactaggcttcaccatgcaagtttataatgaaaggttatacactgaatatatactttagctatatatttcaaagacctcaagataacgttaaggccgggcatggtggctcacgcctatagtcccaacacttgggaggccagctggggaggaccacttgaggccaggagttagagaccagcctggacaacatggtaagacttcatctctataaaacataaaaaagccaggcgtggtggcatacacctgtagtcttagctacttgggaggctgaggctggaggatcacttgagcccaggaggtcaagactgcagtgacccatgttcaaactacttcattccagcctaggtgacagagagcaaccctgtcttcaacaaaaacaaacaaacaaaaacaactttgaatcagcaaaattaagcaaccaagtgtgttccccttctctaatgtcattaagctttgagtgtgtctttacagaaatttttattttcttatgtatggcatcctagattgtatgactttaacataatcccagatggattaattatcatgaagcctattttgcagacgattcaagggaatttagcccaagagcaaaagttaggtaattccttaaatctgaaatctgtcctctgaaatactactctactcaccgcttaaatggttttcagtgaagtggcattttaaaaataagtgctgcttgctttacctctgaattcccttctccaatgccattttactccctgagctgctttcttggcagtttggggcaccccttgctgtttgtgcctgtgayagtctgacttccatctgctgctctgcagccaggagcctgctgtgctcccttcagtcacatctttcatgcctggccattcaagcacctttcatcaggtctcaatgggcctgggtaaagggccctccccctgcatccacatgagcacataatctcccaggtagcctcctccttgaagcacctccagtgcatgtgttcgcaaacagcaggacatcactctctactgggttcctaatccctcagacacacagaggaaggaggtcgcaaggctgtgaaagtgaaaagaaaagcgagggggcgggtgagcagaggcaacacaatgtcagcgcctgggccctccagcggctgcaccacaatcatcgccagctgcagcccaattaagctcaacaggtcacaggtgttccagacagaagatgcttttaacaaaaccactttcttgaaaatacctaagactttttgaagcactgcagcccatttcttttggtagattctttaaagctatttagtacccttcaaatacaaagaagctgagaagcacatttcggcctcagtggaaggcgtgcttgcttcatgcagaacagcgggggcagcagccaggctgccgtgaccgagcgcagagacagcatctctgccaatacgtggattcagtgtgcagctgcagaaaaaggacgtgaggggtgtctccctcctccagcttggtcgcgtctgatactgtagcctgaactgtgcagttcactcactcacacaagaaattgctgcatagccatgaccttgtgtgtactcttaaattacaatctctaggatgcagttgtagttttcctatgaacttttaagcagccctgccacatgctggttaaactaggtgaatgaattcagctatcaggaactacttttcatcttctgacacattttaaagtgctggcttcattttctccacagatccaagtgttccctgtgcctgccagaagtgtggggaggggatgacaggatccaagcagaaattaggtagttgtttaagtcaccttcggacctttgttacccttccacctttctttgaggatatcgataatctctgagaggcagttargaatgtagtggggaaggtcaagttagaatttcggcatccctattggaagggagcggttcttggttcccctactcctcaggcgcacttacagcagcatcccttcttcccacgcctgtgtgccactctcatgggtatgtttgcctgttgtcattattgtaacctgtttacagccaatagcgaggacatgctgacgctacccaggtcttatctggaaatggaagcaactgcttaaatttacaattgggtttctaatctgtcaacgcaccagaaaagcccctagtactactgtgaaactgaaaagaacatgggaagagttaaagcacagcgggaatgaatacccagaatagggcccaacgttttcagcttttccttcctgttgattagtttttggtaaacagtctttgccttgactgttactttttatcacgtcatttttttaaattattactgcttgcttagaaaccatgttggttttaattttcacaatacgcctgtttctgttttgctaagctgagccacctgtttaaactcttcttgtctcatgaattgggggaaagaaccgtaggcaatgtataagaggtttcatttttttccacagtgaagtaagacattgttcttattcttcatggcattcagaattctgcacaattgcctcttttgcccttttgcatttaaaagtgaggtaattagatttcccaaggttcaatggtcaagagccttctcatcccgcggagttgcttccccacactgctcacaagtggagctgtctcgcgtaatccagttattgctatattgttgttataaaggaactgctttttcagagagctagcatagcatgaaactttatactcacatgtccctttgctttcattgcttttttccccacatttgaaactaattactattttattcagtgtctgtgaggatttctaaacatttttgttaaaaatcttttcctacgtcctaggaattcatttcaaatatgcctaaatccttcacattgtgagatcctgcctttgttgttttatgtttttgtcagatattcgatcgtcagatctattattactgctgaacaaatggaaagaaaatttgtgacatgttggcaccaaataaattagtgtcatagccactgaaacaaaggcatgtcttcgtctagctctgacagtgagatcttgggcccactctgctatttttttgtcttattttctcattttcacaaacagataatgttttacctttgcaaaaagctgtatatatatatatattctaaagcttggatatcaatttttttttcttttttttttctgagatggggcttcactcttgttgcccaagccagagtgcaatgtcacgatcttggctcactgcaacctctgcctcccgggttcaagtgattctcctgcctcagcctcccaagtagctgggattacagrcatgcaccaccacacccggctaattttttgtatttttagtagaaacggggtttcaccctgttggccaggctggtcaggtatccattttttagtcaaaactgaataagatgaaatactcagatttatagagctggccaaaacgtttttgtttttacagcctaatagcaaaagcaatcttgctggtagttggctagtaattcatttctatgatgtagtctgcagcctatgggggaagaggacaagatggtgaagggattaggggaaagcttccaaaatcctttttgccaaagaagttaaggagcttgagcgacccaggttttctctctaaatgggttagtttaacattccagacagtctgtgattcaaacttgtctattcacctatacatctactcagcagagttctttatggcctcataggaacaattcagctgaattcccccatcactgaaactgttccagactttatctacttttgctttttgttttttagagacagagtcttgcagtgttgcccagcgtggccttgaactcctgggttcagatgatcctcccatctcagcctcctaagtagcatgactacaggcccacaccactacacccagctccatctgcattttgaatgtgatgccagcagagtgatgagctttgtggtggtccctgggttcagtgtagatacacacacacacacaaacacacaaacacacacatacttatctcattaggttttcctataaactttatagctagtaatgagaaaggtcctagtttaaattgaagggttttttccctcagtttctgtagtattcattcctaaatagagagatatgttgacagatttatctgaaaagacctcatttttccaaagcttaacacagaaaggaaaatcccgtaatcttaggttagtttcatcaagtgagacaataaatcgccatttgcataattttctttttttagcaaagattccattctaattctccaaaataatatacagtcatgcaccacataataacatttcagtcaacaatggaccagatacataatggtggtcccataagattacaatattatatttttgctgtaccttttctatgtttagatacacaaatacttacattgtgttacagttgcctgcctacagtattcagtaacatgctgtacaggtgtgtagtgtaggagcaatagaatagaccctatagcctagtgtggaatgggctattaccatctagatttgtgtaaggacagtctgtctacacaacagtgaaagcacctaacaatgcacttctcagaacatatccctgttgttgagcaacacrtgactrtatgttactgcactgtttgtaaattttctgaagttgtgctccattccagtgcagtttttttctatgacaatacaacaaagaagctcctgttcctgtgggatacattttgataccgaagaaagcatctctcaaaaataacaaaagcatagctgtattcttgctagaatttctaatttatgttagaaattagttctacagaaagaactaaatgcagagtagtgctccaaactgaaaacatagcttgagatgaacatacatcacagtattaaacaattttagttatttactttctcttcattctaagaacttaagaagacctgacaacatctggatcaggggttcccaccacccccaggccatgcaccggtactggtccgtagcatgtcaggaaccaggccacacggtaggaggtgagcagtgggcaagtgagcattaccacctgagctccacctcctgtcagatcagcggyggcattagattctcataggtgtgggaaccctattgtgaactgtgcatgtgagggatccaggttgtgcrctccttatgagagtctaatgcctgatgatctgagatggaacggattcatcctgaaaccacccgcactcctccgccccctgtccatggaaagattgtcttccacgaaaccagtccctggtgctaaaaaggttggggactgcttatctagatcatatgaaacataagtaactaaaaatactatagattggccaaatctggggaagatgaacatagcatgcatctttttgaaaaggtagttgtagttaagtaactattcagttcagcaaacataccttgactatttacatagccagagcacaagtaagtgctttggctgctaccactgttgctgccctttgacccattaaacacactggcctyccttcygtctctcatgtcctctccccatcttctcagaaacacaaggaatatgtctatatgtctattccttgtgtttctgtcctccacccgcttcctttttctattttggaatggggagagcaaaagtaaaaagctatgctaataagcaagagccataatgtgccctgattgagttgtttggtatctcccaaagtatgtgccaaagatcaccattaaaccatttatagatattctgccagaaataggaggggaagagttctatgggaaacaacragtgtcgtagtccattctggctgctataaccaaataacttrgactgggcaatttttaaataatacaaatttattgctcacacttctgaaaactgggaagtccaggatcaaggtgccaacagatttggtgtctggtgagggcctattcctcatagacataccttctagctgtgtcctcacatggtggaaggggccaaccagctccatcaggcttcttttataggggtactaattctgtcagtgagtacagaacgctcacaacctaatcacctcccaaagacctcacttcttaatactagtagcattggagattaagtttcaacatatacattttggagaaaaacattcagaccattgcactgggttaaagaaaatcaaactgaccatcattagtagcctttgtaaaacctttaaaattctattgtgcaccatggggaacagaatatatacaggttgagtatcactaatctgaaatccasagtgctccaaaattcaaaacttttgagtaccaacataacacacaaaggaaatgctcattggagcattttggatttcaaattttcagattacaaatgttcaaccagtaagtagaatgcagatattccaaaatctgtaacatgtctggtcccmagcatttcagataaggaatactcarcctgtatagtgttgcccaaaacttatttgaccatggaatacttctcctgaacacactgatttcttaacggaaatgctggcgtggaccatgagaagagcaggagagctgcacttttcttgggagatattatatcatatcttggaactcataccacagtaagtggctcccagagcaaatagaaaccagccatcatggacatcctaagaatacatctgtttccaaatctacctttttattcgcggtaggagaaaagaaccaataatccagtcaatgcttttgcttttggaatttctactaagaagccttttcatgaggaaaaaataaaaacaaaaggaacttttaggagtggcgctctgtcagctgcttgtgcatcagctgcttgtggatttggtttagagctttagagaggactggcattgactagctttcactgtcattgtggcccacatgacttygaaaacactatcattgtgaattttagttatatttgatggtagaattattcttttaaaaaaatttctccattctgtctactgaggctagttcaatgtaatccgtgttttctttcttcccaccttgctgcttctctactcattttattcctttcccttacctgtatgcatgtctcagttctgttcttcacactttggtttccaaagctgtaacttattccttctctccacactaaagccctttccatttgcctccctgaaagtacttctaataccatggtacacacggcatttaccttacatgcatccactactggtttgtgagcaggggaagacaggtgctatatcttagacatgcctggatcttccacctggcttaatatagttattgcacagagtagctattcagtggatgttgattgacgaaagaatgactggctaattatttgtagtgtcctggttacatttccctcagttactggcagtatattgctaagtaaatgtgataggaaagtaagagtggcagaagaagrtgaccttattgactagttcttcagagcatcctttataaataaaaagaaacagagtaatgtttattgaagcaagtgttgaattcaggcagtgtttctcccgccctaggacatacagacagctgcactccttcctctacacagaagaagtcacgttcatattgaggtccttgagtacccatgtttctcttttcattaacwctcagaagttctctaggtcatccctatctcatccaaccattagtgatctggtcaaaactctgtccaagttttctatatctcaagtttcgtagttctccaagctagatggaattgtttaagagacaggggagtactaaatatagtagggaaatttttcccaaatgttgacatatactagaggccccaagttacaaacattcacatttcaggtggtcactacttctctgaccataactgatcactaaagccgctttgtcattaccatgtaagccmccmcaaaacaacaayttatagctcatagaaaaatctatagmagcaggctgggctcgggggctcacacctgtaatcccaggactttgagaggccaaggcgggcggatcacaaggtcaggagatcgagaccatcctggctaatatggtgaaaccccatctctactaaaaatacaaaaaactagccaggcgtggtggcacgcgcccrtagtcccagctactcaggaggcttaggcagaagaatcgcttgaacccaggaggcggaggttgcagggagccgagattacgccactgcactccagcctggtgacagaacgagactctgtctcaaaaaaaaaaaaaaaaaaagagagagaaaatctatagaagcaaatgtgaaggaaagtaagtgattctgcaaagaggaatgcccaggggaactgaccctaaggacagccttctaggccctaatgatataacatttcccactacctacatttatttactgtgctgtattaggctccctgaggttccagtgattacaggagtacaaccatttcttcttctgccagtttgattactgtgtgttgagagtgaaagcctgtctgacaattggttcccttcctcggatgtgccagcggggcaaaccgcccatctsgccatgtgaatcaaaacccagaaacgttgagaggttccaggcagccttttggttacctctytttttctcaaccctgctctttttccaacccccgccctggccaccatggtacacatgctcatctggccactctgttggatgtgtttccatcagactttacacatacccctattagcaagatcactgcactgtgcaaaaacagggagatatcagtcatatagcaaatgaaatagtacagtaattaatatttgtccactcacatagtaggtgctcaataaatgttyccaaccattatgtgccaggctctctattctctgagggagtctcagctatgaggggtgggggaggtatgcaggagagagaaagagagctccgtcacctggcaggaaatgtagtgctctttgcctcttccagtgattcttcagacttcttagccttgcaaccattgcttcaaattcttgtccagatgaaagaagtgctgctcagaagggtgtgggtggggactcttcccacttggtcccttcacctccctttgtagagatctccaaggtccccttagaacacagtggaaccattggatagccagtttaccatgctggtcatttcacaggtttttactgtgcttattaattatcacattcttgttttcaaaagagctctttttgcaccagaacatgtgataaagtggttttactaatcccttgaagttttgttttttccttcaacaagatgatagccaccctcttttttcagaaaaacattaacatgcataaccactacagttaacttcggcgctcattaatgaagcccagaactaatagttacattgtcgtaatttgacaaagccatctaaatctatgcatgtttttgaaagctccctaaacatgctgctaaatcccctaaaaagctactaaactgctttggcagccattagcccagcataagcagaggaactcttttcagtgagtgaacaaacagagaaaatacgctgaatggatggacaaatgtgtttcagctggccctttcatttaccaatataagggcgcagtcaatatcaatcactgttttccctgttgccctgaaaatcacaatatctcttttcatcccacaagctcttttcactaccgtaatgtgtctttagaatgacactggcatcagcctgcttccgctgtctgaagtccagagagcttaaaaacacatttcgggattcttgaaccttcctccccttccgttttcctactgcctcctccctcctccctctgcatccattccgccccctccccagattcttttcaattcttccagctttcctggctgagtaaacagcattcacttctctgttctaatgcagctctccaaagtaaatgttgacaaccctatctgatattcctgagatttaagaactcattaaagagatacacataaagaaatgcttttacatgttggtaatacatcaaaggttgaaaggaatgtggaaactctgtgctatgacacggtgtgttgatgagcaaggcctcactctgtatcagaatatctccccctctgccctcccttgaccgttggctcccgcctccctccaccacatagagacatgcatcctttgccatcccttgttaaaagtatgtgcgtgcacagctacctacccttacagttaagagcaaatgcccttaaaagcaaatgccacttcttagatatcttttggcactcctggttctgagtacttaatacgttgctttgggatgaaggaaagaacagaatgctctgtatatgattaccttttatccttttgaaaacttgagtggactaattcttgcagataaattttagcaatgggcatttagttgtagaaggtaccacagatgaatatttggaatattatgtttctaaaagagtactgattgttttctacctccttttatttacttattttttaaaatttcagattgtagctgtctgcagagaggcagctcttctggctctggaagaagacattcaagccaatctcatcatgaaaagacatttcactcaggccttgagcactgtgacacctagaattcctgagtcattgagacgtttttatgaagattatcaagagaagagtgggctgcatacactctgagaaaatatatatattcaagatgctgaaaatcctttccagagaaaatttgtttctttttaaaattttttgagagtgttaaaaaaaattttactaggcaaaatgtttgaagtatgttcagtagaatttaggggctttggttcttacagattttcaagtcatgtaagtacagtgaaaatatctctgagcataagtttcaatcagttttacctggaaatttgtggtgtggtttaaaaaacaaatgtttagctttttcatttgcgacctagtctgttcatcccatgaagcgatttctttttccagaatctgtttgagtgtctttctaaaatgccaaacatgttggcatcaattttatacagggatataaaaaagtatatgtggataaattttttgtaatctttagggatataaaaaagtgtatgtggataaattttttgtaatctttatttttgaaggccagccagtaaaatggcccaatgtrccagccaggcttatgtggccttgttttcaaatatacatatatgtgttatcattaaaattcatatatgcatttttgttttagccttcttaatctctacctatggccaaaaaaattttttttgagagatattttgtataatacaatgccctttgaaagtgtaagcccactctaagcctagatcagtaggcttgggttttttttgttgttgttttgtctttttttttttttttgagacagagtctcactctgtcacctaagctggagtgcagtggcacgatcttggctcactgcaacctccgcctcctgagttcaagcaattctcctgcctcaacctcctgagtagctgggactacaggtgtgcaccaccacacgcagctaatttttatatttttagtagagacaaggtttcaccatgttagccaggccggtctcgaactgctggcctcaggtgacccacccacctgagcctcccaaagtgctgggattacaggcgtgagccaccatacctggagaggttttgtgtttttgtttttttttcataaaatgcttttaataaatcatatgaagcattcatgtttttacttatacatattttcagggtaccagtaaactttttagttcaaagataggccaaattgtacttttttttttttatgagacagagtctcgctgctctgtcgcccaggctagagtgcagtggcgtgatytaggctcactgcaagctctgcctcctgggtttacttacgccattctcccgcctcagcctcctgagtagctgggactacaggtgcccrccaccatgcctggctaatttttttttttttttttttttwttagagacagggtttcaccgtgttagccaggatgatctcgatctcctgacctcgtgatccgcccgcctcggcctcccaaagtgctgggattacaggcatgagctactgcgccctgccgccaaattgtaatcttaaacatattatgttgcattctaaatatgtatatttatgcttcttgttatttatcctcaggatttcttcacactttattacttcataaatactcttgaaaaagctttcagaaagtgattctctgacttcagatcagaaactggcaatgggaagaatgtgcacttaaacttgatcactgtagatctttgaaaattcccagaaagacaaatcagacaagaaatacctgattatcaaaataatgggctatacagttttgtggtggcatacattccttgtttgtttgtttagagataggatcttgttgtgtcacccaggstggaatgcagtggcacagtcgtagctcactgcaccttcaaactcctggagctcaagtgatcctcctgactcagcctcctgagtagctaggacaacaggtgcacactgccatgtcaggctaatttttttttttaaacagagagacagagtcttgctgtgttgcccaggctggtctccaactcctggcctcaggtgaccctcctgcctcagcttcccaaagggctgagattacaggtgtgagccaccatgcccagcctgtggtgacatatattctgaagtcacatctcaaatatttaatcctcaaatatatttacatcctcaaaaatatcagattttcaagacaacactggtttaccagtacataaacccacctaggggacaaagaatattaccacttagaactgtgttgtcaaatacaataaccactaattgtatctgaccattttaattaaattaattacaattaaataatatttaagaattagtttatcagacatatcagccacatttcaaatgctcaatagctacatgtggcaagggtctgccacactggacagagtagaaaacattcccatcattcagaaggttctcttggacgctgcagatctggaaaacaagacttccatattgaaataaatacaacctcaaaacttttatgctctgtgttccctttagttgttatctacatagaaaattatgaaacaagagaggaacttaccttcttccctattaaatatatggctaagggcacaagaaaataagaggaaaacttatccttcagggcctaaacaaggaaatgaaagaaatctcattcccaatagaataaaaaccagaagcttgaaatgactctggtgcaggaggctgggtggtggggaggagggtagcagtctcaatcaacaagtttagatattaatagccactcaaagccttcagcccatataacatgaagtgacaactgagctctgcacataatgctcaagctctataataaccaacactctcagcacaagggtagacaagaaaagaaaaatctcctgctggccaggaagaccacaaggaggctttctgacttggcctgtgcttttgatttttaaaacattttttaaaagaggcctctctgggctgggcgcggtggctcatgcctgtaatcccagcactttgggaggccgaggcaggcggatcacgaggtcagaagatcaagaccatcctggctaacacagtgaaaccccgtctctactaaaaattcaaaaaattagccgggaatggtggtgggcgcctgtagtcccagttactcgggaggctgaggcaggagaatggcgtaaacccgggagacggagcttgcagtgagctgagattgcgccactgcactccagcctgggtgacagagtgagactccgtctcaaaaaaaaaaaaaaaaaaaacctctgagaattctgactatgagcttacctgcccatggctttagaatgatttgaattcacactaccttcaaattcatgaaacctcaaaacctacaaattaacctaaaaacatggagccaagctaaaaatgccctgggggtaactagcacttggactagttacaggaatgtagcttcgtctcagaggattccaaaagctaatgccttgcttaccaagggcttgtaatctcacaggatgtgatgggtggggcctcagatctgctgatgggagcataaattggtacaaccactttggaaggcaactggctatctagcaaagttgaagaccctacaatctaacagttctcctaggtgcatatcccagagcaagtctcacattgatgcagtgagatagtgaataggaaagttcatagcaccattatttttaagtagtaagaacccggaaacaatctaaatatccatcagtaatagatatatgtgatagtcatacaatggaatactgtggcaataaaaaataattagagctacatatgaaatagggatgaaacayggatgaacaaagaatgttttagaggaatatgatatttaaaatttgaagcatgaaaaatatgtgtttatgggggcayatatagtggaagaataaatgaatagaaaagaaaagcaccaaatactggtgaggaatttcctcaggggagaaaagttgagctgcttcaattgtgtcagtaatgtttcatatcttagggtgggtgatgggaatataggtgctgatttaatatagtctgtactttttstgtacctaaatatttcgtgataatttttaaaagatgggccttaaaccaatacagtcatatcatttaactcaattccatgaatttacaatgcaatccacagtgcccacaaccccatgtttctggaaaatcaggagtattgggtacaatggaataaaatgcaagaaggcaaataagagatcaggcttttaggacctaggaaacaaataaagaggaatttgttgctgaaagtaatgtgtagctgacactctcattacctgacacaatgggagacattatgtctgggaataagacatctatttccatagcactgtagtcctgcaaaggagttggaagttaygaatttttaaagattttagaacattatatctttagtctctcataagccaattatttatatctccacatagcccattattaccattgaaaaggcatgcaattcttctatttgaagcttgttccctttttacaaaagtactagtaaaaatctgagtcatacaaaagagcaggtcaggtgtcactaataacagtttacctcagcttcatctccatgaaggttttacttctaatcccagagtctcatgtttatgtattacaagagtgtatgaaagctgggcrtggtggcacacaccagtagtcccagctactcggtcgggggttgaggtgagaggatcgcttgaactcaggagtttgaatccagcctggtcaatgtagcgagatcctatctcttaaaaaaaaaaagggggggaaacagtgtatgatcctattatttgggtttgtgtgtgatcgaatacatggtatatagttcatggaaaatttaagctcagcaaggaaagaaaatggccagcttcctgtcttaggaagacaatttactttttggcatctgtttggttgaaagtttgcctttgatccagattctttcggatgtcagggatattcacattgacatgtctttttagtgttccaggagattttagtttgaatagtacaattttttcttcttacaacaaaacttagaacggcttctaacttatttcttcatggccaagaaactaccctaacttatctcgataaatatttagttctgtcttatttctaatgtgtaaaacaggttttaaaaataatatatagattttgcatttataaaaaaagatttaatttatagaaccaaacttgaacatatgtttaatttagcctaatcagaaggttacagaaaaagttgctgtaaagatagaataaargtattgtactggtctgtttttactgaagttccagaatgtgaggttattagagtcttggcttattgtgtcatgttttcctgaatgcttcctttgaagatgagcacacaccaaagcatcctttgatattatgtatggattaaattaacactgctttccaaatgtggtccacatagaaattctaatgttacaaatttgcctttcttccttgsattttcattataacagttgtgtgcacacataggccttttgcctaatgtctttatcaaatataccccttactccaacaaatttttgcagaaagagatgttacagggttttgagagtcctacaaaatcatatggaaatttgtagactcttctttcaggatttagtgataaacatttctggaaagacggttaagtgtcacacccacacacagcaaaacccaaggatatgaaaagaaaaaaaaatagaaacatagaattcatctatgcttaaaatagggaacaaatataacacgtattacagrtttcaattttacaccaacttaaaaaggatctaggaagttttacaygtactgtgcttgacaacacattcagtgtgacaggaaataccttgtttacttggtttcaatacaccatcaattgtaagcctcactatttaaaaacatmtttttctagaaaaaagataaagtactataatattgatttgcatgttaatggtattacatcctgattccagaagcattaaaatgtgaacaacatatataataaaaatcaatgaaatacagttaaatgcaaaggaaattaacatgtaataatacattcaaatattttataatacacccacagccattaaaatattacttgcacccaacataattataggtaataatgaaaattgcgacaagcaaataggagaattaaagatactgaatgcagattattttggggccgtgaataatcacaaagtgaaatatcccaaatgaaaatagcaggggaactatgccaaaaatgtggggtgaaggggaaggctgggaggaggagagaaaacaccaaaagaaagctggggtacatttggaagaaggaacattttctgaggaaagaggaaaaaagtttagaatacaatggctttgaagtctcaaaaaaagttaagaaaacatggatgatgtgattcagtagataaaataattgagtcagatttaaacagaattaacagagcaaaggaaagggactaagaagaaaaataatactctcatgtagccttagattcagaaattccacattaaaccatttatcattcagatatacattcacagttacaaaatggtacgtataaaattttttcattacagctttgttaaaaagacaattcagttatctatccataagggcta

SEQ ID NO: 13422 - DNA, 44362 bp, Homo sapiens
  misc_feature (1)...(44362): n = A,T,C or G, or insertion/deletion polymorphism (see Tables 1-2)
ttgtattatcctgctctcattccatggagatcactctgacgatattgataatagtttttatacttcctcttctttcttttttttcttttttgtttttttgagacagagtctcactccctcgcccaggctggagtgcagtggcttgatctctgctcactgcaagctctgcctcacaggttcaaacaattttcttgcctcagcctcctgagtagctgggattacaggcctgtgcaaccatgcctggctaatttttgtatttttagtagagacagggtttcaccatgttggccaggctggtctccaactcctgacctcaagtgatttgctcacctcggcatcctgaagtgctgggattacaggcctgagccaccgtgccagacttgtttcctcttcctctaatgaaagatgtctaataacttttccaatatcttctatgataatggaccattcagattttccattttcttttgggtcatttctggtaatttacatgctactggaagttacccatttcctctagatcttcatatttgctgccacataattttgtgaagttaacatttatatctttaatctctcctgtattcacggttatatctttcttattctttttatttttactttccctcttttcaattttttattttaatttttgtgggtacatagcaagtgtatatatttatggagtacacgagatgttttgatgcaggcatgcagtgcataataatcacatcgtgtaaaatcgggtatctggccgggcccggtggctcacgcctgtaatgccagcactttgggaggcggaggtgggcggatcacgatgtcaagagattgagaccatcctggccaacatggtgaaactgtgtctctactaaaaatagaaaaattagctgggccttgtggcgcatgcctatagtcccagctactcgggaggctgaggcaggagaattgcttgaacctgggaggtgggggttgcaatgagctgagatcatggcattgtactccagcctgggtgacagagcgagactgtctcaaagaaacmcataardaagtaagtaaataaataaataaataaataaataaatgggatatccatcccctgaagcatttatcctttatgttacaagcaacccaattatacttttattaatttttattttatttatttatttttgagatggagtatcactctgtcgctcaggccagagtacagtggcgtgatctgggctcactgcaacctctgcctcctgggttctagcaattcttctgcctcagcttcccgagtagctcagattacaggtgccagccaccacgcctggctaatttttgtattttagtagagatggggtttcaccatgttggtcaggctggtctcaaactcctgccctcaaatgatctttctgccttggcctctcaaagtgctgggattataggcgtaagccaccgtgccctgcccctcttttagtatttttttaaatgtacaattaaattattattgaccatagtcaccctgttgtgctaccaaatactaggtcttattcattctttctatttttttgtacttattaactctccccatctcccttactttctctcttttttgcttgatcagttttcaatttcactttttattgttattttcattttctcttcttcaatttctttttttttcttattaagctaaatacgtagctccttatgtacttaatcaagagactttttgtggagcgggggattaggtttagggtgtattagtatatgaatatgaaatatcagtatattaatagaaaaaatatcagtaagctgagaaaattcattaggtctaattagccaaacgtacaatgttcagtagtcacttcatattcttctctgcttgtttatatgtgtgcagaaaaggctgagaggtggactgagtagaagctcaggggtagtttggcagccgtaggaagagatggcaatggatgtttattagggaaatgagaaaaaatgaaagcgggaacttcaacatcctcatgggttgaggctttttgggaacttccgggagacgaaagtgttcaaagagggctacttgggagttagaaacaattaagtaatggcaatttaagtctgaatgggaggagaacattccgctcacacacacaattagtcttactattattcactgataatttaagaataatcctgggaattattttaataggaaatgtccaaatgtttttcccaaagtgttttcaaggcttaggaaaagatcattaacattatcatagcttatgaatctcatcttgtatttttattattcatagaatccttatgatcttaattgaggtattttttgggggagagggtatatacgtttttacctaagttctaatattttctcaattttgttttgtcctccagaaaattggagaaaagacagctttcagaccggaatctaattttttcccagcatttgattagaaaaaacttcaaacatacaggaaattygtaagacatgtacagtaaatggctgggtgcggtggctcacacctgcaatcccagcactttgggaggccgaggtgggaggatcacttgakcccaagagttagagactagcctggacaacatggtgaaaccatgtctctactaaaaatacaaaaattagccaggtgtggtggtgcgtgcctgtagtcccagctacttgggaggctgagacacaagaattgcttgaacctgggaggcagaggctgcagtgagtgtcactgcactccagcctgggtgacagagcgatacttcatttcaaaataaataaataaaaataaaaattagccgggtgtggtggtacacacctgtagtccagctactcaggatgctgaggtgggaggatggcttgtgcagcacagcaggtggagcctgcagtgagccactgaactccagcctggccaacagagagaggccctgtctccaaaaaatataaaaaataaaaaatagaagaataagagagaaaagaaaaaataaatgtacaataaacacctatatacccaccacccagattctataatcagaacctaacttttactagctagaattaacatttgtctagacctacaagtgatattgagtagtgatagctctatcataattacatagacgtactctgtttctgctggtaagcccagtgcttcataagagttttgtactgtggccaatttcatgagtgttttaaacaagccaacacaggtcagctgttagctgggtggaggagcttctagagagttcttcccagcttaaaaaaacaaaatttcaaagtcatctggcatgctgcctaaagacacccacagcttttggctcttagaagcaggtgatgtccataagcataaccttggatttctggttgtgcaacaaggagcaactgccacctctctggggcagaaggtgacagagacagtgacaagaggaggggtagctggaattcatatcccttcacatcagtttcactaaaagttccaccctgcaattggtggccatggtcccgacagagagccctgtcctcttctacaaattcacacaatcttctgtatgttttctagagccattaaagcttttttaaaakgagcactgttctttgaaatctaaggaaaactggcaatcatctctctaagccagttccaagtaccgtatatatatctcaagccataataattacttcattttggcaaaacatcatctatccttggcttatttcttttcctggaacgtctttgcttaagaatagagtcaggagcaaaggatgtgtgctcataggtaagctagctccttctcacagaaaaaccaaccaaaaaacaaaaccaaagaagagtcctatttcttctcagccttttggctccgatcaagcgtcgaaaagaggctttgtggttgaatgaaatccataccatattcatcctgttaaaaacaggtgttatttccccaaatgctaaagctctttaggtcagcactgaatatgcaattttgtttttgtttttgtttttgagacggagtgycactctcttgcccaggctggagtgcagtggcgcgatctcagctcactgcaatttctgcctcctgcgttcaagtgattctcccacctcagcctcccaagtagctgggattagaaggcactcaccaccatgcctggctaatttttgtagtcttagtagagacaggagtctcaccatattggccaagctggtcttaaacttctgacctcaaataatccgcccaccttggcctcccaaagtgctgggattacaggtgtgagccaacgcccctggcctgaatacgcaattttgaacaggaatggagtacttgggtgaatatgaaaataacacatttagaatggggctggtatttttaaattctaaaagttttattctcttttgcctttctgagtacatgaccatcactctagaacaaggatcagcaaacatttctgtaaaggtccatttagtcaataattttggttgttgcaagtactcaactctgccatagtagcagagaagcagccatagacaacacaaacaaatgagcttggctggactccaatcaaactttagttatggactgagatgaagactacatcagctatacctgctatactttgcaactgtttcctcaaaggtaatctagttctcaacctttagacaccttttattcaattcatgaaaccataggatgacagacagtcatactgagcctgaattttcaccataattttaaaagtaataagtagggtagaggttaaaaacttaagttttagagtcagtcagaagtgaattcaaatccagactctgtggctttcttagttgtgttatatcaggtaaactgaagaatgtttctacgtttcttcatttgtgaaatagggaaattgttttgaagattaaaagaaataatgcatatcaaactctttttttttttttttgagactgagtctcaatctgttgccctcttggctcactgcagcctcagcctaccaggttcaagtgattctcctgcctcagcctcccaagtagctgggactacagagcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcctgtagtcccagctactccggaggctgaggcagcaaaaatcacttgaaccagggaggcggagcttgcagtgagccgagatcgcaccactgcactgcagcctgggtaacagagcttgactcgtctcaaaaaaaaaaaaaaaatctatgacatttggtgttcaatagtccatttcactgattatataccattttgtaactaggaaaatttccctaatgtcatgtttgtttaatgtgagatccctatgattaatgtgatataataatagatgggttatacagcaggctccttgaatgacagctggctccgtccgtctcggcaccacaggaaggcaggaaagaagtgtaycttttcatctctaacttgccactgtcactacctttacatatctgtgggctaatagcatttgtgcatatatattttaaaaattaatatttattaaagcactaaaaatgagttcagatgctttatggagagtggcacatctcattagacagtgttcaagcaaatgcaactttatttcaaagttcttttttctttacaggtaaagacatagtataaacggcaaaattcaaaaggtgcagaagattctagtacggtgaaaagcaagttttctttctctcctccactcctagtcccacagtgaccatcctaagaagcaaccacttccagagatgcaaacacacataccacatacacacagccctactcacactcttctgcactttattacttagaatacaccggaaaatttccacgtctcagcaaatacagctgccctgtactctttaatggcagcttagtgttccctcagagggatgcgccccatatcattcacccagcccccagggacgggcttttaggttgtttccagctgcttgctcttacaagcaacattgcaacgctgccctgttacttttaatcttctttatcctgtgattccgttctgcttttccttccagcacgactgcaaagtgactgcggggttttcccgagtgccctcgccccagacctcagcgagttatttgtggagtcaccgggtcctgctccgcattgttattcgaagtctccccgggacagcggggagcaggcggagctgcgtgtcccggcctgcgcgtctgggcccaggcgggcgcgcgtcgcgctcggatttcgggcggatagtgcgtgggaggcggcgctgccctccgtatgcagcgcgcgtgcagccaaggyggcgctgcgatctgcggcctggggccctggtgtgaaactcccgcggagacgctcccagccccgggccgcagctcgcccctgcacggagggaggtgtctaaaggtgtctcttaggaacaggcacaacccgrgcagccgggccccagaacaatgggtgctttcagccgcccctttagatgcctggcccgtcaccatggcaaccaccccattattgaaagtcagtgccggtccccgccttagacgctctcctcccgggctcccctcccccgccggccccgccgtatggtgtgtgtgtcactggcagctgttgtcaaaagaaggcacctctttgtctccaggggatgaaagccatttggtttccagcgccaccctttctctccgcccggcaacttttctccgcgtcccgtccccaaggcgtccctggatgcgcgcgctcggccccgcgcccgccacccgcgctgagtgctggtatcctccccatcactcagcccagagccgttctgcctctgcctcaaactctcagagtccttataagtcttattctcaagagttgtgtcccagcgaagggaatccgccttggaaatcgcggcttcctccttgcacgccgctcgctgtttcagcgcaagccggatctcccctcacacccaacagcaccaccttccgagactagcggctcattrccgcccagtccccgcggcccggmgcaagaactcctcgccgggccccattccaggctgggtcgggtctttagaataaggaccagttgtgtrtctccctgtcgctggcagcggatcactttctggctgaagaaaagacaaaacgacgagggaaacaataggacctgtatgttttacacacagttctcattcgaaatgtatcatgatcatatttttaaagatgcgtgttacctttcataaatacytaaataaaacttactttctgttgtctgcggaggaacttgataaacattaaaaaagcaagaatatctttggtggccatgtgtctgggatgtggggttcacctatcatctgccccagggatcctaagaggggaacagatggtgttttcaaaacctatctggaaatwaaaaaggttacggtgctgagaggaagagcagagtccaagaggagggggctgtgagagagaaacgcagagagaggataaagctaggacttccagttattctgtaaagacaaacttgagatgctgtgtgggtaggaaaaatagaggcgtcataaaacttcactgatactgaaaagtgtaactactagaggaagaaatttaaggataatttgttcagaactcagtctatattttcaaataaagtttaaaaataattaccaaatgataaacacatttttaaaactttgtaaatgctaaaagtatgacaagtaaagaaaagcaggtgactgacaagaggtaagttgttctggtctttgctttcaataactatccgttccatttgataaacaggatgcaggcgagtctgacacacaggaaacaagtgtttgcaaagcccaggggtgtgtttccctctgcgtacaagtgttatctgagtaactgtctagaaaatagtaagtatgttaccctgaaaacgtttcctgacagtccaacctcttttcctttccgataaattctggagaaaattctgtcattcttccatgagatttgatgagtatttctccagtcatttcaaatgagggtttattatgcagtgtcaaaatttgaaacgctagttatttaatgcgatgggtttggtaaaaagtgcgtaagattgttattaccaagtaaaagcaattttccatatctgatggtaatctctgatttttaaccaataaatgcgtcattttattttgttgaagtcacacatggaactatgtagaagtgagctccacggaactcaggggccaccatgggaatgaagaccgaggccaagcagacattgctccggaattctattgctgcgtcctctggagcacctctgcttgatcttttttgttggttgattggttggttggttggttggctggttttgtcttcagagatagagtcttgctatgttgcccagaatggtcttgaactcctggggtcaatcgatcygcccgcagcttcctgagtagttgagaatacaggtgtgtgctgtctcacccagctcttcatctgttttctatgaaaccttccatttgtctaaaatatttcacttaattaaaataaaagttgccctggtgtggtggctcacacctgtaatcccagcactttgggaggccgaggcggaaggatctcttgagcccaggagttcagcaccagcctgggcaatatagtgaaaccctcatcttttaaaataaaaaaaattagccaggcatggtggtgcacacctgtggtcccagctactctgaaggctgaggttggaggatggcttgagtcaaggacgcagaggttgcagtgaccagagatcacaccactgtactttaagcctggtcaacagagccagaccctctcttaaaaaaaaaaaaaatgaccactagaattgtagcgttgggaaagatcttaaagataatttagttcaatcctctcattttacgacccatgagacccaaggacctccctaggtaacctcctgaggtcacaccgccagtttgtggtgaccctgtcaccacrcagatgaccctgtgattgcttatcatccccacaatgctttcagacatgactcttaccctgacatcacgtactgtaccttgttttcacaacggacatgtttctgtcttgtcttctaacaagattaaataaaaagtcgagcactgtggcttgtgcctgtaatcccaactcaggaggctgaggctggaggatcgcttgagaccagcagctcaaggccagtgtcagcagcagagcaagaccctgtctcaaaaaaaaaaaaattaagtaaagtctgttttgtggaaccttcctgttttccagtccaccttacctaagccctccaattctagactttaattaaaatattcagtctattcattgattgtaatcacacttcactttgttagttgcctattggatatccattctcctgtcttccttattcacagaatccattttggaagtgggagtgggggcagtaatgtgcccagctaagaacaatcccaggacctcctttaacataatattatctgaacaagagagtaccagtgggattcaggaaaagtcccttaaagggagcctatgcagttggctcacacccatttgctctttatctttttttgcctggaatatagcttgatgcctggagccacggcaacaatgttatgcacatgaggatgaaagctccacccccaggaagggtaggatgacaagctaagagatgcctgagtccatgatggaagctgccattccagctctggatttatgaacttcttgacatctcatgatgtggagagaaaactaaacccctatcttgtttaagccagtgttatttggcttttctgttacatgtagctaagcataatccccatgggctccaatttaggataagaataaaggagaattagggggcctggcacagtggctcacccctgcaaccctagcactttgggaggtcgaggcaggcaaattgcttgagtccagttcgagaccagcctgggcaatgttgtgaaaccctgtctctacaaaaaaaatagaaaaattagctgggcatggtgaccacacacctgtagtcccacccagcccagaggctgaggtgggaggatcacttaagcccgggaggtgaaggctgcagtagtgagccaagattgcgccactgtactccagcctgggtgagagtgagaccatgtctcaaaaaaaaaaaaaaaaaaaaggtaggattaggaattcagttttttaaggaaaacttactagctactcatctagtagcctgtacatacaaatcacagggctgtagtatagtaattcattcacttagtcttataataaaataatctcttccccttaccccctgcctctggctactatatgtgtatgtctcttgtccagatgctattatagatccatgtatggtaagaactaaactttcaagtgcaaccttgacattcttgaagatcacagggcctgaatgcttgtgaattcccctcatcttagcagacatccctggctaattctgtcagcaggacaagctgcaccccatgcagttctcaacctaatgagcttcaccttcctattagccygcgaaataattcaaacaaaccaatcacatgctccaatgggaaccaagggccatcctgccctcttgtctctaccaaggctgcctctctgggggtttgctctactccagaatgcagcccccaccatccacaatctcctcctcctgcagctgtgagtttacattgtgaataaactgctatcaacctcatccgtccagggccaggtgtcatgtgtttggctatcttgtactttttagggcagggatacccctcattcaccaacagtggaaggtgatcagaacagcccatgtaagccacaaacatttatttatttaaaattttagattcaggggtacaggtgcaggtttgttacatgagtatattgcatgatgctgaggctttaatgatcccgtcagccaagtagtgagcacagtacccataggtagttttttgacccttgacttcctccctttcccctgcttttgggatcccagtgtttattgttcccatctttgtgtctgtgtgtacctaacatttagctcccacttacaagtgaaaacatgcagtatttgcttttctgtttctgcattaatttgcttaggataacggcctccagctgcattcatgttgctacaaaggacatgatttcactctgttttatggctacatagtattccacggtgtatatgtaccacattttctttatccaatccaccattgatgggcacctaggttgattccatgtctttgctattgtgaatagcacagtgatgaacatacaagtgcatatgtctttttggtagaacaatttatttcctttgggtatatgcccagtaatgggattgctggattgcatggtagtgctatattaagttctttgagagatccccaaactgcttttcacagggcaacaaacatttactgaaacctcctgartgccagatattgtgctaggcaatggctacaaaggtgagcaggacagacacagtgcctgacctcagggggcacatactctagtggggaagactgacaaagaagaaaagaccacagataaataaacacagtaattacaagctkcgatgggtattataaagaatagagacagaatacttagggtggtagaggaagacaaagatggggggtagatttagacaaggtgcttaatggaagactccctgagaaggtaccataaaggaagacttaaaggaagaacaggagcttccaarcagaggaaagagcatrttctaggcccagagctgagagtgggggtgagtggtggaggggtgtggcaagagattcaactggagagatcgagaggacagataagtgttaaaggtagtcrggtgtggtggcatgcctgtagtcccatttactcaggaggctgaagcgggagtattgcttgagtccaggagttcaaggctgcaatgagttatgatcacatcactgcactccagcctgggcaacacagtgagaccctgactctaagcggggaaaaaaaagaagtagtaaaggcatttttgatttaatgccatgggaatgcattgatgggttccaagctgcacataactgtttacagttttaaaagctcacttttgctgctgtatagaaaatggattggaggggtgagagtagaaatgggagaccagtatggcagcggttatcatctttcagggaagtggtgattgtggcctggactaaagtgatgacattgcattggagagattctgaattcctgatgtacattgaagatagaatccacagggtatgcttctgattacatraggggatgagggtaatggaggacttgaggatgactcatgggtttgagtagctggatggatggtggtattgtttactaagctggggaaaacagttgaggttggagatacatcgagagctgtcatcattaaaagggtattacactcatgaagccatctagggagagtgcagagaaagaaccgcggagcgtctactaacaagccrcagaataatgccatgcccctgaggtgagggtgtggcctcatgattggatattcttgtggctaatcatctggggaagggaccatttggtgcaataattatgtccctcaggagactggaaccaggaggccagcctgaggccaccaggagagggaggctgctgtctccttgtcagacaaggtttggatttcaggaactccagatggcttgccggggctcctaggtgagaggaggtacacagcatccctgtcccctggaagcaggtgtgcatcccatagagacatctaagatgcccggattggatcacatttgtgagctacatttttagttgcatgttactctttctgctcacttcctttctgttatcttcaagtctttttttttttttttttgagactgagtctcgttctatcaccsaggctggagtgcaatggcacgatcttggctcactgcaaactctgccttccaggttcaagccattctcatgcctcggcctcccgagtagctgggattacaggtggccgccaccatgcccagctaatttttgtatttttagtagaaatgggttggccaggctggtctcgaactcctgacctcaagtgatccgcccacctctgtctcccaaaatgttgggattacaggcgtgagccactgtgctcggcctatcttcaagtctttagacaagctttggataaatgtccatcctggtctctgctctgctataggaaattaaacaaacaacaaaaaatagtgtgtcttaaatgccattgaagagttaaagggatactgaccctcccaaaaccagtatggtggtgggagctgcagccagcagtgagaggtccctaaggggaaagcggatctctttttctagagtagggcgtcaggttcagtctctcctctccacatggacaggctcctttcatggccaggcttaaaggagctggtttttttttttttttttttttgagatggagtctccctctgtggcccaggctggagtgcagtggcgtgatcttggctcactgcaacttctgcctcctgggttcaagtgattctcctgcctcagcctccccgagtagctgggactataggtgcatgccaccacactgggctaattttttttttttctatttttagtagagacaaggtttcaccatgttggccaggctggtctcgaactcttgacttcaggtgatccacccgccttggcctcccaaagtgctgggattacaggtgtgagccacggcgcccggcctggttttgataaggggagcagtctacactttaaatcccccctccacttgactgtatgttccttgaagtaacatagagtaccgcatctttgtacccgcagtgtccaggaggttgtaagcactccatcactgttagtttaataggtgaytgttcactagacattgtgagacacactgtggtttcccaaagagcttagaatccagatttggtcagcagatgcacatgttgatgcatggcagagtgtgcccgctctgtaggttacatgaaagagctgggaaatgctctttgatcacagaggagggaaacattactcccagtgtgggggcaagaagcttcaaacagactttgtggaggaggaaacatatggctgggccttgcgggctggagcgaatttccaaaataggatgagtaaaagacaaacatgtgccaggtagagggctccgtgagaagggaggcatgaggagaaggcattccattgcttcagtgcatgaccggtagtgaggtgtgttgcaaggagagcatacgtgtgaacagggaggaagtggcaaagacgcagaaatgatgttgcagctctgaaaaaaatgtctttctgggtgggcaaggcctctcttgtctcagaccaaaaatgaaatataaataaataaataaataaatggttcccagtgaatcctgatagctaggattaactttttatggtagaaaaatttctcagcagtgagagctgttaaacattagaatggtttgtgagtggcagctttaggaaatctttccctagagatttttatgcacaaaatagactgacttatcatttgtcaatgatttcctgtggcctctcttaaagtcatgggaaagtattacatgagctctcagattctatgttacttgattcaattcaacaaacacttgagtgtcaacttggttcatgcccccaggcattgctatatactggattcatgcgccctccccgcaaggggcctctcttccagtgatccccatctcaacacatgatgcttccatccatgtcattgcccgaatcagaaacctactctgcctcaccactgacattccattaatccctaatccctatcttctctggaaggtgtccacttctctctaatccctgcctcatggctccaggcactagctctctcctagggattactgcaattgtctaaataacctcccagcctccaggctcagcctgttacagtccatcctgcacacatagtctttctgaaatggaaatctgaaagtgtgccactctcctgcttcacatttcttcaatgggttcctgggcttagaggtaggaagtgtggaatctgagccattctgctcagatcttccaacgtccttgaatcacagctttgctgttcgaccttgggcagttatttaagctgtctttgcagcttcctcatctacgaaaaggggatcacaacggtaattcattttagagtagytggggggattaaatgatttcagatcctcctctcttatgtgaactcttaaatttggagtgtccctggaatctggttctcttatctctccacactccttccctcggtcatctcaacaggtcctactactttaaatatccatatactgaaaacacccaaatttatatctcaagctcagcccactctcctgaaccctggacttatatgtccagctgccttctcaacatctccacttggatagttaatrgagctcacagatatattgatatactttggatgtttgtcccctccaaatctcatgttgaaatgtgatccccagttttggaggtgggtctagcaggtgtcatggggttggatccctcgtgaatggcttggtgccctccccatggtaatgagtgagttctcactctgttggtttatgagagagctggttgtttaaaggagcctggcacctcctctctctcactcctgctttcaccatgcaactgcccgctcccctttcaccttctgccatgagtaaaagcttcctgaggcctcaccagaagctgagcagatgctggtgccacgcttgcatagcctacagaaccatgagccaaataaacctctttttttttaatattataaattaccgagtctcaggtattcctttatagcaagcttgtccagcccaaggcccataggctgcatgcggcccaggatagctctgaatgcagcccaacacaaactcataaactctcttaaaacattatcagatttgtgattgctttttttttttttttgagacggagtcttgccttattgcccaggctggagtgcagtggcacaatcttggctcactgcaacttccacctcccaggttcaagcaattcttttgtctcagccttccgagtagctgggattacaggtgttcgccaccacacccggctaatttttgtatttttagtagagacagggtttcaccatgttggccaggctggtctcgaactcctgacctcaggtgatccacctgcctcagcctcccaaagtgctggaattacaggcatgagccaccgtgcttggcctacccatagtctttctagtctcagctgatgaaactatccttctccatgctgaagctcagtggccctcccttctctcttgttctcactccctgcatcccatccatctggaaatccagctggctcctcctggagactacacgcacagtccacctcctcctcaccacctccatggctacagcctggtctgagctccatcacctctcgcctgggtcactgcagcggtctcactagtcttcttgcacagtcttctcaacccagatgactgataaatcagatcctatcacccctttgtccaaaccctccatgggctctctctttcacaaccataatctttaaaagagctttctagcccctgtgtgatcaggccacccaccctgtaaccttgtctcctcctttaccctgcgctcatttcactccagccacactgtcacccttcctgctccagaaactccccaggagcattctggccttacaggctttgcagtgcctgttccctttgctggaatgctctcccccaagatctccctatagttaactcttctgccttcttcaartctttgcactaatgtctcttctcaatgaggcttgttctcactactctcttaaaaactgtaatttgccctccaatcccataacactcctggtagtttttttttattgcacatgccatcttataacctactatatactttacttatgtatattgattattatctgtcttttccccactagaatataagcctcactaggacagggktttttttttttttttttttttttttttttgagacagagtctcactctgtcgcccaggttggagtgcagtsgtgcgatcttagctcactgcaacctctgcctcytgggttcaagcgattctcccgtctcagcctcctgagtagctgggaccacaggtacgtgccatcacgcctggctaattttttaattttagtagagacaggggttcatcatgttggccaggctggtcttgaactcctgacgtcaagtgatccgcccacctcagcctcccaaagtgttgggattacaggcgtaagccaccgcgcccagctccaagagatttttgtcttttgtttactggtgttatgtatccaagcactggaacagtgcctggcgcatggtagggctcactaaatatttatggaatggtacttacaaattataaaacacagtgtatggcacacagtgttttataaatattaacatttccaaggttcacaaccactaggctccctacttacctttccagcctgatctccctgcgctcttcctaccattccagctcagctatacttaacttgctcatctgcagagccttccttatgtacttttttctctgtccatctatccctgcatttgagggatcctttctcattttcaggtttcaaggtagagggtcttccctgactctaggtcagccatctctacagcactcctcccaccccctatgcgttccttattcatcacactgcattgcaatcccttgcttctcatttgtctttcctgctgggccctgtaaccacagggacaatgcctgtgacagcagtcattgcagcatctccagcatccagcacaggtcgatacgtgggggttttcggcaaatgttaattcagtgaatgaatgagaaattctcacggcagcgactgcatttctgcaccttcgacacacattatcacgtgttattgtatcttgtgctgttccttagggcataacaattgctagcattttctaactcaatcctcacaactctaggagggaggtactattcacgttcttatttgagaagtgaggaacttgaagtttagaggagttacagttctttctcacggtcactcaggttgtaagtgttggagcgggttcaagccaagtcctctggcaccagcgtccctaagcccacccagagtcataccattctgccattttgtttctggcttttcttcatagttcaaagtcagccaactacctgcccttagcaagcgtggagagaaccccccgyaccacctcagcaaagggcttgtgtgtggaggagctgccacccacgctccatttcaccaaagtgacaactaatgctagggagggcgaacctctcatcggcgaggtcgccactgtcaccagcgcccactgctgggtccaaggctggcgacgcctcaccgcatctgggcttgacttcctgcgtcactggggcgacccctggtcctgacttccactccacgccttcgtggatcaggacgactgggaccactcaaaagcgtatccaagtcctgaggtctccaaagcggtggagagacccgcccagcccctcactccccggctgggaactgagattgtggagggtgggcgccctgccgcggcccagtggggctgggggcttccagagtcggggtccagggctcggtgtccgagactccaccgccagccgcgccgacctgacccacggccgggtacaacagagaaggcggcgcttcccaaaggcaccgatggagtgcagggtagccgccgccctcaggatttatcaaccgcgaggcgctgtcagcaactcgtgcccggaagccaccccgccccggcacacacatactccagcgccccctccaggcgcactccgcaaacacgcgagcgcggcgaccgccccagccctttgtgactggatgagtggggccgagcagcacgcactgtcttcgacctccaatcaggactcggggtctcggagctgtaccaatcggagatgaccgtggcctcaacagggccaatcgggggactcgagcccgacaacagggcaagccgccaacagcgatcaatcagaggggaggagcggctcccagatacccaatcagcggccttcaggcgcagatcgtgggcggagcggtagccaggccgcgggccggccaatcagcgggcgagcggctgcctcagcgcgcgcggcgggcggggcggggcctgtccgcgcctaggagcagtgggcgctgagagcagcaaggccaggtgaggagtagggacgaccccgagcctggagagggggcaggagtgggggcgcgcgagggtcggggcggggtctcaggatgcagccgggcggcctctcagggctgcggacgcggcggggagaggtgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactgttgccatggcagcgcacgtgcgctcgctggcacggcccggcacccctgcgctcttcaccccggaacgcgcgtgccccttcagccaggcccctgcccgcctgcgccccgcggcctccgtcgccgccggctctgggccggggcctgcgcagggaccgcctgcctaggccgctgcctctccctcgcaccccgggctgcctggctgtctctccctcctgctgtctcctccaggcggcgctgggcaccgcaggcctctgcgttttgaccacccgcgccggttcgcggaatggccacatcctggcgactggcaccagagagatgcaaccgtctgagggccttggggtgtctgtcccccagggaaatttttttttttttttggaggtggagggggcggggttctccctctgttgcccgggctgatctcgaactcgtgagctccagcggtctgcccgcggaggcctccctaagtactgggatcacaggcgggagccccaagggatctttttaaatgtcttactgcattarcaagtgcctaaggagtgctcagagaatagctctgattggatgaataaagacccccaagggcagctttccattcctcccaccaattctggtgggcagaaatagaaagcaaaccacatatgtaattgtacatgttctggtaaccactttaaaataataaaacaggttaaattaattttaatatatttgatttaacccaggatatccaaaatgttattacaacatataatcaatattaaattattggtaagatatttgaaattttttttttcatgcaaagcctttcagatttgtcgtgtgtcttacacttaacagcacacctcagtccgcaccagccacctttcaagtgctcgctggtcccatagtggctatcgtattaagctgcgcatttcttgtgtatgtgtgagctgttgccaaaacatgacatcaaattcagtgttcttggaagccctcttcaaagaacastgattgtgttgcagtcaggcaacgcaaaacatgaggcacggcccttttcttcaaggagtttgcggttcggttgagaaaatagacacccacagataagtagtattttaaatggatgcaatttgggcgatagtaaagataactgggagtatatgattgacagtcagatgactgatcattatcgtttcgaattcaagggagggctatcttcaggctcatgcaggaggggaagattgggcctggtcttgaaagatgggtaagtcttggactgttgggaaaagatggggagggccttttggttgaatggaactgaatatcgctgcttttgtttttagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggttcgtgaatgtgggaaagttcatatatgtaaaccgtaaagtgtctttgtagtcctgtttccattgtgtaaagcctccattaagaaacttaaaaaaaaaaatcaaaactctggtattactcacttcctctcccatctgataagattctggtttctatttattgaattggctgcatgcaaaatgacaaatggaatacttttgaacctcttgygtgggaaagtcatcctatttgcgatgactatatatagcctttctagctctgattctactttttgctcacaaattagagtttagattgtttttgcctggtggtcttgatcctaaccattgttatctgcattgctttgagttgcatcagaaagtgattgtataaagttttagaaaagaaaaagtagaaaaagctaaggaatgcttaatttaactctcccagtcaggggtaactcatgaacctgtactagttctcaggtttgaggtggttctttatagtgagagagtggtactgatgagctctgcttgcaaagatgagattgggaaatctcatgtgcctgtaagaatttaagtgagccattttatgaggcagttttcattttaagctttttcttcaggaatagatgttaagaacttagggggtgatgtccaagggaggtcagtgataccaggacacgacaccatttgcagcacaggagttcagacagcaccggccctggattcacacagaggaactttctcccaaaagaaccaatcaacttctaactgttgtggttatttgcataactcaaatgagaagcgagggccttttggtttaacttctgtgtcrtatgaggtctggaatgagtcatatgaacactggaattgtggaattggagaagagaatgaggacccacacactatgataaaagttaaaaagcaagtcaaagagttccttctcttgtactcatatctgcaccacgtctagaacaacttcccttcccaagagaattaaaatacattttttgtttttccctgcaatactctgtagtactactgttctggaatttcagttctcatgcaacataccggcccctttgcacagtgaaaacgtaagtatgataagtcccagtatgtggaagaactagaagaacccaggagttgtgatcctaaacaacttttaactgggccttgttatgatttccacgtgtgatactttactcattctgagattaacagtcgcactggtgaaactgacagccgctatatggccatactaatgtaacttattacaagacaggaagtgagaagagttgtttgatctagttgaaaccaygggggaatttgggaaagcagagtaaatttgctaatttggaagtctgagacttcagagcttgttattcttgaagcagttgttaaaagtcagtggacatcctgattctcaggtctccgatgtggatgtgcatcctctccggcagcatgatttttccaggaccagaatgtgacaggagcggccccgcaatagaattgcaggctcacaggccggctgcagcacttggctgtattgcgaggctcctttccagctgcttagttcacatgatgcctggtttataaaacctagtgaagtgttttattttttaaaaataaatcacttttgggaaggaaatgtgtgactttttcttcttttaaattatcattcaaaatgagaattttcctcttaaagaggaaatctttttgttttaggaatacattcctgactcttaggtgacccgggtattggaatcttgtggataattgacgttatctaatgtaatttagactctagtagagtctgttcagttttggatgtcaaagaaatggaaagatggtgaaacaacctggaaaccataccttatcatgaacagcggaagtatcttgaaagtgtggccctgagaagaaaaaaactgaggtgaaaactcgtagttttcagataattgcagggctgttatgtacacttgctctgcaaaacagagctaggaggcaaatttcagtttagcaaaagaaagaactttggaatgatcagagccattcatgaatagaatggactttctcaaaaggagtaaattttccttcattctatgagttcaagagggttgcatgaccctctcagaggtcctggaaaagacatactgacattgctggaagggaacattgaatagccacaaacatttcttgctaaataatgatcacgcattccattttgtagtgctttatagtttacaaagtacattcatgagcgttagtgtttaattagtcatgcctaattcttacagccctgtacctccagtggtgttatcctgattataccattaaagaatcaagatcaaaattaattaacatgacttaatctacaaatgacaaaattataatccaggtcttctggtttgaaatccagtgctttcccacaatgcagataatttagcacctaacgttagccttttaaataaaaggacaaagagttcttggaatgctagcgtcttaaagatagtccaaaggaattttcaggtgtgctagyttgtccccttcatttcatttttttcccctcaactcttattcactgcatgaatgttaagaaatagcacagcagtaggggtaaagattttcatgtactgttctttgttatatcaagtattattttgtataattctttcaaattcttgttgataagcacatataatcaagattcaattttgtattctgtgtattttatcaagttgaggaaattaacccaaaagatttaagttcctcttgtttgtagaagaagctagtaatgacagtagtaccataagccagtctagtgctttctaccaaacagactgcctaagagaactatggttatgctgcattccctcgttgtagaagagtagcccagaaacacatggacaggccagatccttattctctgtaggcacattcttttatttatttatttattttacagtatctgagtgatcaatgtgtatattctgtctccatcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggtacggcrgagggggaaactgatagatagtggccatcctacagcctgagtggcttagtcgagtgtcgcacattgttttgagtgtttgtctttggggatctcaggtgtcccagtgctttaattttgctctttgtagtttttttttttttttttgagacagagtctccctctgtcacccaggctggagtgcagtggcgtgatcttggctcactgcaacctccgcctcctgggttgaagtgattctcctgcctcagcctcccgagtagctgggattacaggcatgcaccatcacacccagctaatttttgtatttttagtagagatggtgtttcactatgttggccaggctggtcttgaactcctggcctcaggggatccacctgcctcggcctcccaaagtgctgggattacaggtgtgagccaccgcgcctggcccctcttgtagactgagtacaacctgaaataatatttttgctttgtggaaaataccctgattttaatgacaaaatgaagtgttctttaaaaatatttttttctgattacagaagaaacacatgattattgtagaaacttcagaaatacagaaaagcacaaagaatgcaaaaattgcttttaatcccaccacacttttaacatgtgatattttatgaacattatcccatgatgatgtcttctacatggttcttttttttttttttgagatggcgtcttgctctgttgcccaggatggagtgcagtggtgcgatctcaactcactgcaacctccgcctcccrggctcaagcgattctcctacctcagcctcccgagtagctgggattacaggcacacgccaccatgcccagctaatttttgtattttttaggagagatggggtttcatcatgttgactatgctggtctctaatgcctgacctcaagtgatccacccaccttggcctcccaaagttctgggattacaggtgggagccactatgcctggccttcatttttaataatttatagttttcttccatgtggagtggacccaaagttacgtactgaatccctatttatgatgttactgatttttgttcttttaaataacaaggattaccattcttacacttgaaccttggtgcacatctgggatgatttctttaaagtagtagaggtagcaatgctgtgtcaaggggtgtatacattttaagtactgtaatgtgttgctctccagaaaagttaggccaatttatactttcagtaacaatttcaaagcactgtagtgaaccctgttattgtcattaataattttttagaaacattggcaatttgatagtttattgatatcttgtatttacagtcattttttgttattaaggagactaaaatcttttcaagtatttattgactgtttttcctctattgtgaattaccttttcatgtcctttgttcatttttttgttgttgaaatgtatttcttttttcatgtggatttaaaatctcttttatgggagatctttatgtcttttgattactgcattacagatattttcttacagtctatcacttgtgatttagctttgttctggtggtgtttagccacattttaaatgttttgatttaatcaaattaatcattcttttcattaaggttttacattttgggtcttgtttaatgcataagcaagcattttcatggaattttataaactgattgaaaaatacattttaaaagtataaatattgcaagaatagccaggacagttttggaaaagaattacaaaggggttgttgggaggatttgccctgtcaaatatcacgacacgttaagtttgtatagtacacaagacaaatattcatacagtagacatcctacaagacccaagagagttttgaaaataatatttttaaaaagaggaaagataaaatgtgtcctaccagatatcagatatattacaggtttaacatcccaaatccaaaatccagaatgctctacaatccaaaactttttggatactgacatgacactcaaaggaaatgctcattggaggatttcagatttttgaatttgggatgcgcaactggtataatccagatattccaaaatttaaaaaaatacaaaatttgaaacatttctggtcctgaacatttcaggtaaagattactcaatctgtatgaagtttgggtagtttttaaaatttggtatttgtctgtaacagacagataggtcattgggataaaatagtccagaaacagacccttgcttttataggaatttggtgtagatagatgtggtcatttatcaaatcagtggaccaggggctggttgttaactatattgtattagggcagtcagcttcaatatggaaaaaattaagtccctccacttcacactatacacaaaataaagtctagctaggttaaggagttaaacacagactttataattattagacaaaaacaggagaatgtctttttgatctcagagaagggaagatcttttttaaaagtctagtttgtgattttatttttggatttaattatttaatccatttgaaaattatcttggtgtgcaataatgtttatttcttcaagagttttcctagcaccattgtgtaatttatccttttcccctgttttagaatgacatttctatcttgtcctgtcattatggattcttggtctgtttttaggctttcctgccttttccctagactgctttgattattatatcttgatgatacattttaatacatagttcctctttttaaggaaacaaatttggtggtttcttcaatattctgagttcattttaagccttaaaagctttgttagtgcctgaatcatttacgaatattatgaagtgagttaagcctgtatctcactttaatctagaaaagggtatctaagaaccacttttgaaaagttgaaatgggcctgacatattggctcatgcctgtatccaatactttagsaggctgaggcgggaggatcactcatgcacaggagttcgaaatcagcctgggcaacttgatgaaaccctgtctttacaaaaaatacaaaaattagccaagcatggtggtgcatgcctgtggtcccagctactctgaaggctaaggtgggaggatcacttgagcccaggaggtcgaggctgcagtgagttatgattgtgcctgtgaatagccactgaactccagcatgggcaacataggaaaaccctatctcttaaaaaaattttttaggtgggcatggtggctcacatctgtaatcccagcactttgggaggccgagttgggtggatcattaggtcaggagttcaagaccagcctggccaacatagtgaaaccccrtctctactaaaaatacaaaaattagccggatgtggtggcacgcgcctgtagtcccagctactcgggaggctgaggcaggagaattgtttgaacccggaaggcagaggttgcagtaagccaagactgcaccactgtactccagcctgggcgatagagcgagactctatctaaaaaaaattttgtttaaagacagaaaataaaaggatccaggtaatggaagaaggaaatagaatttaaattaatgtattttattatgtcagtataaaaccttttaaattaaaaaaagtttatgcctgtaaaggaaaaaacaagtgaaggaattgatctacaattcttaaagacagggagagatcaactttgtgttcttttcctaagtttcagtgttggaacttgggaatgagacagatcatattgatatgtacattttagtacctaccataaatgtacctaagaacctatctcaggctcaaatactgtttttacccatgaaatttttatatcaatatgtagattacgaactctactgaaagccaatacattatttaagctgcatctgagatactaagttcaggttactttcaaaaccaaaatatgatatctgtttctcaggtaactttttcttaaacctttattctgtttgaaaaggcagaccagatrgcaacaaggggttttaaaaatagactaggttaccccatatagaagttgggaaaaacctcatcttctgtttgaaaaattcttcaattgagtgcatgaatagtgggagcatagaaacttctagggaggtgttctgtggtttctagagtcaaaatggtgttaaaatacagtaatattaattgcctcaggaagcacgaatgtgggtgaccagcttcccactgggcagctgtcagtggtgccttggcgacggactggggtgaaatataccaacaatgaggcctattttgatgtgattgaagagattgatgcaattattgataaatcaggtaggtgcttttaatatgttctcagaaatatgaaaatagaaagggacctctttcatataatgcttgtagtttcagaattaacccccrttcaaggtcatccacttcaatttagtgcctactttgtgccaggcactgtgctgggtactgggaatggacgttaatattatgatgcagaccagggtttatttcatatgtttacttgctttattggtcttatcctcttgaataaaaaagagaagtaacaggccagatgtagtgactcacgcctgtaatcccagcactttggaaagctgaggcgggaggattgcttgagcccaggagtttaagaccagcctgagcaacatagtgagaccccatctccmcaaaaagtgaaaaaaattacctgagcatagttgtgcatgcctgtattcctaactttgtgaggggctgaggtaggaggattgcttgagcttgggaagttgaggttgcagtaagccctgatcatgacactgcactccagcctgggcaacagcaagaccctgtctcaaaaaaaaaaaaaaaaaaaaaaaaaaaagtaacaaatwaatttcttattgattaaattaccttctcgaaagtatttggctcccagttctgatggcagaactaaagttgtaatcacaaaattcagggagctgccttttctatgtgttctgaattaggtaaatatgactagaagtcctggagcttcagaatttgtagaagccagtcatgatggtatgagcctatagtcccaattattgggaggctgaggtgagaggatcacttaagcccagtagttggagactgcggtgagctatgattatggctgtgaataatagctgcactctagcctgggcaacatagtgagatcctgtctttaactaaagaaaaaaaattgtaaaaagtccttttcacattagtgaacttattaaattcaacagatgtttactgaaaacttgcatcatagcacagtgctagatagtgggcacttgatgatgaataagacatagtctatggctgcagaagttaagtctagtgagggagagagaaaggtaaaaaggtagagnnnnnnnnnnnnnnnnnnnnagagaaaggtaaaaaggtagagcatatgagaggtacccacccctgagcaaagtgcaacagagaggtgggggtgtttatgcttcatcagtggattgaaatgaagttattaagatgtgtggatttgggagcaaagtatgcgcaaacatcacaatattgagcaaaaaatcagatgcataagattatagacagtgggattacatgtatatgaagtttgaaaacagatgcartttagtctaaggtaatagaagtcagaattttggggatgtgaattacctgggatgggtaagagggagtgcttggatgctgaaaatgttccgtatcttgctgtagctagtatttgcataaatgtatatatatttaaaaattcattgagctgtacactttaagatttttacattttactgtttacctcaacgaaaaagtaaaatatatatggccagatcatgaagaaccttgcctgccagtttaaggagggcagatgtgagtgattgaagagttttaagttgggaatgacttgatgagacttgtagtttagagcgatgagtctggctgctgtgtgaagaatggcctgaagtggggtgggcctgaaggcagggagcagctacgaggctgaaatccaggcccaaaacatagatgtccatagtgcaatgaggacagagaggaatgcacagaccagagagaggtgagtcctcgaaaagaaaggagctgatcattggctggatgtgggcgggagaagtggacgttgtcagggatgcatctgtgtttctggcttaggcagcaggataratggtgccatcacacagatttggaaatgggagcaccgggttcagggcatgagagaatggactcatttctgacatgtgcctcagtgtcatccaagtggagatgtccattaggcaggagtggggctgaacttgaaaaaagaataggtaataatgggctgtaaatgaacattgaagccttgggaagtaggtaaaataacccaggagagtgtgtaaagtgaaagaaaatagaagttcagaactgaaaaagcatttaagggatgtgcaaagaaagagaacctgccgaagacactgaggaagaggagctgggaaaataggacaccaggagaggttaggagggagggatgtttgagaaggcagaagtgattgacagtgacacatgccacatagaggatgtatagaataagagactgggagtgaccactcactttagcagcagagctcattggtgaccttagggagaacagtttctgataggaaactttctgaaccattggctaaaataatgatgctctgtttaattctgatattagactgacaactcctttaggctaataactacttcattaatctttttatcaccgttacctcaccatagtgtctcatgcttgatgtgcagttgataagtgttcagaatgatggatagatggattgtataaatgaattggatggctaggcagaaggaaagaaagggagagagaggaaggggagggagagagaggaaggtgagggagagaggaagagaaggagggaggagataagtttgttgagaaggacagagaagtattcagtaatctgtgttctttttgtcttattcctgtctcaggctccacaattactgctgagatccagggggtgattgatgcctgtgtcaagctgactggcatgccagaccttacactttccttcatggtaaaatcctgggccagagattaagttcttgggatgagaaattaaatgctgctggaaagacagagtagtggsaatggaatagaacaagaagaaataattaggacagccacgaagcttgtctcaggcttgaattttctagaagtcactacatgatttctgtgtgtgtgtgtgtggtgtgttttaattaaaaacagcatttaaattgctttcctgaaagcactgcgggtgtttaatgcccacttcttgcttctcctctcctgatgactgtagaaccctaggttgttggatgatgtcagcttccatccttgtgttcgtttcaaacgctgggaatctgagcgcatcctctccttcatccctcctgatggaaacttccgcctgctgtctyaccatgtcagtgcacagaagtaagcagctcttataattaagaatggaatccgtgtatgtacatgtatgtggaaaccgtatctgtggtgattaagaactcaggctctagagttacctgggttcacattccagcttctgtggttactaattgggtaacctcaggtgagttgcttaacccctatgtatctcttttctcatctgtaaattgaaaataataaaagtgccttgttctgaagattgaataagagaatctgaatagtgcttaacacaaagaagtgctcattaagtttgctgttatttttgttgttatgtgtctaaacaagaacattattttctcaaatcagaatctgggcatactgtgttcaatgtccctggtctaaaagaagcattaagttatgctatgaaaaagcataaaacgcagtgatttttggtcttgaacattctctttaatttggaatctaaaggcytttggaagcagttttgtatagtataaggtatgcagacagaagagagtcaggaggcctcagagccaccagtcccttcccgtgtgatgtggaatgaatcatttgggaaaatatctgagtgcttgaggtcaaagcctctggaatcagactccctggacttaaaccycatcttcagtacttagaaccttgggcaagttacttaatctcagttaagtataaggacatcagtattcatctataaaatcagtacctactacatagttacagtagcagtatctacttcatacttattgggaggattaaacacggtaggagttaaatggatagaaaccatttagcatagtgactggcaaacaggaagtactcaatacatgttaggaactgttattacttcagggttattccgtgacttctctgaatccttttcttctgtcaaatcatgacagcctaccctaccttatggggtttttgtaaggaccagatgatgtcagatgaaagcattytaaaaaaattatagagacaagaggatcacttgagcccaggagttcgagaccagcatgggcaacatggccaaaccttgtctctacaaaaaaaaaaaaaaaaaaaaaaaaaaaaaaagtaaaaattagcggggtgtgatgttgtgtgcctgtggtcccagctactcaggaggcagtggtgggaggatcacttgagcctggtatgtcgaggctgcagtgagctatgatcgtgccactgcactcyaaccaggctgaccgagccagaccctatctcaaaaaaaaaagaaagaaattataaaaggtccatgagctatgaatattatactccccagtgcaaatgatgactggtcacatgttacaagttaaaaacatggagacataatgacaatacrtttttgtacattatgcctttgtcatagtagtgtactttttgattttgtttrtattattcagagtcattagaaaagttaatttagttactagacagtagcttttcaaaaagaaaaaattagattactggggtttttttctgtttattttttcagataaaaagtaaggacatagttaagggagaagaagctacccacagggcagaaaaagcatcatgtgaaaggaagaactaccattttcccagtgcacgaatgaaatgactctttgtctctcatttccagtctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaaggtagggatgagcaggacatcttgaattgctgatgttaagcagaaaccagtctgcaggttctctgtgtagactctagaccttgtttggaaggtgagatgagtcaaagggaccttgttttctcctgccaggtaacttaacagtaacacgtaggattctcaatggaaagatacccagaggcagcttataatgttgtggacaggtgccctgagtttagatctcagccacctcaaatgcaggattctgctgtaactattttttggaaagaccacttctccatttttattttctttgaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggtaagtgacccagagctcaagaggctccaaagggaacaaaaacggctttctgccatatggcgcaggcaccaggaagcctttctgggcttcctgtttacaaggtttagtttcattacctgataaacaatctttagtaacatcttttctggcatgtttctggggaaaatttacaatccttcctttgaagttggcataagtgacctgaataaaagtgcctaagacacactgagaaagaaacagtattggtagaaggaagtattcactagccatttttggatcatcttagggttgttcatttcaggttcccaaggttttcagtatgagaatccatgtgcattctcagctataactgaagtgtaatttccactcctttcttctgttttcagaagactttcatgtttgctcttatttctattttggaaccactgggcctttccaggtcagttcactatagtctgtgccgaccttagcacggtagtcatcagttaccactttgggggcatttaccaygttccaggcactgttttaagctcttttcatgtgttttcttttttaatccttagaaactctgtgatgtggaaaggagatgactttagctttatatgaagtttctgtttttctgtacaaacgggccttatacaatttaagtgattggaattcatttgatgtataagctcttcaatcttaaaacaataaactataaagctctataccatataaaatattcttggcttagtctagtgagaatacttaggaagcattcatttattaattactttcattgttaattcctttatttataatttacttcattattcatttgttttgttattcattttttcagtccaataatttgagaaaaatcatgcagtggtctaattttttccttatcctcattttagtctgcacattactttgtaccctttccacttcagggacaggtcttctcataggtagcttgtctgttggagcctttttttgctgtcagtatctgtcccaagactggagaatccatctgctctgcataagtggttccctgtcacagcaatgtcggtcccactgacytcagtgtattgaacagaaacagttaggcgacctgctccttttgaataatactcatgtctattttccctctctccctcctttctaggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccaccygctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtyagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgwgttggtttctttctgattcctctactcatgtagaaaacacttgtacttctggaaatggactggagactttttaaatttgagtccactattgacatggaaaccccagtggaatcagattttccctcraagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtytgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcrccctagaaaaagagaaagcttaccatcgagggtgtggttgatccttgaagctgcttggtaaagttatcatttcctcagtcttttcttttgtactcctatcatgtattcattaatatctaycagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccrtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttattkcctctagaactcatcctgtttcaagggaagtacctaagaagatatagagtgtttctagggtaagggacctgcaggtgtaagcatagatgaaataactgtccwgtcacaygtgcagcaggccatggagtgtagcgggcatcrctgccgccattcctgcagcatcaccataagcagtgcagggtgtctccatcgagctgtttggttccatgtgtgtttaacatgtgcagaagtagcttctctgtttaagtttaataaagttgagtttcaccagtcttctatgtcctaagtggtttgttaccagaactaacaacagtgctatgccactcaaacctcagtagaagcagtgagtaaggaattcatcgactcaggaggatcttactgcttctgtcctgtctagccagcagacctaaagcatgtgttttgatcgattctttggtcacatctggaagatagcagatgctgatattaatgtcatttttagggttgtgagcataaggtccagatccacctagttatttttcaccagagttttaaaagacgaaatcgttgaagctgccggcatttagtctagggctttcygcattctcttgacctgcttctcttgtcttgttaatttaggcatgaaacggtgtcgcagtactctggcgtctttattccaggagaggcttcttacaagataaggcactgcgagtcgattgttacgccacacctgtaacaattttctataaacatctcatggccatcaaaaaaccttaaaactcaatgcgtactcactgtgagtgttcagtgccagctagtgctccaccccttctccctctcagccggcgtcaactgtctcttcgcctgtgctcccgggtgctctgaccctggtggtgggacaggaagttggttgtatacatgtacttttctctgtggccggtaggtggggactccatgccatcaatactcattattttaatggttagatttttttttttttttttttttgggggacgtagtcttgcactgttgcccgggctggtgtgcagtggcgggatcttggctcactgcaatctccgcctcctggattcaagcgattctcctgcctcagactcccgagtaactaggattacagggcgcccaccaccatgcccagctaattttttttttttttttttttgkatttttagtggagacagggtttcactatgttggccaggctcgtcttgagatctgcctgcctcggcctcccaaagtgctgggattacaggcatgagccattgcgcctggccaactgttagaatttttttttttttttgaggcggagtctcactctgtcgcccaggctggagtgcagtggtgcgatttcggctcactgcaagctctgcctcctgggttcacgccattctcctgcctcagcctcagagtaggtgggactacaggagcccaccaccgtgccccgctaatttttttttttttttttttttttttttagtagaaatggggtttcactgtgttagccaggatggtctcgatctcctgacctcgtgatccacccgccttggcctcccaaagtgctgggattacaggcgtgagccgtcgcgcctggccctgttaaaatttttaaaaggaaatttgaccagcctggccaacatggcaaaacccatctctactgaaaaatataaaaattagctgggcctggtggcgggcacctgtaatcccagctactggggaggctgaggcaggagaatcgcttgaacccgggaggcggaggttgcagtgagctgagatcgcaccactgcactccagcctgggcaaaaagagtgagactccatctcaaaataaaataaaataaaaggaaatttaatttcaaactctgaaacttcctccaagatcctaagtactgaggattgcatgagtctttggcttttgaagttaagtggagtgaaaagtttatgcactttctgataaacagacatgactggggctctgggagggtacagtgtcaccatcccagagttcctctaggttttcacccagtaagaagagttgcacaggtacctggagatcttgttctcctggactgttaccatctgcttgttttattaactagctgggaataatgaggagatgatatttaatttcccctgacacccattcccggtaatgatgtgttgctctttgagcgtgttttagaatttgcatcactgggctggggccccgtctctcagtcaggggcctcttctgagcaattgtctctatctagtctgtggttccaagactgcgtgggaggaatgctggggcctttttacctcccatttccatccccaggggcctcactgcctcagttcatttcattaatcctgaagaagagcttgtcctgcaaagggggaggggatgaaaccagctgaatttctgccggarattcagtggctgggggttccttcgcactggtcctcagtgtttttttttttttctttctttctttctttttttttcttgacarartcttgctctgttgcccagggtggartacagtgacacaatttcagctcactgcaacctctgcctcccaggctcaagcgattctcctgcctcaktgttccaagtagctggagccacaggcgtgcaccaccacacccagctaacttttgtattttagtagagatggggttttgccacgttggccaggctggtctcaaactcctagcctcaagtgatccacccacgtcagcctcctaaagtgctgggattataggcatgagccaccgttcctggcctcaaacaatgtttttcttaaatggctgagacacacatcygtctaaaaactgtagaacatgcaagtgagcagtctgaagtcaagaaatctgtgacttaagtctctgtgacctgcatttatttactggcctaggtacttcaacacttcagggatgtcccccgctgcctcccycaccccagtcaagctcttgggagttaaagaatctctttcttttgtgagtttaaacgacttttgttccaagaacctctaaactgagcagttctgacarctccaccagagagacgaccacctttctcctctctgaggagctgtgtcagcatatccccaacagcagcattgcagcatccgatttattcttggaactaggatgtcagtgagaacaaaagctgccaracagcagccaggaataggggttgcatctcgcgagtagaaagtartctaagagggctgggtgcagtggctcacgcctgtaatcccagcaccttgggaggccraggcaggcggatcacgaggtcaggagatcgagaccatcctggctaacacggtgaaaccccgtctctactacaaatatgaaaaattagccgggcatggtggcgggcacctatagtcccagctactcgggagactgaggcaggagaatggcgtgaacccaggaggcagascttgcagatagcgccactgcacttcagcctgggcraaagagcgagactctgtctcaaaaaaaaaaaaaaaaagtagtctaagagaagcagaatgcaacattacttagataacgtacttgtgtggactggtttaggggttcratttctaatgagcagaaaattaagacaatgggaracagatggcccaaataccagcttctaggccgaaccaacggttgggatgttgctgtgttagcaaggtcatgcgaggttcttcctccctatccccacagcgttcctytcctgctgtctgcttgcttgccagccaccccctggttaattttcctaaggcatgcccagttcctcacttccctgagcagaatctccatggctcctcgttgcctacagaagtcaattaagtccaaactcagtttggtgttcagagcccccataatctaaattccagcctatgttcctcttcctgaagttcacttcagacaagctcaackcatttctccctgtactcccctctcttggccctctacataytcatacctccatggagagtgccttttccacacctgtccacagtccacgtctcacccagttattttttccttaagattctattttttccttaagattccccaatccctcttgcaactgaattctactacaagtctgcccttttgtgaccggctccactgtaccttggtacttctctaaatgccatattagcccatcagaccaagcattcctgtccctccttttcccggtctggagcacytagcccattgccttgtatgttacaggtgttgtgtatatgttaagcgagtgaagcagaattccaaatgattttaaaatgtgaacatgaataaagagtgggatacagcatctataacaaaaccattccactctgattttggaaaaactgtgaaaaatatatctgaatttattaagtacagtataaaacagggttgtggcaacagaaagtaaaaactaacatggattgctataaatatgctkaagcctagttgttcaaatgatacaattctctcatgctactctaaagtttataaagaaaaaggatttacactttacacactgtacacaaaaggaataccttctgagagccrgggagtggggaaaggggaaggagacttgacgtcaagggtgcttttgaggaacatgacgggccrgccagcctgccccaactttgaggccctgctgggctcttgtgactataaatatactgtctrtttctaatgcaatccgtctttcctgaaagatcttgttatcttttactattgagacatgctttcatttttgtggtcctgtttccaaagctgctcacggtgacaggtcaggaggttgggctttagctgaaaacagggtggcatggccactttctgcccagggaggaggcattcctggagaggctagtgtgcattcatgtcttcccatctgacagagtatcctgaaatcagaccaagtcctgaaaacttccaaaatgggaagtatctgggaaaatgcactcttccctctcctgtagggtctcgtcccgcttctgcggtgtggtgggtctggagaagtctgtagagaagcactscgcctttgcagtgtcttctgaagaagaagaggcgggatctcatttgcttttgaggagtcgggtgttcctggtcacggtcrcatgttgtcaygaatccagtctaggtagttggtaaccttggtgtacacacccgggacatccttctgtccacagcccaggccccagctgatgatgcccaccaaagtcatgcggccatcgttcagacacaccagggggcctccygaatcgccctgcaaaggagatagcaggtttggcgtttgcaaaaaaagcagactatctggagaaagtcagtatgtgtagcatgaacatcgtaatcttcaaaatacagcaggcccttcaataatattccattcagtgtcatttcattataactttgatgaggaaaacaaaaatcarttcctgtctggggacactgtctgcctgggttttgtccaggtaccccggtttccttccacatcccaaagcttgcacatyaagccaactgaggatgtatctacgtgggcccagtctgagtgagtgtgggtgttagtggctctgcaataggatggtggcgtctgtccagggctggtccygcctggcgccctgagctgccaggtggctctggccacccccacccaagaccctgaaccggaataagcasgttggaaaatgaatgaatacaaagtgttataaagtaaaaatctgtctagtctgtgmtaaatacacgaatgcatgataaactgtgagstgtggaggcagtcagggagcctgccctatttgtgattgtttttgaacttcatggtagtaagaggtgttccttaccattyytgcyttgcaaacatttattccctgaattaaccyaccactattatggccgccatcatycacttattctccaaaaattgggtaaataaataccatgtttgtttttattaacctttcttaaatgttgtatagctcacatttatttcaatattgaatgttagaagtgttttgggtctttatttagaagtttgctgatgtttttatgactagaaatattgccacaagaacttcactcttcttttttkgtttttttttgtttttttgttttgagacagagtctcactctgtcacccacccaggctrgagtgcagtggcgcaatctcagctcactgcaccctccacctccggggttcaagcaattctcgtgcttatgggcacgcaccaccacacctggctaatttttgtgtttttartagaggcagggtttcaccatggtggccaggctggtctcgaactcctgayctcaggtgatctgccttcctcagcctctcaaagtgctgggattacaggcatgagccccgcacctgaccaactcttgtttatatcaattagctgrtggtaaaattggttttgttatacgtcatttcacttacagttgcagtttctaagaacctattttttccaggcatgctgttaagtggagacttactgaagagtgggtagattgtatctcagttatcttggtcccatggaggattaggctgtatctattctggtamagtagagttaattactcmaacgtttcaggcctcaaaaaccctggcttggctccatcacttactagctgatggccttagactaaccatgctttggttttcttatctgtaccatagagataatattcatactacccatagagtggttatggcattcagtagaagaatgcatgaaaagcactggaagacatctagtaaaactcttggtaattgttagctgttcttatattgaatt

SEQ ID NO: 13423 - DNA, 14819 bp, Homo sapiens
ggggagaccaaaaatgctacagacatggctccggcagattatttttgccaccatcgaagtgctgaaaccacactgttaaggagaaaatcttaaaagcagccagagaacaaagatctcctccccacagacaagccaggtgagaggsgcagcctaagccctgaaaaaccacacaggaagaggcagcggcagaggccccaccccagccggtgctgctcccctctcctcttcatcaggactgtccccgctccctccacccagtgctgagaccaacagcagacatgggggcgagggtgtgatgcacttaacatgacctaagccacacaaatatattaccaacaaactccaatgacttaactttgagattctcttcatctaagtttttaaagtggtcattcctagtttctctcattcctaccagtgctctggacagacttgcctgtggccaggtgcacacacgttccccctctgagctgcacacactttccctctctgagctttggtcctctcctctgtaaaatgtgatgattcacatcccctcctggccacaggcgagtgtctgaggtgccgagtgcaccctgctcttccctacaaagcagaccctttctcctttccccattatcacagatacctgcctgggaatccggaagaggcccttcccagtccaacaggcagctgctattatcaagcaggccaggtcccaaatgctggggacttcctcctcctaaatctcattttctccccagacaaaatgagagcaacaatccccacatccctgggttaggaaaataccctgaatgaagatgtgcagtctctggctgggctggcccaatctctatgccaggtccttccacctcacctctctctttagcaaagtagaaattgagaaattctgaaggctctgaagcttagacactcaggctatcaaagagcccagagattggaggctgaagactgccagggttggccgtgctcctcttcagctgtgactctgctgtggccccagctccttcctataaactaggcagatataaaatctgcagcggccctttataaaccacagtggtctgtgttggcagatgtgtgctgccgtgtaggaggacaaatcacatgctcagggctggtgtcagtcactcatgactctggatccccagggcacctgtcctaatgaacttgaaagagaactgaaggcactggcatttttccagactaagtgacaccaactgcccaacagcacaggctcagggcatggcactgtccccatctccgacctggaagctaaagccttgctgccctgtcactcctggatacaggacagaggaccagaactgggactgttgcctctcagtaggggctgggtgagcagccatctgcagccacatggatggagacctttcctgctcactcttcaaactgcaaccagtgccgggtgcccaccagaaggacaactggaaggaaacgtggcaggtaagccaggctgtggccctgcagtgacatctttgtcctaacttgaagtctggctcctctgttcctccacggcccctccccatggcgctccaccccattccttagaaccttctgccccaagctcagagagccagtatggaggtgcaggtgggagcaggtgcagcctctgctgggtagaggacaggtgctctggggatccagagtcctgagtgactgacaccagccctgagcatgtgatttgtcctcccacacgacagcacacatctgccaacacagaccactgtggtttacacagggccgctgcagacttttatatccacctagtttataggaaggagctggggccacagcagagtcacagagctgaagaggagcacggccaaccctggctgtcttcagcctccaatctctgggctctgatagcctgagtgtctaagcttcagagccatcagaatttctcatttcctactttgataaagagagagacgagacgaggtggaaggacctggcacagagattgggccagtccagcattgacagagccaggacctggggtgagaaactgagctcagctccaggctcatctgatgtcatcctgacagtctgaggacagagacattatctccattcacaggcatggcgggtggcaggaactggccccagccgaccacagtttcctaagtgcagaggtgcgactgcagtcttccctgctccctccccarcggtctaatctggagtctctaggtcatctactcccagtctcaaaaaattcctggatccttgaaaatctctaataacactgaaacaaaaaatacaacattgaggtctatcattttttacctcttagagtagcaaagaatgaaagttccatgtagtaagggtgcagggacacgggcacgcttgtgtattcttttttttttttcttgaaacggagtctcgctcagtcgcccaggctggagtgcagtggcgagatctcggctcactgcaagctctgcctcccgggttcacgccattctcctgcctcagcctcccgagtagctgggactacaggcgcccgccaccgtgcctggctaatttttttcaatttttagtagagacggggtttcaccgtgttagccaggatggtctggatctcctgacctcgtgatccacctgtctcggcctcccaaagtgctgggattacaggcgttagccaccgcacccggccacacttttgtattcttggtgtgagagtaaaactggcacaatcttctcccgaagtacaatttagcaatatccaaacaaaattctacattgatgagctcatgtaccyaaaaattcctcttctaaagggctgcccgatacttcagggaacattgacatatggacatatgacacatacaagggttctcactacaatgctgctggaattagaaaaaacaaaagcaggacataatgttaacaattgcccatgggatggaagattaaaattaactgtggttcacgccatgtgtttcacccatgcactaaatattatgatgctgttaaaaagaatgagatacttgcatgtactgatagaaaacatccaatgcgatttgttcttcagtcagaattttaaaagttaaggtgcctataaatgcacaggaagaaggctgagggatggtgggatgagarggtcctgtgggatggcagaaggccttggtgtctgctacgggtcctttgtccctgccagggctcacgttgaaatctgaaccgtaatgtagctggtggggcctgttggggtttggggtggatccctcatgaaaggcttggtgccataaccgccccctcccacattcccccaggagttgtcaatcttagttccccatgacacctggttgttagaatgaacctggcccctccccgtstcccttccggatctcatccccctcctcctgccatcctccccaccccttcccctgatgggcagaatccagctgtccttccccttcaccaccagtggaagtttcctgaggcctcaccagaggcagatgctggtggcatgcttcttgtacagcctgcagaaccatgtgccaaataagcctcttttaaaattatccagcgtcaagttttcttttttattttttttcttttccgaaacggagtctccctctgtcgcccaggctggagtgcagtggcgtggtctcggctcactggaagctccgcctcccaggttcacgccattctcccgcctcagcctcccgagtagctgggactacaggcggccaccaccacgcctggctaattttttgtatttttaatagagacggggtttcaccgtgttggccaggatcgtctcgatctcctgacctcgtgatccgcccgcctcggcctcccagagtgctgggattacaggcgtgagccaccgcgcctggcctcaagtattcttttatagccacaccaacggactgtgacatttccaaaaccaccaaattcagatgtttcaccttgtctatacaggtgagccctacatccacctggaatcgcactagcctgtcaaaaagaaagccatttaataagcgtattaaaaataagagtcaaacgtgggttccacctaacataaactgacgtttaaaacataaattctgtaattatttggagatttcaaaatgctattggattcctggattttgtttagtttgttaaacaaaaacacgtaaaatttcctgacacttgtaagactggtttatccttcaggtacttagctttcgttttgtttttccttaacatagaaggaatctggatgagaacaattggtagagccttaatgaacttgaaagagaactgaaggcattggcatttttccagactgagtgattgctttcacaggaaacgctgcctcctgaaggaagggcgtgccccgctcctggctgcctgcctcgtggtggtcaattcgctgccctgtacctgttgatgcgcaagaaagtggctggaaggaaactgctgccggtgtgctcagtggactcgaaacggaagacaacgagcagaggagagaaagttactttttcctgccgggctgcgtgtttaaccaatttgtctaagaaaagaaggatggagggccgggcgcggtggctcmcrcctgtaatcccagcactttgggaggccgaggcgggcggatttggctaacacagtgwaaccccgtgwstactaaaaatacaaaaaattagccgggcgtggtggcaggagcctgtactcccagctactcgggaggctgaggcaggagaatcgcttgaaccaggaaggcggagcttgcagtgagccgagatcgcgccactacactccagcctgggcgacagagagagactccgtttcaaaaaaaaaaaaagaagagaagaaaagaaggacgggggtggggagggaatcagggagtggggagaatggcgctccccttcacgcagctggtgtggctgggagttggcttggaagtttacacacttgagctctatcgattccgaaacttcccgatacatcgtgaggtgtgggcaggagggagacgcgccaggcagcagccaacggggtggagtccccgggcccagcctcctgcgggagggggctctgctgcctccaggcccgggtcgctcctgcctggccccggggaccccgttcttcctccgactccgacgacgggctcctcctgcccggacatgccccgccacaagtgacccgggccaggcacccccgccgcgtccccctctctctctgccccctcccggtgccaggcgcgcttttccccaggcaggaccgcggtggggactcacctgcagcaggaccccgacgacgacaaacttgaaggtcttgtggacccggagccgagggctggcttcccgcgccggcctgggtcctggggcgcgccctgcccgggcccgggcactgggtccgtgctgtcccatggaggtagggagcgctcctcggcccccgcctcgtggttcaatcctccccgcggaagagccccacactttgctgggtrtggccgcggctgcctctgtcccactcgctgcgctcccgggattcggagtcactgccaggaacgcacctagatgtactctagctggtggtggcgccatcctgccaggtcaatccaagaagcagcgtgcttggctrtgacaagacagaacttcgcattcggagttcagggcacccctgaccccgcccccttttcggggcacctgcggctcctgttggctaaccctgaacttccttcctctgtgaccgcccttgccgctctcagcttctgttcctcaaccacggccgccgcgtggatgccgctgcattcggagtcgttttgccacttggtcccagcgccaggcttctcggtcgggagttgacctcagcctttctgtgacccagttcctggcacccagcaggcgctcggtggacggatgggtggcggaatgaaggacacagaggccactgcggggtctggcctctaagaggcttttacggcctcctccgtcactacckggcgagtgattcagcctgcctttttttttttttttttttttttttttttttttgwgatggagtcaagctctgtcgcccaggctggagtgcagtggcacgatctcggctcactgcaacctccgcctcccaggttcaagcgattttcctgcctcagcctcctgagtaactgggattacaggkgcccgccaccacgtccggctaattttttttctatttttagtagagamgggggtttcactgttttggccaggctggtctcgagctcctgatctcgtgatccgcccgcttcggccttmcaaagtgctgggattacaagcgtgagccaccgtgcccggctcatcctgcttttggtttcaggtctccatgccagtgaaatgtcacctcaactccaccgtccctggtgtcaggcaagcccgagggacccaattctgcctttcttctggattttcctaacctgttaagagtcttgaaagtccttaaaccacgggagactatctggcacatgacacgggatgagacttggtgggggtcccacgggggacaggtccttccagcggttcctctgcacccagcgctgcacgggcayggggcgtgggtaatcagcctcccgaaagccacgcgagtcacggtcctgcctgcgaagaactcccagggcgaccttggggctgaggagtgggtaagagaaagggggcgctgattgatgttcatttttctccatattttaatggtgttccggtaccatttgttgaaaagactcttttcgaccgggcgcggtggctcacgcctgtaatcccagcactttgggaggccgaggcgggcggatcacctgaggtcaggagttcgagaccagcctgaccgacatggagaaacgcagcmtctactaaaaatacaaaattagcggggcgtggtggcggatgcctgtaatcccagccactcgggagactgaggcaggagaatcgcttgaacccgggaggcagaggctgcggggagccgagatggagccattgcgctccagcctgggccacaagagggaaactccgtctcaaaaaaaaaaaaaaaaaagactttttttccttatccaatagccttatcacttttgttgaaattaaattgaccatatatatgtatgtgtccatttccggactctattctgttccgtttatttatttggctattctcatgctaattaccacattgtcctaattatgagctgtatagtcagtcttgaaatcaggcagttcaagtcctccccctactacccacctcccaaatggtttgcatttccgtatatattaaatatagaataatttttttcagttaaaaaagcctactggaattttaattgggattgcattgaatgtagagatgaatgagaataattgacattttaacaattttgagtctttcaatccatgaaatttatttatttagatatttgttacttaagcttgacaatattttgcaaactttccatgtacaaatctttcatatcttttgtaaacatatttctaactatttttgttactattgctaatggaattgatttagcttcccttattttcaaattgtttgttgcaactatacagaaatacagttgatttttgtccatcggccttgtatgctatggtactgctaaattgatatatttctagttgttattttatagattatttaggattttctatgtaagcaatcctattgtcagtaaccaaaaactgtctcagttcttcctttccaatctttataccttctattcatctttgttgctgaattgccctggataggatttccagtacaatgttaaatagaaatagttaaagcagacatgcttatcttattccatatcttagaacacatctaattaatcaccattagatatgatgttagttatagtttcctcatagatgcctgctgtagtttgaatgtcctctccaaaactcatgttgaattttttttttttttttttttttgagacagagtctcactctttcgcccaggctggagtgcagtggcctgatctcggctcattgcaacctccacctcctgggttcaagcaattcttctgccccagcctccccagtagctgggactacaggcacatgctgccgtgcctggctaatttttgtattttcagtagaaacggggtttcaccgtgttgcccaggctggtcacaaactcctgagctcaggcaacctgcctgccttggcgtcccaaggtgctgggattataggcttgagacaccatgcccgccaatttttttttttttagatgagtctcgctgtgttgcccaagctagactgcagtggygcgatctcggctcactgcaacctctgtctctgggttcaagcgattttcctgcctcagcctccccagtagctgtcagtacaggcacgcaccaccaccacacccagctaatttttgtatttgtagtagagacgggatttcaccatgttgaccagggaggtggggcctttaagaggtgatttagcttatgagggctccatcttcatgaatggattaacgctattgtctcaggactgggttaattttcatgtgagtgggttcctgataaaaaataatgagtttggcatgatttcctccctctctctcacctaggcctgcttcggccttctgctcttctgttgtgtggtgaccctcaccagaggacagcttcatgctcttggacttcccagcctcaagaactgtaagaaataaatttctttataagttgcccagtctgtggtatttggttatagcagcaggaaatggagtgagacaatgccctttaccagatcaaattccctttcatttctactttgctgtttttaccattaatagaatgtgaaatataacaataaacaataacgtttgacacwttgaaacgtatcaaatgttattttttggcrtctattgagatgattatattgtttttctcttttatgctattcaaatgtttaatcaaattgactttcaaatgttgcatctaacttgaattcctgggtcaaatttcacttgtcatgatgtattatcttttttacatattgctaggtttgatttgctaatactttcttaagcatatttttgtgtctgtattcatgagagatattgatttatcattgtcttwttctgtaatgtctttctaagtttgggtatactcattattctggctttataaaataaactcagtttcctgagagtcttataagattagcattatttcttctttcaatgtttgataccattcaccagtaacaccatctggacttggtgataatttttgttgtttttcttttggggtatgtatgtgtctgaaggtttttgataataaattcaaatcctataatagatatgagtttttcagattttctattattttatatgtctcttttggcaagtaaaaattttcaagtcatttgtctcttttatctgagttcttaaatatattggcataaagttgctcacaatattcccttattatccttagcaatcatagtgatgtcctctcttttattttgataacttagttttgtctctctctctttgatgagtttcgctaatgatttattattcttttcaaatagccataatgtctrtgttaactttattactttcagggtttttctgttttctattctatagattttctctcattattgcctttcttatacttattctgggtttatattgctctttttttttttctagtttttttgagacagagtctcactctgtcgcccaggctggagtgcagtggcgtgatcttggctcactgcaacctctgcctcccaggttcaagcgattctcctgcctcagcctcccgagtagctaggactacaggcgcctgccaccacgcctggctaattttttttttttttttggtatttttagtagagacagggtttcaccacgttagccaagatggtctcaatctcccgaccttatgatccgcccgcctcagcctcccaaagtgctgggattacaggagtgagccattgttcccagcctgctcttctttctttagcttttaagtggaaacctagatcattgatttctatccttttttgtttactaatacgagcactcatactctctatgtccttctgtagttatgtcctacaaattttgatattttgcatcatcatttagtttgaaatattttctgatttctacaggctttctcctctgacccatggtggtttaaactgcaaatatgaaagtcttttttgtatttcttattgacttctaattcaatttcactgcaactaaagaaagtgttctgtatgatttcaatccttttaaatttattaagactcttcgtaggcccagaatagggtctaccttagtaaacatactatgtgcactcaaaaagaatgaacattctacagttgttgggtatagtattctatgaatgtttattaggtcaaggtggttgataattttttcagattgtctgtgacttcattgatttttctttttttgtttttttgacagtcttgctctgttgcccaggctagaatgcagaggcaccatcttggctcactgcaacctccgcctaccgggttcaaatgattctcctgcctcagcctcccgagtagctgggattacaggcacctgccaccatgcccagctaatttttgtattttcagcagagatgaggttttaccatgttgaccaggctggtcttgaactcctgacctcaagtgatccgccaacctcggcctcccaaagtgctgagattacaggcatgagccaccatgcccggcctccatcttttactttcaatctatctgaagctttatatttaaggtgcatatattttagacagttaataatttcagcttgcttttttttttcctagttggggaaactctgctttttaattggattgtttattctggttacatttgttgttgtggtgaaatttggaaagttcaacctgccacaacgtcttcacttactatttttaaaggatattctcaatgagtgtgaatagtgagtcaacagctttctttcaccatttcacacatcctgagcctccattgttttgagtcagctgtcgttcatatctttgttacctgtgaatgcacaaaatttgctctgtatgatgactatgatgtgtccaggtagggttttctttacatttatttttatgaggggtttatgaactttttgaatctataagttgatgttttttcactacatttkagactatatcaactttttttttctttcatcttttccagccatttcttcttggttctggttccgtgtgtacygcatgatattgtaccacgtgtcacggagactcgcttccttgttttctttcagtttcattttcccttgcacttcagatggaatgatatctattgatctcttttcaagttcactcattctttcttctgtaatgttcaatctctcttaagaaagtccaaataaatttttcatttcagagagtggaattttcggttctaaaatgtccatttggttcttgtttatagttatcatatgtatgctgaaatagcttatcttccactcatgtcaacaatcttttctgtagacccaacatatattttgtagctccttaaaagagattctattatgaatcagcattaaaaaccactgtgaagacagaaactctacctagaagaatgaggtttttatggtttggcttttgttttttgggatagcgtctcactctgtcacccaggctggagtgcagtggtgcaatcatgactcattgaagcctcgacctgctgtgctcsagagatcctcccacctcagcctcctgagtagctgggactacagtcatgggcccccaagcccagctaatttttgtactttttctagggacaaagttttgctgtgttgcccaggctggtcttgagttcttgagctcaagtgatcagcctgcctcaaccttcagaattactgggattacagacgtgagccattgtgcccggccaggagtgagttatctaatgaagagtaacaataacagaaaatgtttatgagctsctgcatacaataatttcacaagtatttatcgaaaattgattacataccaggcaaaatgtatgcaaagattaaaatctgcagtacctgatctaggggacttgcacactagtagggagacagtaaaacaactgtaataaaatgtgatttggcagagcctattaaaaatgattctatcagcygggcgcggtggctcacgcctgtgatcccagcactttgggaggccgaggcaggcagatcacaacgtcaggagatcgggaccatcctggctaacacggtgaaaccctgtctctactaaaaatacaaaaaaattagccgggcatggtggcgggtgcctgtagtcccagctactcgggaggctgaggcaggagaatggcatgaaaccggcaggtggagcttgcagtgagccgagattgcaccactgcactccagcctgggtgacagagcgagactccgtctcaaaaaaaagaaaaaaataataattctatccccaagaacctgtatttttagtttggggaataaaatgcttaggataattaggagaaagaaggtaggaggggagaagagagtggaagaaagtgaaatggggaatgtctcagaccttatttacaaagaaatcttaaagaaaatccaaagacaatagggaagacaaaaaaggaaaaaaaaaaaaaaaaaagacaacagaggaaattttagcctatgacggccgggcacggtggctcccacctgtaatcccagcactttgggaggccaaggcgggcggatcacgaggtcagcagtttgagaccagcctgaccaacatgctgaaaccccgtctctactaaaaatacaaaaaaaaaaaaaaaattggccggacatggtggcgcatgcctgtaatcccagctactcaggaggctgaggcgggagaactgcttgaacccaggaagtggaagttgcagtgagcagagatcgagccactgcactccagcctgagygacagagggatactccgtctcaaaaaaagaaaggaaaagaaaaagaaattttagtctatgacaacaatagctacagcacacagtaaacactccgtaactcctagtcagaaataaaacctcctactaaaagttctgtttcactaaattccttttatccaatccatcatgttcataatacaggaaataaacagaattgaaggcagaaatttgcactactataataatagttggagacttcaattgtcccactttcaaaaacagaaccatcagaatgaagatcaataaggatgtagcgtacttggacatcactatatactaatggaaactaaaagacatagaaaacagttcaccacaaacagaagcatacaatttttctcaaagatacatggaatattctccaggataaaccataagttagaccacagagtaattctttataaatttaaaataactgaaagtatctcttctgatcacaatatgacactagaaatcagtatcagaaggaaaagagtaaactcctcaaacatgtagaaatcaacaagcttttaaataaccaacgagtcaaagaggaactcatacaagaaattagaaaagatctggagataagtgaagcaaaaaacacaacatactaaaacttatgggatgcagtaaaagcagtgctaagaggaaatgttatcatggtaaatgcttatatcaaaaaggaaaaaagacctaaaataaacaatctacacattaagaaactaggaaaggaagaataaactaaatccaaggtagcggaaagaaggaaataaaaaaaaatagaggagagattattttaaaaagagaataggaaaacagtaaagaaaatcaataagcccaaaagttgattctttgaaaagattaacaaaatggagaaatctttggcttgatttattaaaaaataagaatcctcaaattactaaaatcagaaatgaaartgggacattattgctgattctacaggaataaaaagggttagaagagagtactatgaaaaaatgtatgccaaaaaaacacatttatctagctaaaatgaacaaattcctagaaacacacaacctaccaagactgatttataatgaaatagaaaattggaacagacataactggaaggagattgaatcaacaatcaaaaacttccctggaccagatttgtgtccagccaaatatttaaagaaaaatcggctgggcacggtggctcatgcctgtaatcccagcactttaagaggccgaggtgggcagatcacaaggtcaagagatccagacatcctggccaacatggtgaaaccccgtctctaccaaaaatacaaaaattagccggtcgtggtggtgcacgcctatagtcccagcaactcgggaggatgaggcaggagaatcgcttgaacccaggaggcggaggttgcagtgagccgagattgcgccactgcactccagcctggcgacaagagartgactccgtctcaaaaaaaaaagaaaaagagaaaaatcaaccccaagttttctcaaagatgtgaaaaggagggaacccttcctaactgattctatgaggccagaattgtccttacactaaagtcaggcaaagatactacaagaaagaaaactacagaccaatatcccttataaattttgctgcaaaaatcttcaacaaaataataacaaactgaaactaacatttacagatttttattatttatttatttatttattaaagacagtcttgctctgtcascacgctggagtgcagtggtgtgatcatagctcactgcagccttgaactcctgggctcaagttatccccttccctcagcctcccaagtcactgggactttagctgcctgtcaccacgcccagctaatttcttggttttttttgt

SEQ ID NO: 13424 - DNA, 16964 bp, Homo sapiens
aagcttacaccctaaagaagacacacatatggaaatgcgtagtttcaagccagtcaggtgctctataacaggataattttgaaagtgctatggaaatcytcagaaaaaaacaagtaaataaataaataataakaagaaaacctctacagaatcctggaaagactttccagagaagctggctttaaaagctgggcaggccaaggtaatttatagattcaatgccatccccatcaagctaccaatgactttcttcacagaattggaaaaaactactttaaagttcatatggaaccaaaaaagagcccacattgccaagacaatcctaagcaaaaagaacaaagctggaggcatcacattacctgacttcaaactacactacaaggcttcagtaaccaaaacagcatggtactggtaccaaaacagagatatagaccaatggagcagaacagaggcctcagaaataataccacacatctacaaccatctgatctttgacaaaccggacaaaaacaagaaatggagaayggattccctatttaataaatggtgctgggaaaactggcatatgtagaaagctgaaactggatcccttccttacaccttatacaaaaattaattcaagatggattgaagacttaaatgttagacctaaaaccataaaaaccctagaagaaaacctaggcaataccattcaggacatagccatgggcaaggacttcatgactaaaacaccaaaagcaatggcaacaaaagccaaagtagacaaatgggatctaattaaactaaagagcttctgcacagcaaaagaaactaccatcagagtaaacaggcaacctacagaatgggagaaaatttttgcaatctacccatctgacaaagggctaatatccagaatctacaaagaactcaaacaaatttacaagaaaaaaacaaacaaccccatcaaaaagtgggcaatggatatgaacagacacttctcaaaggaagacatttatgcaggcaacagacacgtgaaaaaacgttcatcatcactggtcatcagagaaatgcaaatcaaaaccacaatgagataccatctcacaccagttagaatggtgatcattaaaaagtcaggaaacaacaggtgctggagaggatgtggagaaaaaggaacacttttaaactcttggtaggactgtaaactagttcaaccattatggaagacagtgtggcgattcctcaaggatctagaactagaaataccatttgacccagccaccccattactgggtatacacccaaaggattataaatcatgctactacaaagacacatgcacatgtatgtttattgcggcactattcacaatagcaaagacttggaaccaacccaaatgtccatcaatgatagactggattaagaaaatgtggcatatatacaccatggaatactatgcagccataaaaaaacgatgagttcatgtcctttgtagggacatggatgaagctggaaaccatcattctcagcaaactaccacaaagacagaaacccaaacaccacatgttctcactcataggtgggaactgaacaatgaaaacacttggacatagggtggggaaaatcacacaccggggcctgtggggtgggcgggggggatgtgagaggaatagcattaggagaaatacctaatgtaaatgactagttgatgggtgcggcaaaccaacatggctcatgtatacctatgtatcaaacttgcatattgtgcacttttaccctagarcttaaagtataataataaaaaagaaacaacccaaatgtccatcaaaaacagaatggataaatggattgtagtatattagtataatggaatacagaacaataaaaactgaaagaaccatatctataagttctttagtttttgacatggacaattcccacaaataatgtattaaaggattaagccacagagtaatacagtattattccatatacgtaaagttcaaaaccaggctaaactaaatcattctggatgcatgtgtagacagtaaaactatgtcgttattatcatgaaactcaggaaggtggtgatacagaggrgagggaagcggatgtgatgagggaggagggtgtgatcagtagggaaacacggcctccagcgatgacaatmttccagttattaaactgggtgatgggttgtactgctgttctttataattcaatacacattttaaatgttcttttgtatttattcaataggtaatgaaacttattaaaaccacatatcaaaaaaaaaaagaaaaaagaaaagccgggcaggcattccgtaggtggtgaaatgggggatgcaaataataggctgaggaattagcaggtgccaagaatgtggcaggaagacaaagggcatggtttgtgtggtgcccctggggtgggtttctatggtttcctgtgagccacgtggtagtgagataggacggacccttatgccacatttaggagtttgaacttgagattatggtctggaaagccatgcatggtttttaaacaaacgtctcatatgagtgcattggggctttasaaagataacccggctcartatttggtatgaaaagaggctggggagctggcgcgtaggccaccaccatgggccagggactgctgaaagcagagggattgtctgcaatagagaagtgggggctggaattgccaggcagtgactgctcacatagggacagagcacaggagggcccagtcccgaggcgcctagctgttataaattcatactcagggtgggtcgtgaaccactggaattttaaatgaggagtcaggctggaatggggaatatgacttgttccatttgagatgcgtggaacacaccataccaggtgaacctgtaacaaagacagccaaggatgtttgtaaacagttagggacggggatgagtagactgtctagagccagagacctggagccatcagcatcccgattccgagaggttccatgagaatggatgaaactacacagaacatctagtggaggcacaagggaagaaatccacctatttctgtggaatttccaatatctggaggtagtaaaaggaagagacagaggagggcgaggggagagcgcgcgcgcgaaacggagactgagacccagccatcagggtgtgctgggagaactggggagacgagtctgcccctscgagtggacccagggaagagggcgcggtctacgcagagcccgaggcagggaagcgggaggggcccggagagcagccctgggtgaggccctttggaatggagaggtctcaggagtgaagcagcagccagaggactgagagtgtctggaaagtgaggaattggttaaagtaacgccggtggctgcaacagagaggggcgtaggtgaagaagcacccccaaccccatcccatttgagaggaagcagacaatgaagaagagaatatgaaagatacagaaagatgaaggcaggggtggaaagaacggaggggggggacaggaagggaaggagaaggtgcaaccaataggctgtaagcacaggggcaagcttgggcgccaggggagcagggactcggcgcctccccgatctgccccaggcgccacggaaattccaggccccgccacccgcactcccggagcctcctccgcagcggcggctcctcccactcgccctcccggggctcccgcccaagcttccggcgcttccaaactcactgctcgcgtcaccccccgctcccatccggcagcaaatcacagcgcagcaaatcgcaagcctagaaacagacgctccctctccaggggcagcttcctattcagggcgggtctgggcgcacctgttctcsggacccggccctcggccttcgccgggtctcgcggtggggcttgggaccccggctggtgccagggcgacccccacagccccgcgactctctttcccggccgcctcccgccgtcattctcctagttcctgcccgcctttgcctcgctctgattcctgctctggccttcctcccttcscctctctcacgcactccagggaagaggtggcctccgcgggaacctgggcacctccgtgcctgccccgcccggtacctggcagaggcccccacctcctgctgctgctgctgctgccgccgccgccgccgccgctgctgctttgactattcctcctttgtagatgcttcacgtccgccttgattgagggcaaggcttccggcagatgactcagaaccgttcgattgctctggcttgtgcaatccctgattctttgggcctgtgtggatgtctgygggcaccggagagagggccagtgcctggtccttggagggtggtttttataaaaagtgtacacattggctattgtccttttttcaccrttgattcacgtttgactccactgtagttagacgtccacccaaacattctctgaaattgctcctgataaggatactaatcattttctaattgccttggccaaaaaatacatcccaggtcttatttcattttgtttgttggcgacatttagccctttcttctttgaccttcccaggatttccagagcacccttcccttctttcctgactcctttgcttggtatcctgattcctttcctaccattctaagccctcttcttttcattatratatgatcttcttgtatgacctccactatatccataggttcatgtttcaacttttaacttatttcttcaaaatctctaacctgtctcgagccgtagatgttacctgtgtactactggacatctctcagaaacctgggtgtgtccctccgcagttcttttaactaaatgatcaacagtcctgttacttctatcacttttgtgttcctcctgtccatactctgtcacctctatcatgtctcatgtctctcctaaacaattaattttcctacctacagttctgatccatgccaacctattgcctactctgaagttcaggtaaacattccaattctaattattttatacctcagtttaaaatcctttataacatcctcttatccaaaaagataaattagaaactattgagcaaggagtgtaagcctcttcacgtcttgatttctcccttcttttctttagagccatagcaaattatttacattccttcatatcctctgttcatatacatggggttcctggcatgcaagcttgtctttcaaaattcagttcaaataatgtctcctgcaggaagctctcacagagctctccagtttgggaattctgcttttaaagatgcacattcccactctgcaccccaaaccaattaagtaaagatctcttggaggagggaacccagcagcagtattttgtaaaactcgctcagtgatttccctgtggaatcctaaaagtaactgttcccaagaactctcctcaataagtcttggtgcaggattcacccccatcttttctccatgactttgaaacccctctctctagtggctacagactcacatttgaactgtgcccaaacttaccggctctgccagttgaaaatgccaaggtcacttccccattgtgcatcaatttctccttgttggtcagaactagatccagactttgggccccactttgtccatccactccttttcctctttgaccagcaaaacagattaaaagatgaaaaatgcttgttttcctccgtgaaacttccagcaaatgcctggtggtttgaagtcstttacaaaggatataatttggcccctgggagtttggttgtaaacacagatatcccatgtaggaaacacagtgcgtgcaggtgcaaagaggcacaagatagcaccatgaaaaccatgacgtatccaggcctgcagtggtacagatagtgtggatgaggcactgcaagacaacgtctgatgtgtccacagggccatgtcgtgaaggccatgtggacgctgttggtggtgtttcttcrttcccttgtggactatggggaaacacaaaaggattttaagytggggagaaacataatcatatttgtatttacgaaggtccctctggctgcaacatggagtatattgtaggagggtaccattgcctgcagtgaggcgttaaggacgcagcatggatgagagatgaggaaagctgaaatgaaacagaggcaggagaaawggagaggaggacatggccttgaggaatttccaggacataaatttggcatcacttcttggaccatgagaggaasagggagcaggaagaatcaaagatgaatccaagaatgaacaaatctaatttttgaaataatgcaatgaaaagtagaactggtctgttttcctaggtaaggaatttgtcygcaagtcgatattcacgaggattaattgtatttattttctgagtatggacaatttaaatgctgggccctgaagggaaacccatctctcagaataactaaagcccaatttcagagtgagcctgaacaggctccccactccaccctggcccactggggacacaacaggtaactgataaggttccagagtatataattcagtgcctcagaaactgtcctcagcctcatcttctgtcttcttgcctcatacctaacttcacatctcttcagtcagtactagggagtatctgctggttctcaactcccgactcaaccttgacctagttttgtctgactccctcggctcctgactttgtggacctcaggaagggcacactcctaggctagtctcaggttgagctaccaccgtctccaaattagacttccacttgtcaagaaggaagtagagtccaggcataattggagcttcctggggtgattcgaggtctctgtactccttgctgtaaaatgcacaaatactccaccttaaagaatctcacggggcagggcacagtggctcatgcctgtaatcccagcacttttggaggccgaggcgggcggatcacctgaggtcaggagttccagaccagcctggccaacgtggtgaaaccccgtctctgctaaaaatacaaaaatgagccaggcgtggtggcaggtgcctgtaaccccagctactagggggcactgaagcaggagaactgcttgaacctcgggaggttgcagtgagttgagattgtgccactgcactccagcctgggcaacagagcgagactgtctcaaacaaacaaacaaaaaacaaagagtctcaccggagttccaaaatatccttcagtgactgaccatatactctagcaaaagttacttcatatatgcccggccacagctctcaatctcccatgagattcccagcaatcttccctggttttgagaaagtgtaaaaaaacacaaaaagcaaaaacaaaacacacttgcttcagctaattaatgctagagaaacaaacatagcatcataaaatgtaagcatttgaaagaaccatattgttgacgctgttccttatattttgcaggagaggatggtgaaatagaggtagtttgtgtgatttgcccagagtcccatgaagaattcacagaagaattgagactacagtcagtatggccacattcccagagaactgctttttctgccataccctgtggtaataatattgtcacaagacaattggacagtgtttcacatattcagtgatggaagaagagtttaattgaaataaataaatgtcaggaaaaattaattcgattgtgataacacttaaggaatggagtgttcactctctaggagaagttgggctaaatgatgaaatggagtgtccgtgtatgtgatctgtggtgctgttttgctgtagttaattcctakttttaacttgaaatgtgttctgactgcgttagtgccaatttttttgagaccggtgtacctatcctatcaggtacattcgatttacacaagtacattctcttttcagttctcccaccacttctctttattcaaacaattaaaaccttcttgaatattatttggttagtcctttgagttaatgaatcaattttacaggatctgcttctgtcatttttcattaacattccccagacaaatttgtactgcttactaacagcacaatcctaaattcaaaagattactgagttataaagtggatgtctggacmatccaaaacataatggctgtggtttgggtgtggatttttgtctccacsaaaacmcacactgcgattcagtccctgctgtgccagtgttccacttagggagaggtgtctgygtcatgtgggtggatcccttgtgaaagccttggtcctgttctcctggtagtcagtgaggtacaattagctctcatggaatggattaattcctccragagtgggttgttataaagtaaggtttctccccrtgtttggtccctcttcgcatgtgcctgcatcccctttgacctttccctcattgaacctgcaggttcaatgaaggttcactgcaacctccgcctcctgaggttcaatgtcttttgacatagcacaaaagccctctccagaagcctggggatgccagtgccatacctcttgtatattctgcagaatatgagccaaataagccttctttctttataaactacccagcctcaggtattcctrtatagcaacacaaaacagactaagacaatgcttatatgaaaatgtctagattgttaccaagacaaatgtaagcaatgaaacatacatgttgtagagcctctgctgatcaagggtatggagaacccagtggaccttaatgtgaaaagcattacattaatatgcctggtattgtatttcaaggaacttataaaagaaaaaaaggctcctgatatggcattgcctggaaactgccattagtccctcattagtgaatcgtcagtctctccattaatttgaagggggttaaggggaagtattaagtgacaaagaatttggagggaattagaaagatctctttggtttctaaacgtatcttttcgtgctttgattgaatgtgttgcagataggaaagttgaataggagatccctgatagcctctcagattttagcttatcaatagagttaccattgattgttgaaacagtgtgagttcctgccacttgttctagtgtcctgtctggttcagcattaatctcagaattttcagtttttaatggagtagtttttctaatagctgcacaccctcaagccagaatgtgtttgctagatccacactgtggacttcagtctcctgccacactctttcataatagtgggagagatgcttattcagttacatcaggcagtgttcactttgcaaacaaactacatcagagatttgaagagaagagaattaatacaaagaattattaagtaatagattttttaaaaatactgtaatggcagcagatgtasaaggtacaaaagagaaattgtcacttcatgtcttggggtaagtggaaaaaaaaagaactaaggacttaggaaaagacataggtcatagactgtattatgtcctcacaaaatttttatgtaaaagccctaacccctaagatgatagtttctggagatagggcctttgggagttgattggggtaaaataaagtcaggagggttgggccctcttgaagaaattagtggcattaaaagaagaagagataaattgctctccctgccatgtgaacatagctaaaaggtggccttctgcaaaccaggaatagagccctcttcagaaaccaaatctcctggcagcctgatcttggacttcccagcctctaaaactctgagaaatgtcagttgcttaaactgcccagtctatggtattttatttttattttttgaatcagtgtctcactctgttgcccaagctgaagtgcagtggcatgatcttggttcactgcagcctctgcctcctgggttcaagcgattctcctggctcagcctcctgagtagctgggactataggcaggtgccaccatgcccagttaatttttttgtttttgttttcagttttgtattttcagtagagatggggtttcaccatgttggccaggatggtctctaactcctgacctccggtgatctgcccaccttggcttcccaaagtgctgggattataggcatgagccaccacacccagcctatggtattttattatacccacctragcaaactaacatgactgaatgtcccaaggctgatattcagagctctttgaaggtgtggctgccacaggaacatgcagtctgcagtggctatgaaacttgtcagatggccaaagstggcttacgagaagccatatgtccttgctggagggtgtgggcaggctggggctggaccatagaagcaaatgcctggtagggatatagttgccagaggttgcatcttgaccaaatgcagaaatggccattgtgtggagaaagcattccctgagaatgtggctacagatgaccaagtgagctgctgggtgcctacactgaataatcctaagaagatcagaatccagaaagtgcatttctacttctatcttcttacagtgtctctccagctccctctattggcaaagcygaacactgggccagtcagtcaagttcttgttacaggatccaggtttactatcacaaagtccacaaaggtagatttagagctgatagacaataaattgatatctggcacagcaatgaatggagttctcaggcaagcctgtcattaaatctggatgataactastgaatctgtctcttttcctgatcctctccagaatccttcatctcaaggacaatatctaaggaattcactggtaaaacattktatgcttggtcacaagcagctagagaaagcaaactacttccggcctggtgcggtggctcatgtctgtaatctcagcactttgggaggccgaggtggtggatcacgaggacaggagttcaagaccagcctggccaacatggtgaaaccccgtctctactaaaaatacaaaaattggtcgggaggctggggcaggagacatgcttgaacccaggaggtggaggttgcaatgagctgagattgcaccactgcactccagcctgggtgacagagcgatactctstcttggaaggaaggaagcaaggaaagaaggaaggaaggaagcaaggaaggaaggaaggaagsaagsaaggarggaagsaaggaagsaaggaaggaagcaatgaaggaaggaagggagagagagagaaagaaagaagagagagagaagaaagaaaraaagaaagaaagaaagaaagaaagaaagaaagaaagaaagaaagaaagagaaagaaaagaaagaaagaaagaaaactacatctgaagtcaacactagtattggtgggagaggaattttatgctgcattccccaacagccactagatacgccaatcaggtgtgcatggtccatgctatgatctgtgagtatcagatcaacrtcagcttgttcagcaagccctcaggactggaaacctccctcaagtcctctgccccctccatctccttcaacacagaagcttcagctcaggaaaggaaaggccacctttcacatgcagaagcrcatcagcttctggaggggtacttcatgaaggtactgcctccatcttctcagtctccaaaccatcccttgctttggacctctccttttcaactgtggccctgcagccctctttgagaagagggatgcaagagccttagagttcccacttattgaagcataggaggagtgaaggctctcaggacctccattcaggactcctggagggggtagcaatgcttgcagagttcatagcgcccagatgcacctgaccttagctccatatcccaggatgctcatccctggatccaggatgatgtgcttttggtgccagaagtttctgagttccacttttcagatgggataacacagccaaagaaatcagacttcatcttaaagggagacaggtttctggtccctactcttcctgcactgtgctgacagctgcccttctggtaggagctgatataggtaagtttcacaataacaagaggaagagattactcatggcttttctggatgtaccaggcttgtttgagtaattttccagtgtttggcattaccagacattggatccacattctacctcgttgctagctacaagaacttgttcaagctacttaacttctgagtctcagattcctcatgggtttattatcmctaaggattaaataatctatgcaaaatgtccaatgcaaagaaggtattcagtaaacatatctgaggaggtcagatcaactttttttcctagaattcaattctaaatggaactcactttgtggatacttacaagaaacactacatagtgtaagggaaatgtcttagtgcaatttcacaaaacacatggaattattatttgggaggctggacctttcacggaattgtagctgttttgattgtctcatattcaccttgttggtgaaggagggatctcccccattaaatagtaggagataactagacacatggcatgacacactggacagatgaaattggcggcagtttattagtcacaactgctcacagggagggaggtcaccacatgccatgcggggtcacaggagagttgcatttgggaatagagtgaaccagtaggggctgtggaaggcaggctttgcagtaacaagaggaagaggcgattcctggctcctccagatgtgacaggcttgtttgaataattttccaggctggagggaagtgagccacgttgagacccagggagggtacagctgactgcctggtaagggaacttagaagggggaagagccttcctgctcagtgggtgaatagggtgcacatatctgacaagagcaggggacttcatggccaggcctctgaggccctgagaagcccatagatgtcaaggcagcacatgagctttcaggctttacaagacagaaataaaatagtgaatgataactcttcaaagagaatatgacaaacaaaatttcacaagaccctctaggaacaatatgcatattgttatctctatgttttatgatttacatggctaaagtctgattatattatatttctataacagataaaaccattatcattcattttcataattcatattgaaatgatttgattatcctcattccaggaaagaaaaaaaaaaaacaccctcctgcttggatacttagaggttactccatttacactccccactcccacctcttactccacttgactggactatccacaaggcagtgcaaagaggtgtgtgtttccctgaagaagagggtgccaccctgttgctcctggctgtaacactcagaggctctctctgcagtggwagaatcatatgggctgattattccccacctttcagacttctttccaagtccaagtgttgggcagaggaggaagaggaatgagagtagcaaacccggcaacctctgatrctccctctttcctctctcagcccacatataatgtggatgtctccttgtaatcttcagtctcattctctccctgaagctaagtagctggctttggtacaaagggaaaagttggccagttatggaaagaaaatatgggttgtgtcagtgaagttctgagggctcagggtctttctggctgcaagggggttgakggaatgtctttttagctgtgccctagaaaacaatataactctccctgttcaatctaaatcatcagtgtgttcccttatcactgatcacagcagttgcatttcaagcctgtaaaccatacagtatggcaataccagtgagggagacagctagaaatttttaaattcaaattttaacgctatttgtgaaaagaaaaactacctaatattaacaagcaaaaaaacctggaagagattatttcatctagagagacatcacagatacttgataagggaaaagctaaagctagagaaaaggtctacgagttggcaatatttccaaagaaaggttttaatgtttgcatagttgtttagagaaaaaaggactcctttttatatttgacagttttgtaaagaactgactataaaactgtttaaaatattatcgaaatagaataacaatatattttcacctttagttttatcagcaacccaggagtttacacgtgttgtggacttctctgtatcattcacaaagtctagctgttttatcgttgcttggtagaatttgccacaggaatctgtaaaaccctaggaaaaaccaaaaacataatttcacagctacagaaacaactaatatcactggcttacttcttcattgtgccacatcagaaaatcaatarttttatgatttaccatatataatttgcaaataaagatgaggaattaacctaaagtccaaattcttttcagctattcctaatcttagcttataaactaagcaacgcggtgggctgcatatcaagtgattttcatcaactgctggatccttcatgagagtggcagtacacccatcaatgagataatttaaaacactgagaaatctccaagaagacatagaaatccttaataggtaagtacctaatagtggaccatcaagacacataaggcaacaactaatagaactgaaaggagaaatagatgaatccactattataactggagacttcaatatccctctatcaggaatgaacagatccagcaagcagaaaattagtaaagaacatagttgaactcaaaaacaacatcaagtaactagatataattgatatctattgactacttcatccaacaagagtagaatctatattcttctcaagcttacatgaaacatttaccaaaagagaccacattctgggccacaaagcacaacttagcatatttaaaataatagaaatcatgcaacgtctgctctcagacaataacgaattaaactagaaatcaataagagaaagatggctgaaaattccaaaagtactcggagattcaataacacacgaatcacagaagaaatctcaagtgatattaaaaacagtttgaactaaatgaaagtgaaaacacactgacaacactaaatgctggtgaaaacgtggagcaacaggaactctcattcattgctggtgggaatacaatattgtayagtcactttggaagacagtgtggaagttttttataaaactaaaaatatgatccagcaatcatgacccttaccatttacccaaaggagctgataaaacctgcacacaaatattcataacagctttattcctaaccggccaaggtagaaacaagaaagctgtcccccatgactgtactaggggatgttaatcacaggagggactatgcatgtaccttttgctcaatttttctgtgaacctaaaattgctttagaaaataaattctttttttttcttttttacaaatggtgactatagaagctgtcactcctgtaaattattaaatttgttgagtgaggattaacacagcaagtgctatatttgcctctacattttagaacaacagamtataaatatgagtctgttgttccataaattacatgggaaacatatacaatcctagaccagcagtgtccatcggaactttctgggatgatgaaaatgttgtaaatctgcaatgtccagagcggtgccacataggctattgagcacttgaaatatattaatagctagttggactgaggaactgaataattaatttcatggaaaccttatactcatgtacataatgcatagcattatgggtgtttcaaactatgatcaactttccaaaaaagttcaaactatatttagttaatatattctgtagaattataatgatcttaacagaaacctacactatgccacataaaagcagaacatttggtggaaattaaatgagctgaaacaactaatttatgaaccatgcattatagaattgtttcccaatctttctctcaaactgctcacarctaaatatttaatttccctttccataattttgcttttactttggaattttatacttctgtatcagtatggcatggagaggaaatgtgactgtagttaggaacacaagttctgcaacttactagttgtgtgaccttcaaatatttgcttcctctgtttatgcctccatgttctctcctgtagaacaaggaagcagtaatagctacacctcacaagataactgtgaagtcctgatgaaatatcaccttttcatgtaacgtttttgaattctcagtaccacrtaactgatcgatgtacactatttcacttaatcctcccrtaattcatgcttttccaaaattgctgcctctgcctatttttcagtggtttggaaattatttaaatctctcagtgtaagaaaataatctgaaggcaaactgatgaatcacatattgatgacttcttgcacgcctaggygatctttccatctgttaaacgtgtttttaaataactgtctgctattttaagttactatttgacaaagtgtggcaaatcaaacaaaaagaacatgtaattatatattgctattggtatgggattcttgaaaataagaataaataataaattaatctgaaatggtttacaaatatttctcatctttttaatttatattccaatatcaaaataacattttaaatatcaatgcttttctttcaaaatatccaccacgaattgatatttggttgttaacattttggttgtctttatatagaaaactagtaagctagtaaaaagatggcaataaactaaatagtgctaagactagtaaaataagtgaagttgtaaaatcacaatatcatatacaaatcttataaatatttcacttttatgtcttaccaccttcactttataccaatctgtttgcaaacaattaatttagagtcgaaagcaagtttgaaaaaatacatatcacagtaagagagatatcctctacaaaaataattcttataagtcaataagaaaaagacatacaaccccatagaaaaatgtgtaagaggatatgtaaataggcaattcacagaagagatagaaattctcaatacacataaaagtgtttaatcccatttataatcaaaagtttttatttttttttttgttgcttctcttg

SEQ ID NO: 13425 - DNA, 19104 bp, Homo sapiens
ctaaaaatacaaaaattagccgggcgtggtggcgttagctgggcgtggtggcatgtgcctgttgtcccgtccccgctactcaggaggctgaggcaggggaatcacttgaacccaggaggcggaggttgcagtgagccaagatcaagccactgyactccaccctggcgacagagcaagactctgtctccaaacaaacaaacaaacaaaaaacaaacaaacaaaaacaaagatccagcatggctcaaaggagaggccacagggctgctgggcacgacctcagcccaagaacgctgcgaggccagatgttgctaaagaggagtttccctggtaggcaagacgggtsgtgagcgtgacgtctccctaaattaggaggggaagaggggacgtgacagtcagtgcagcaggtgaccttggggaccagatgagccacaggggcttgaagggagagggccaagaaaaggcagaggaaagaggctgctgtgtgaaagagctctgagaagctcaggccagagccaggtcactgagacccacgactcccatccccttggggacagccttaagggccttgtcagcaaccagggacacagctcgggcggaccacccacatcaagcgttcctggctggaaggcacagcttctctctggagttacctggcctggtcacctcaccaggtcctccttggagagaaggagcaggaaacctgcactggttaaatgtacctggatctttctagaggcacagtgaggcccttagcatctatgagctatgtctgtcgccgctttgtggacaatggagctaagggtcacagagcacccgtgatcacatgacttgtgcccaaggaattagggctggcccacctctgggcagctgcaaaacccactcgtccccagccttcccaccagaccagcctcgttcaacagatgcagagcgggcgcctccacagccttcactgcactgttttaaacgtttcacaccaactacctcatctcaaactcaaaactgccagaacttaggagataaatactgttacctcctttgacagatgcaaagcccaggcccagagcgatcaagtgtccagccagaggctaccaggcggtgaggggcagaggcccagagcccacgatcttaacgggccatctacaggccccagacccggctcctgccctgtcctggcgctcccagctctgccgactgtgaagccacatgcagtcttcactgtcacactggtgccctgagctctgcccccacagccaggccctctccctccccaacctatgacttcccaaggctgtcaagatgtaaaaagtattccttgtgctcctcaccgactcccttagatgagtgaaggaagctttttcctggatttatccctgggaagtgacactgctcaccatcctccagccagaaagtcaacactcccagcattgaccatggtggccgggaactctctaaaacacctcagactcagtaggaggtgcagggggacggcgttccctgctaagctccggacactggagtgagtgggagttcccagaccctctcactggccaggctgacgtgtgtgctgcagggctgcaaggagcacaaccaggagacgggaagggctgcrcatggatctgatgaaactgagaggaccctgcttcggcttcaggatmtaaaccctcaagagttatttgtacaaaatgataagcagctaacctctgcaacacataaagcacttgtttaagaaaaggatcaaaactgccccaaacatacagacagaccgaaagaatcagcacacacggagaaaacagttcaaaccctgttggtcaccaaagcccaagttcctgtggcttcagcgtggctgccaggacgcagagcagttcttgcagagctgyggrgacatgatgcagcccaggggcaaaaccacagctgtaatctactctggggaatcgccccaagaaayagccaggggcatcccttgctcaaggacattgtcaggtacaggttagctggaaagctgctgagacctcgggtgcctgagggaacaatcccagacctgctgggtatcagcatggtaacccgtcgagcctgcctcacctctcctgatggaagggacgctccgtgcactcgagcctgcctcayctctcctgacggaagtgacactcctcacgtccagctccagcttctgcaccaaggcgctggggtctatcttggtcctggcaaagatgttggtgttgatgaacgcccagtcctaatgtccccaacaaaaacggacgaaaagaagaggtgtgagacttgctctgtggtttcagagggacgttaaaggtgaggagaagatgcaagacaagaacctggattccccagcttctctgcccgggaggacctgggggaaacaaccctcacctcccagagcagragcctccggttccagagctccagggcagacccgcagcgcccaggcccacctgctccctgccttcaatcaccagacgggcttcactcctggttcttcaggagtcaggaccagtatctcaagaaccaaatttccttcccaaccatttcgtcttactctttctacaacattctcctgtgtcacagaagaaacctgcagctgagcagatgaaggataggcagctcccagcctgacagctctttcagctcagactgaccacatcccatcagaactagtcatctcagcagcctctctgccaggtctggttctgagccacactcatccctgcatgaagatttcagttcctccaagtcagctgccgaccaaaccgtgaggagacagaacccccccgtccctgacccccgtgctgcccagcccattcatgtgcaagcctcactgaccttggcagggaaggcagcatcgacctcaacagaggtttctgaagggggtcagaatacgccaccccaaaacatgtcactaattattttgagctaaaggcacttaaaaatatagcaggtaccaagagggcatattaaccccctccctgtttttcctgaaaggagataaaacccccatatggaagatgccctcctacaccagaaggtaagtgacattcttatcatcagggatggatcagaggagccaagagcactctgtacagacacacctggtgaacacaacccctcccctcctgcagcctccccaygtggtttagttttccacaaccacctccgttcaacctctcaccctctcaaagaagcacaaagttctcccacttccttgtcttcatttccttataaggctcccatgtcacataaaacttcaatgaatgggtacgcttttctcctgttaatctgttttatgtaattctaaatctcaggcccaacctaaaaaccttgaaggtagaggtaaaayatggcctccttcacattacagaggagacaggatgcagatgaggtagaaggcagccagggcaccaagaggtgccaggctggactgcaactccccaggtgcyctcacccacagcacctgagggagaagtccttggtctccctcacccacagcacctgagggagaagtccttggtcttggagggttacgtggcagrgacagaaaagtcggtacatgggaaaatatcagactcacgggggaacagtgctggagaccagggcagccttcagatgggcaggcaggtggctgaggcagcacaggtaggctgaggcctcacaggcaaacagggaccaggtggggacaaggggtgcagcatgcagccttccagatcatgaatgtatgttggtatacggcagacgactgcttttcccactgtacctgggacattctccatggtagcactttatatctcattaatgcatatttttggagcttaataaaaaaatgctggcacaggtttcaatgagccaagacaactaaaggcacgcccctctcctgctagtagagagagatgtcacctgagaagctgaagctgctcctgccccatctctggtgtcctgacacggagctcttgcccaggagcggtaggctgcaaaaaggaagaactccatagctctgccagaagggactcgccttgtctgsagctcgtgtgagggctctcacgcctaagggtgttgctgaccaggaaggagctctgggtggtgacagatgcagagggcagggtgcccaaggctcctgggtagacagtaagcccctctgacccaggaacaactcccaggaggtcgcatccctggcagtctggaggctgtgcgcatgttcaaggacgcaccctaccaggagtgagcagagggactctgtaagctactagtccttggctgtgcctctgagggcagaaatgaaggtcaaaaatgtgaacacgctgaatctgacagccacctccaagccagaggtatccagtggtaaaaggcaaaaaccccctggccaaggaggctttaagaacaattgctgaccagtgaggagctyaagcagatccaactagccaggctaaaagagaaaaacaggaagaaaaaaaaaaaaccaagggggcacatcagaggctgcacacagccagaaggggacaaggagagaggtcacatagttcagttccagatcaataaacaaagtaatcaagcagatactaatccctggttgctacaggactatccaaaatgcccaattttccacaaaaagtgatacattcaaagaaggcccacctgctcctacctgccagcatgagccaggcaacagaaactgctttgagcagcccacatgtaaagaattcagagtaggcattayaaatatttctaaggactaaaagagaccgtgtctaaagaactaaacgaaggtataatgacattctcacatcaaacagaaaacatcagtaaagagtattttttaaaatgaggaggaacaggagaagagaaagaaagtaaataaattctggagtcaaaaaaaatgaaaatttcactggaaaggttcaaaagcacctctgggctggcagaacatcagtaaacttgaattaagatagattatgccatctgaagaaaagagaaaaactgagtgaacagcgcctcagagcactgtgggacaccattaagcacgacgtacatatttataatggaagtatccgaaagagaggagtgacagaaargggcagaaaaaaatattcaaggaaataatggctgaagacttrccaatgtaacgaaaaacattaacctacacacgcaagaagctcagtgaacacgcaaaataaatgcagatacctacaccaagacacatcggtcaaaatatttaaggcaaaagccaaaaaaaaaaaaaaatcctgaaagcaataattccactcacatgcagtgtctagaataaagacaraaggtagattcgtgcttgcttagggctgagggggatggagaaacaggccagcygactgctaaagggaacggggtctctcttcagtttgctctccgttcttctctaactctgggaacgtcctttcctttccggggagctcagtgcgattcaggaacctctggggtccgcgtggcaaccctggaccgcagcgggaggttcctggctctctcccctccccgggagcggcgcgagtccgtgtgccmaggacggcagcgcagagcggagcctcggagtttacgacgcttcgcgaagcaagaaggtcgcgtctgtagcgcagcaaatgcccgcagagcccgagggaaggccggggtcgcggaaccctcccggaggcggcgccccgcagctcacccgccctcggacccacgcggcagcccccggccagcgcctccccagctcaccttccccgcggccgaggccggcggargggtcgcctccggggcagggggcgcggggccgggggcggcctcccctttcggcctcacggcagcctggtgcactcgggcgcgcaaccccctcactttccccatcttcccggcggagcacggcaaacgtgcggagcgcctcccggaagctggtcctgcgttctygccgcccggcggaaacaggagccgcggctgccgggagccccgcggccgccggaagtacccggaagcggctcgggcgggcgcagggtcgcgggtgtagggtggcggcgctccgcctttcaccgacgcacctgggagaaacagaccggaggacgcgggtggcgcggagcacgagaaacaaygagtttctgtctagatcgtgggggacccaagcccggggttgcgtccaaggtcggggatggagaggacgcgacccccgcggcagtcgagatggcctttttaaaattctatatttgagaaggagtctcgcgctgtcgcccaggctggagcgcaatggcgcgaaatcggctcaytgcagcctcgacgtccaggactcgagcgatcctcccgcctcagcctctcgagaaggtgggaccacsggtgggcaccgccacgcccggytaatttttattaatgttttgctagagccgggatcttgctgtgttgtcyggctggtcttaaactcctgggctccagcgatcctccctcctcggcctcccaaagcgctgggattacaggcatgagccacactgcgcctggccaagctagtgcattttaattgaccttcacttcatgtcaatttattttttacactattccatttagtcctcagaacagttctttagaattgggtattgctccgtttacgtgggaaacatagcagcgaggtaacgggctgggtcccgtgctgggaacgggagccctgctcatctgactgcttgcaccctgtgctgtctatgctgggcgtactggggggcgttagggaagagaccacaggtacgatgcaatgcctgtcctcaaggagcccattgttctcatgggaacacaaagctgacacatcgagaacaaactatggaacaggctgtggctgagggccatgaaggaaggctgccaagtccgggcccagccaggtagcagccacacctctatctaccctgctccccaacactgggcaccagcactcacctgcccaggacccacagtgaaaacccacccacaaaaaatgcactttggagaagrgtagcaggtcccaggcagagccagggccacctctcagaaaggacatcaagtttctcgcccagctgagagatggacagatgaccgcacaagccactcacagcccaaggtgatggactctaggatatattcaaggctgagcaactggcttgaagtcgtgtctacttacatattcaaagacctagtgagcattcacaagtcattctttttaccctccaactagccgtgttctcaaccagtctacctaggaatgctgttggctgtgaaaactccagaggctggtatctttagagttccttcagggtgcattcagcatctgagcctagcgactcttgaggtgaaagtgcycaygttttttttttggtgagagagtctcactctgtcgcccaggctggagtgcagtggcgcagtctcaaagtgctcatctttatgtactttggatgccggtgaatgcctattgtttcagccagctggatcactttacctgttaaccattccaatgtgagtttacttcatggaattgtgcctgtttttaaagaacatattctggctgggcgtggtggcccacgcctgtaatcccagcactttgggaggctgaggcaggcggatcacctgaggtcaggagtctgagaccagcctgaccaacgtggagaaaccccatctccactaaaaatacaaaattagccaggcgtggtggcgcatgcctgtaatcccagctactcaggaggctgaggcaggagaatcgcttgaaccggggaggcagaggttgcaatgacccaagatcacaccgttgcactctggcctaggcaacaagagcaaaactccgtctcaaaaaaaaaaaatttatattctttaaagatcagcctcctcttccactgccagcccagtgtttgagactgctatggtttgaatgttggtcccctctgaaacccatgttgaaatgtaattgccatcatactagtattaagatgtggcacctttaagaggtgattaggccacaaggactctaccgtcaggaaagggttaatgttgttatcatgggagtgggtttgttatcaaagtatttttcataaaaggactagtttgccccccttttggcacactcttgccctctctttgctgttccaccatgggatgacacakcaagaaggcccttgccagtkgctagctcttctgtcttggacttcccagtctccagaaccatgagccagtaaatttcagttcattatataaattacctagtctgtggtattctgttatagcagcacaaaacagagtaagacagtgacaaagatactcacctgtacaaaggaggaagcttcaaaagaagccattcatgtatggggtgggactgcagaaggaccacagtagagaatccctcaccaataaggaactgtgttaatcaggtaactaattaattaaaaaaaaattaagagacagggtctcactctgttgcccaagttggaacagtggtgcaatcatagctcattgtaayggtgamctcctgggctcaagtgatcctcccatcttagcctcctgaatagctgggaacacaggcatgtgccaccacacctggctaattttttgggtttttttttttgcagagacacaatctccctatgttgcccaggctgatcttgaactcggctcaagcagtcgtcccacttcagcctcccaaaatgctgagatgacaggcgtgagccactgccatgtggccccagattttcttttttaaaaagtcatatacgtacacgatactgtaggggaggcaaatatccacctccctcctcttaggttcctggctgggcctgggaactaagttgaaatcagatggattaacaggagaaatgtatacaaatttaatgtcactttgatgtcacacaggaccctcctaaggaagcaaagacccaaagaagtgacgaaacctatgtgcttttgcaggaggctgaacaaagaggcagttgtggaaaagtaaaccgtgtggggaggcttaagaacgacaggaattactttaattactttaatgtctgtacagaattctgtyggctatgacgtgcttccctgtagaggaatctttcttcgcccggtacagggaaggcatctttcaccygagcgtttttatctcctgtcttcaggaagaaaaggagagatccgatgatgctcttgcctgtgccatttttcaagtgccttaggtagaagtgattcttatgtcaaagtggcagagtgagccacccttcgatcccaatggaaacgtcctaaaaggtgttgacagtgaacagttccccttcctcccctgacgccagagcctagttctctgcccacttgaaaccatgattatgggtttcctatcgcaattctgtagacttttatacaaaaagagttttatctatgagaaaatatttttcagtgatcctgttcttcacaccaattaaacctgactgttccctgctccgcacctggcttctctcacgtcataaagatcttaccatttgcccctcattcctcctggcactccatagcggctgcagaggacactggatgtgacatggctccatcagttcccacatggcttgttccctctctcctgctgtaactgacatgctggcatgcacattgccttatacatacaaacagaagctttccaaagagaagtttcaggaaattcacgtggaatgtttggcagttggtgtatataaaaagctcaggcctggccgggtgcagtggcttacacctgtaatcccagcactttgggaggccgaggcgggcagatcacaatgtcaggagatcaagactatcctggctaacacggtgaaacgctgtctctactaaaaatacaaaaaattagctgggcgtggtggcgggcgcctgtagtcccagctactcaggaggctgaggcaggagaatggcatgaaccggggaggcggagcttgcagtgagccgagatcgcaccactgcactccagcctgggcgatggagcgagactctgtctcaaaaaaaaaaaaataagtaaaaataaaaaactcaggyctgcttctcccttcgtgttgtacccaggagtggccagaaggctcctctccaggcctcacagagggaaacactggtctagtgagagacctgcgtcctgcccatcaggaccgaagcggcacgygygaggatcctgcaggccaagagacaacagcgattacaaaccccagtcccagccttgcagctgaccttgcaggtgacgccctgcctgggtgtctcggtgcagctgcacatcaggggcctctgctggacagaagctctgagtccacacttggcccccaggcgctggagctggtaggtgacaygttgcactcttatttgggattctgctacctctttctgttcaacaagtgaagcctcagaatgcagagagggggctaggagaggcccctgcagacatgctgggcctcatggggcctcacagctgtccagagccaaaccatgcggtgctgctctgctccagccatggccagtggtgaaagggacagagggaatcactgatgcctgcaaggatgctctgacccctcaggaaggctgcccaggtgcccaccttcagggagacccacagatgccccatgctgggggggcacagtatgagtggctgaatccttgcagagccagtgctaggcttggacccctgcagatgcagggggtgccccagggagggtctccatggactcagagcctgcctctgccctggactgtctcctgctcctgctctctcctctctgcccctggagtggtgtgtgctggctctaggtcagtaggaggcttcattcagaaatgcctttcagcatgctgcccagaccaygtctctgtttcaggagcactgccacgagaggggatgctgccgtggctgcrccagcttcagccctttccctgcaccgagatgtcccagtgagcggctgggtgctcacagttcccgttgggccatcagaggaagatcaaagatcaaccctcccccatgggctcctgcctgcctgccaggtgggtttcctgcctgtctcccagcccccaagagctccacggactctgccagtagctgctttaaaggagggagggagttttctgatcctctggacatcyctggggctggagctatgggctgagccataggagagccagcccwgctccctgggggttgggggctgtgtctctccatcccttagtaaaaatacagcaactcccaactcaaagtcaagggtcaatagtcacaaaaccttggtgcagcctggaacaggcatagaggtctcagcagagctgcccaaggacaagacctaagatccagcagggaactatgtagtcaccccgagaggcccagctctctccgtgagctctgggcctagggtgggggtggttgttggttctgcgcgcactgttccccctacatgatgggtccatcccagttggcttctctcactcgcttcctcctgtggagaagcctgtccaggtgtcactgcctccaggaagctgtctctgatttctccagttgaacagtgagatttgccacacctcacatgcatcgctcttgtccctggaattgtaaccataggttttcctgtctcctggaggacaaggatgagggctttccacttgagtctccctggtggagcccagctcctgacatacctggtaaaagttctcaagagaagaacatggaggaggaatgtggataacaaccctggctgcctgtgtgttccaagctaggaagatgtaatgtccccacaaacggggtaaatggcttgcctgcgtcacagctgtctcaagcccaggccctgggygccagcccaagcccaaggactaggtccagagccacacagcgccaggccacatccgcctcacctgggaccytttgtggggtacagtctccggccccacccagacctsctgaaggagagaccccatggcaaggactcagccacctgcagtttcataagcccccagtgggttcctaggcatgaagaccaccggttagaggctgaactggcaggaacctgtctccagccccttctcaccccagccgggccctgcctcagaggcagcacccaggacgtggccatgacccgtggactccactcaatccctcttctccaggagccatgcaaagtgtcagccagccaggcccctggaaggcagtcatcacctcttaaggcattgygggtrtcggtcctgcaactgccaggtgcagcacacgaccyrtgtccggtgttcgatagcagggagccatgacctggcaacgattccacgctcaaaggggcacccggggggccctgggtcggggcggatcagctttccctgggcacatctgcctcattccagatctccagggctcatgtctgtgacagggagggaaggctctgccctggccttccgtcagctctgccagtgcaggctgggcagcctgggctttagagctggcttctgcccacactttctccgtgaaaggaaaacaactatgagtctgccaaacgcatctcagatgcgttttaaaaaattctggtccccgctctctgtcccatcatcygcctcggggacttcctctctccgtggttctcaccccatactctgtcactgccacattttcacctgggcctggcctttgtctccacctgaaactcctgaaaatcttgaaatggatttctaggtcactggggactccggcagcacattcggcttcagaataaagggcgcccgcggtcccccagcacctscccaagccacacccctagcttccctccctatccctgcagcctgagggtcccttcagccacccytaagtccccacctgggctcctgccccgcccctggctagcagcgccttctccaccggggcccctctgctcacagagccccctcacctccctggggatgaggggccaggccatgaccctgaaagcctagccctggccttgacctcccaggagcgccctccccgccctctcccggccccggccycgtcctctgctgctggcctctgggtcgtgccccgcagactgagctgcgcttgggggtcctggcggcctgggccgtcccgcaccgaacccaggcggtcggagcccggcggggaggcgcgaggtccttctgggggctcctccgacgcctgagggcgctgcttccccgcggscgccccgggtttctgcggagccggggcctccgctctcgggwgacccggtgagacccccggggaggccgctggggaggcgcgggctctgctcccgggtcccaaaygcaccggctgcccctcaggagggacggcgacctccacccacggcgctggcgcccgcacggccgctcctcccgctcccgcagcctggacgcctcccgaggccgccccgccgggccccacgcgcggccccatccgcaggccaggactgccttcccggagctggcggcccccagcctggaggagccggccccagacgccctcccagccctccccagcccactctggccccgcagcccccgcctggtccgagtgcgggtctctggccccggcctttcccggggaaggaaagctcccttcacgcgccccagggaggcggccaggctcggagcgtggaatccctgcccgccgcggaccgcaggttttgggcaagctctggccttcctgagcctcagtttccccatctctataatggggacggcaggggtttttctgaggacccccaggaaaagctccaggaagcgcctactcacagcgcgtgctcagtggtggccccggagctggcagggagcaaacgcaacggaatacggccggggtcgggcggtgggggtctgggtcggggtcagggtgggggtcggatcgtggtgtccgcggcgggggaggctccgcgcaccggctgagcagctccggacagcgggtgagggaaggcggcttcctcctgcttcgagacccatcctcgtgcccaggggagcgcctcagggaaggaggagccacgttccagggcacctggmtgggacctgccgcagcctctgcgcgcagcgggctccatcccccgggccacggattgggagactgaggcaggcgcgaagcccgccgcccagcctccgctagggagaccccggccacctccaggcagttttcctgaagcccggggccaggagaaggtgagcggctgcccgtcgggggtcgcctgcgccgggtggatgcggcggcacttgggtgcggtgggctcccaacctcactgtccgaccaaaggatcgccccggctgggcggggacctggcgcgcmtaggccgggaggggacagctggtttcgggcggcctctgccccagtgacctgtagactttggctttggttcagggacgtctggggttaaaaatgatcgtttgggttcccgcagtactgttcgcggtctgagcatctccacaacgcgcacattcccataatgaatttccgagaaccggcacgcgtgcctcccctcttggctcctgggactgcgaggccggatccaatctgtgcgcctctgtgcgcagggacggctgatggcccggttccgcctgtccgtgccccaggatgctacaggaagctcagatgcaaactctttggggctgtgagttcccgcattgggaaactcttgcaataaaaataatcgtgctgtaatccccagggaccattgagaggaagtggtgagggcgggggaggcgcgggaggaagaggctgggggctgaggtgtgctggggtgggtaggagaccggctgmgcccagcacggagccgcttcctggtagccctggcggcatcacccttgggtcgggttccagagcccgggggtcctttcagctttccgttccttttccttatacttcgtccctctctccagctrgagaggggcaggctctggggtctgggtacttttgttttggagccatttaacttgagttataataacatgcttttctgattataaaattaatgcatggctaccataaacaatttggaaaagacagaaaacaagttaacacgttaaaatctcaatcctgtctggtgaggactgcagtgaagcccagctggccaccccttccggggcctctgttctccccagggccttgcagcctytctgggcttggcattgctatggctaaagtgtgaaaggktcatgcaaggctgtcagccctgcgtcccccacgtgtgactgcatggggtcccacccaaatcggagtaatatacccactcagcctcacccctgctctgctggccccagggaggaaatgctcatcattgcatccgcccaccccacccctgcagtgccacattcaccagcctcgctgggcatcttccccctccccgccctctgcccctgscgcattcaccagcctcactgggcatattctgccctccccgcccctgcggtggcatattcaccagccccgctgggcatgtcccccaccctgcccctgcagtgccacattcaccagcctcgctgggcatgttcccccaccctgtcttctgcccctgcctcattcaccagcttcactgcccctagccttccctcactcagcagcctctgggccccagtccccactgccactccgtgttcccaggctctgcactcccaacccttcatctgctcatccctgggaggcagacctgtcacctcatttacaaatggaaaaaggtgcctttcaggaactgacctgaggctgtgcagccccctgcctagcaggtgcctagcggttgctgctgtttctatcagaaagaaaaactaacagggggagggaggggggagggctgccctccagccttcaggggcttcctgggtggagggggccrgacctktctggtcaggtccctctgggttgagaggtcatctccgggmcaggactcagaactggaagagggaggggcagcgaggaaaggtccctgcctggcggtgctgccttccatgggggcctkgtggggcagaggctggaacacccacttggggtttctggtgggaactggggagcwgggtggggagcctgagtcccctcagrrgaggagtcattttgaaactggagggagaggctaaaagaggaggctgtggagagacctagtgttgaccagggtccagcgtcagtgtttaggttctctagctcttccccacctccaatgtcctccatgtccgcaccattcccacgtgcctgtgtcccaccycttctcccacacactgtccccactccccatgccccattcctctccagagaatcactggtctagaatagagacctacaaacttgggcccttaggctggccctccacctgtttytgtcaataaagttttattggaacacagtcatactcattcactttcagaaggtctatggtcactctgcagccacaatggcagagctgagtagtcrcggcagagaccatttggccagcaaagcctaaaacacatactgtctgcaggggcttcctgggtggagggggggtgaaccttcctggtcagatccctctgggttgagagctcttccccctccagggaagagcttgcccacctccgcatcgcagctcacttttacggagcactttctctctgttctgtgccacccgagcccatatccaggcccagtgagctctgcacattggtcatcccctcactgcagggggaggcccagataccacccacaggacacatttgtgtgtgaagtgccacactagggcccagaagggacagctccccaccaggtagggacaaagcaggggtaaagggaacacatgggccggcctatgagctggacccttcaggatgggaaatgcgtgggccgggttgcagagggggttggtgaggggctcggggacaacacaggtgtgttcagagacarggcgggtcattagatttgatggaggcttggggtccctgagcttaggaagcccccatggaaaccaagtcacaggcatccagggtgaggaaggctgcccacaggcatccagggtgaggaaggcwgcccacaggcatccagggtgaggaaggcwgcccacaggcatccagggtgaggaaggcwgcccacaggcatccagggtgaggaaggcwgcccacaggcatccagggtgaggaaggcwgcccacaggcatccagggtgaggaaggcwgcccacaggcatccagggtgaggaaggcagcccacacttttcttggagacacatccccaaagamgtcctcacgtggctccgtttgggcagaaaccatgaattgaacgggaaaagaaatatgtcaagtatcagaaagaagagtggcatgctttgacagcaagtggactccgagtccagggcagagcctcagttagggtaagaggcacccacccgacccaacccgacccgacccgacccgaccctcgggagccctgctctctggtcagttggccttcatgggggtggggaggtgggtggaggaatgaggtttagtggtctgcgaaggtggcagatcttgttttggtagatgagggcattatctcccactgccccaccacattcgagctgctttcagtcggcgtggtgcttttgctctctctgaccatgcaattgtcgttcactgctgggccatgtggacggactggaattacagtttcttcttctccggttttccccctggagtccatcgttgcttaactgttttcctcgttccatctcctttgaacattgagcatcttcccacccccagggggcctggaagacttcccagcataactccccaccyagccaaggctaccggtcagtctgtccctggacagggggtgacaggtgagcctgtctggcagcccttgccaggggctgtgaaatcttcctttgggtsagtcagggaagcaagaatgccacctcctcagctctctccctcaaggaggagccacaccacgcagaggaaggcagaggagggaggaactgtgctcccagtgtgggaagctgcgtcggggggttgggggggcacaggcccacccaggccacagggggatggaggctgcccccagcttctcgcagccctccctccttcctacactcacctgccttccccggggcagatctccatttctgcattgcacccagcctggtggcctgggaccagccctgatggtcagcctgtttgtatggatctgtgggggatcccatgagaaagagctcgttggagcaccccacctggggcacccaactccatttcctgccccgagccctccccactcgcctccagggagtgtgtgtcacctcctcccctctgccagccctgcctgcagccctcttctccgcccccgccyctgcccccagcctgcaaaaggtctcacccgccttcaaagggagctgaatcaacactgcagaaggaagtcactggggggaagaagtgaaaaagaaaaaaaaaggcctacgtgggggcagggttgggaggagaccagagttgggttgcaggggaatttgcaggcaggttggagggtgggcgggagagggaagtgtggtgagtgactgggagggagcagcggttcccgggtggccccagggtcctcgtggrggtgctctccaggcagraagggactttctgccacttggacatctccctgtggggccagaccccaggggtctccagggctggttagactcctttctcatcccttatgaacctcactgacctgactcttcccttggtgctgccaaaatattgcagctccccaagcacctctgtgaagtgagcctggaaccacccyctccccactggccctctccatccttagcatctttcttgaccttcaaaccctgstcctatggggtctcctccgtggaaacttccagaatcccacctgtcacagagagacctccttcccaagctctggggttgtgtgttatgggggtggaagctgggcgaagggaagctggggggcccaggccagtgtccaggatgggagggcaggagagcagccctcaggctctgaatctccttccccatctatgctcaccggctgcccccgctgcctccacgtgtggacgctgggggtccctctcatctgccttgtgtcatggctgacatgcttgtctcctgaactcgatggtctgttctggagctcagggtcgggcagcctcagagcacgcaggtctgccaggcaagcacagggaaaggctcaaccaaccaacccctgatgacagcaggt

SEQ ID NO: 13426 - DNA, 17455 bp, Homo sapiens
caaagtgctgggattacaggcatgagccactgcgcccagccgacctcatcttaatttaactaattacatctgcaaagatcctctttccaaataaggtgacattcttttttttttgagatggagttttgctcttgttgcccaggctggagtgcaatggcgccatctcggctcactgcaacctccgcctcctggctcaaacaattcttctgctccaggctaccaagtagctgggattacaggcgtgcatcaccagacccagcaaattttttgtatttttagtagagatggggtttcaccatgttggtcaggctggtctcgaactcccgatctcaggtgatccaccctcctcagcctctcaaagtgctgggattataggcatgagccaccaaacgtggcccaaataaggtcacattctgaggtcccaggtgaacacgaatgttgagggagatgattctattgcaaaaggtcttttataaatttaaatcagggccaggcgcagtggctcatgcctataatcctagcacttcgggaggccaaggcaggaggatcgcttgagcccaggagttcaagaccagcctgggcaacataaggagaccccatctgaacaagtaaaaaaaatagcaggctgagacaggaggattccttgagcttggagttcraggctgcagtgagctgtgatagcgccactgcacttcagtctgggcaacagagcaagaccctgttggctctaaataaataaatgcatgtgttcctttcctagaccttccctatggctcccattgcacatagaataaaattccaaccctggcccttggcccrcctctccaccccgctctgcctctactcaccccatatccattgcactccagacacatgaaccagcttcctcctgctcctcaaacacaccaagttcactccagcctcagggcctttgaacaccctatggcctctgcccagaacaccttcctctgggaacacctctttccagtctttttttttttttttttgagatggagtctcgctctgtagcacaggctggagtgcattggcgcgatcttggctcactgcaacctccgcctctgacgttcaagtgattctcctgcctcagcctcccaagtagctgggattacaggcgtgcgccatcattcccagctaacttttgtatttttagtagaggcggggttttgccatattggccacaccagggtggtctcgaactcccgacctcaagtgatccacccacctcagcctcccaaagtgctggrattataggcctgagccaccgcgcctggccctctttccagtcttaattccaacacgagtcacctccttgtgacttgtaggcctctccaactccccagaccaagttataccctcccagcaccagcttcctcacttttccctaatctgtgcgcttgtccaactcaaaggcagctattggtcaatgcagttgagtagctgaaggaaggaatgcctggatttaccatcaggatttttgtttttggagacaggatctcrctctgttgcataggctggagtcaagtagtataatcacagctcactgcagcctccatctcctgggattaagtgatcccccgcctcagcctcccgagtagctgggactgcagatggacaccaccacgtccagctaatttttgtattttttgtagagatagaatcttgctacattgcccaggcaggtcttgaattcctgggctcaagtgatccttgtgcctcggcctcccaaagtgctgggattataggcaaaagccaccgcacaccactgagttctttttaaagctaactttttctcttttttaattgaaaactaattgttatttagttgtttatttattttgacaggatctcgttctgtatcccaggctagagtgcagtggcaaaatcacagctcattgcagccttgactttttgggcttaggtgatcctcccacctcagcctcccaggtagcacaaccaaacccagctaatttattttttatttttattttttttgagacagagtcttgctctgtcgcccaggctggagccaggctgcagtattgtggcacaatcttggcttgctgcaacctccacctcccgggttcaagcgattctcctgcctcagcctcctgagtagctgggattacaggtgcccatcaccacacccagctaatttttgtatttttagtagagatagggttttatcatgttggccaggctggtctcgaactcctgacctcaggtgattcgcctgcctcggcctcccaaagtgctgggattamaggcatgagccaccgcgcctggcctaattttattttattttagtttttttgagactgcgtctagctttgtcacccaggctggagtgcagtggctcgatcttgttgcactgcagcctccatctcccgggtcaagtgattctcctgcctcagcctgcagagtagctgggattacaggcacccaccaccacacccagctaatttttgtatttttagtagagatggggtttcaccatgttgcccaggctggtgttgaacttctgagctcaagcaatatgcccaccttggcctcccaaggtgctagaattacaggtgtgagcctccgcacccagctcaattttctttctttttttttaaagacaagagtttcgctcttgttgcccaggctggagtgcaatggcagaatctcagctcaccgcaacctctgcctcccagrttcaagtgattctcctgcctcagcctcccaagtagctgggactacaggtgcctgccaccatgcccagaaaatttttgtatttttagttgagatgaggttttcagcatgttggccaggctggtcttgaactcctgacctcaggtgatccacccgccttggccttacaaagtgctgggattacaggcgtgagccaccgcgcccggccacccagcccaatttttttgtatttttggtagagacaaggtgttgcaatgttgcccaggctggtctcgaactcatggagtcaagggatcctcccacttcagcctcccaaagtgctgggactacaggtgtgagccaccatacccagcttccatcagtctctttataaaattaatttttaatcataggtaactctagaacatatcctcatatgtctaattgggaaaaattctcattccctctctttttccatagcggtccctctgataagtcagacacggaaaccatgaagctcctactgactgacacgtttccgtacatatatacatcacttggcctgctgctttatgattttatcttgttttgctttgcttttacgtggatggagtcacatggcgaaagtcacacttactgagaattctcatccttagttttcatttgtgagcgttcaacatgcatctggcgagttctccatttttttctggctgtaccacattccttgtaaacagattcataggattccatggtgtggataaaccagagtttactaagccactccctgtcagtgggctttaggttgctttctgttttcctgcttttatacataatacgatggggagcatccctgtttgtactttcttgtacccttgtgcagatggttcctgagggtagatctaaaaacgggaaataggccaggcgtggtggctcacgcctgtaatcccagcactttgggaggccgaggcaggcgaatcactcgaggtcaggcgttccagacctgcctagccaacatggtgaaaccccgtctctactaaaaacataaaaattagccggatgtgctggcaggcacctgtaattccagctactcgggaggctgaggcaggagaatcgcttgaacccgggaggcgraggttggagtgagccaagatctcaacactccactccaacctgggtgacagagtatgactccgtctcaaaaaaataaataaataaaaataaaaactggaaatagggccaggcacggtggctcacacctgtaatcccagcactttgggaggctgaggtaggcggatcactacaggtcaggagtttcagaacagcctggccagcatggtgaaaccctgtctctactaaaaatacaaaaattagccagacgtggtgtggcccacgcccgtaatcccagctactcgggaggctgaagcaggagaatcacttgagccgaggaggcagaagttgcactgagctgagattgtgccactgcactccaacctgagcaacagagcagactctgtctcaaaaaaaaaaaaaaaaaaaaaagccagtggtggtggtgcacacctgtagtcccagctactcaggagggtggggtaggaggatcgctggaggccaggttgcactccaaactgggtgacagagtgagaccctgtctcaataaacaaaaaatggaaataccaggttgtaaagtctgggtgattataattttactagcctgacaaattgccttccacacggggacaaccagcgtgccttcccaccagcaayagctcactctgcccatttccccacatgtgccacagcactgggagttatcaagttttttttgtttgtgtgtgtgtgtgtgtgtgtgtgtgtgtgtgtgttttaaagagacaggatctcactctctcacccaggctgagtgcagtggtgcaatcatggctcactgcagccttgacctcctgggctcaaacaatcctcccgcctcaacctcctgagtagctgggactacaggcacgtgccaccacctctggtgattttttttcatctttgccaacctggggagggaggagagtgttgttccatcttgtgggttgctggtaaggtcttcccttggatttggatgggtgctgtcaccttggtctacggattgcccctctgaccccgttttggtctctctcttacccgccacgccctgyggcttagatatctctgcgactttacstactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctgggrtgtggccaggaaaagacaagctcttcagcttggggatccgatctggaagagagattctgatctgcccacctcctcttcctycttctctacaaaagctccggttgattcgagggaagtggtgaaaawttttttttctcccattttcctccctgcatctggggacacagctgccgtgaccagggaggccagcctgggaggtccagatgcccagggagaatcttggtctggtgaatccatgagctgmgataccacggctggggccatatgttcacctgctttcctgtccgttggtgaaggaatttcagaattcattttatatccaagactggcttttaccaaatttaaaagcctctcaatgcgtcctcgaccttgaactgtgctcaacagcctggccctttctggggccaccctgggatatggctggcttgcttgcttttctttctttctttctttctttctttctttctttctttctttcttgctttctttctttcttgctttctttcttctctctctctctttttttttttttttaaatagtgctagtttgggcacagagtaatttatattccctttggttaaaatgcaggctttttagccaacaacaaaagtgttttccccccacccccactcrcccaccagggtgatgccacttttgcctcctgccctgaaaattggacttaagatgccatgtcttggccrggcgcagtggctcatgcctgtaatcccagcactttggaaggccagggtgggcggatcacctgagatcaggagttcaagaycagcctggccaacrtggtgaaaccctgcctctactaaaaatacaaaaattagccgggcrtggtgatgrgygcctgtagtccyagctactcgggaggctgaggctggagaatcgcttgaacttgggaggcagaggttgcagtgagctgagattgcacagctgcactccagcctgggtgacagagcgagactctgtctcaaaacaattggacttaagatggcatgtctttgttttagggccaaaaatgaggcccccttgcttaaggcatggggtccgtggccaggcaacggggtgggactgctgccccagatgtggccatgggggtcgtggtcctttcaacaccaagctatgagctgtcgccatggagaccagggccacctgtggaaaggcggattttgtctgcttttgacttttcttttttaatatgtaaaactccacatcagcggaaamccccccctacttctggcctggagcttcagggttttggtgctgggacgagtttgttgttctccttagcggggtggcgcggggggctcaaaacgggggcgcgggggctggagttggcagagctctgcatgtcccggcatgtctgagcaggaggaattccgggcggccaaagggttttatgtagattgcttttggacactcgcccaggagtcaggagttgatttttatctcacttcctggtaaccttgaacttaccaggcagggatgagatgacgtaaacttcctcagatgatgtaagttcagccacatcttgctgcccattagggagagaggacgacccccacagtgaaagtaattgagtgaaatgcacgttctggaaatcagtttctattttggcctggaggaatgtggctatactgcttccctgagtgtgacacagttggaatctaatcttgttggtttcccaacatctaggtttttgtttgtttgtttgtttttatgatagggtcttgttctgttgaccaggctggagtacagtagtgtgatcatggatcactgcagcctctacctcctgggctcaagtgatcctcccatctcagcctcctgagtagctgggactacaggcatgcaccaccacacctggctaatttttaaattttttatacagacagggtttcaccatgttgcccaggctggtctcgaactcctggactcaaactgatcctcctttctcggcctcccaaagtgctgggattacaggcatgagccactgcacccagcccagttctttcttaaaacagctgagagttttgttttcttcagcgttcaccttccttgtctccagttccgatgctggcagtggttcctacctctgttgggtttctagatagtttgggaacggggttgatgggtttctgtgaaacacattttccaagtcttgggctttctctggaggggaaggtggatgctggcgggtgacttgcagtgggcgcctggcagtgggtgtggactgtaactgacaggtggaaatgagtagggrcactattgttccctccatgccagcttttttttttgctggaaatgccccctccacacccctggtagctctgtgtcctgagaaatccagagtgtgggagacatcactgcatctgtccccccagcttctgtgaagggaagctgtggcctcttttgaatgtggggaacaactgaagactcaggggtcacccagaggtctggtggaaagcaacttcaggtttcatcttgctctattcctcaaaggtctggtctgtgggcctctgaggagaaaacaggtctagccaagacagggacaaaatggggaaggggrtgtgccaggcctgaactgagctaagcacctgccccgggctccacacttccatctttyttttgtyttcatttcacctctgtgtttaaagcactgtgtgacatagctccttagagatataacctattgtctgctcattgtcacgtgtgtgtgtgtcatctttgtattcttgcagtggtttcacatttccttacccagtcaagccagtatcccatccttcctcataatgcacaacatttggctcattttatttttctcattgttattttttatttttattttttgagatggattctcacactgttactcgggctagagtgcaatggcgtgatctcggctcactgcaacctccacctcctgggtttacacaattctcctgcctcagcctcccgagtagctgggattacaggcgcccgtcaccacacctggctaatttttgtatttttagtagagatgcagcttcaccatgttggccaggctggtcttgaaatcctgacctcaggtgatctgcctgccttggcctcccaaagtgctgggattacaggtgtgagctactgcgcctggccaagttttttacaaatatttttcttttggtggaactcatctgtgcactctctggtgtgtttttccacctttgttgggtcttggcttaaaatatcctcatgtgggctaggtgtggttactcacacctgtaatcctagcactttgggaggttgaggcaggagaatcccttgagccaggagttcaagaccagcctgggcaacatagcaagagatcccatatctaccaaaacatacaaraattagccagatgtggtggtgcatgcctgtggtcccagatactcaggaggctgaggcaggaggatcacctatgcctgggaggttgaagccccagtgagccatgatcacaccactgtagtccagccygggtgacacagcaagactctgtctcaaaaaaaaaaaaaaaaaaaatcctcatgcaagaagggaaggaccaagtcccattccctcttgcctcattttcagagcctggggtaggggctacaggtggcataggaagggtctgcaaggtgggtgggacttggcaggtgttgggaagaggaataggggtggcaagtgtcaatggtgaaaagacaggctgaggggtgtggtgggaaggctgggggagaaaggtgagaagtgattgggggggcttccctgatgagtcctcatggagggtgctgaggcagggaacaggggtgcagggacagtgatcagggcacctggtaccctgaccaacttgatgatggcatctcttttaagatgcccaagtctgcgcacttttattcctttattcggcccctagcaccccctccccaccccaaagaaggtcagtwgcatgcgtgtggggatgtagctcaaaaaagaaataagatggagtggaaaggaaagaaaggaagaagcaggaattcaaggtgggtgggctgagcttggggccacctagcccacctgctccaatcaagggctggaacaaacctgaggccacttggagaggcagggctgggcagggacagggggtgggggccgaaatcacagcttccccatcagagccagatgtgtgaaggaaatgtcccagatggcagtagtttctcggcaaggaggggaatcctggagatggttcatgtctgtgatcccagtgctttgggaggctgaggtgggaggattgcttgagcccgggagttcgagaccagccctgggcaacatggcgagaccccatctctacagaaattaaaaaaaaaaattagccagttgtggtgtcaagcacctgtagtcccagctacttgggaggctgagttgggaggcttatctgagcccaggaggtgaaggctgcaatgagccatgattacactactgtaccccagcctgggcaacagagcaagaccctgcctcaaaattaagaaaaaaaaaaggggggccaggcgcagtggcttatgcctgttatcccagcactttgggaggccaaggcagactgatcgcttgaggccaggagtttgsgaccagcctggccaacatagcaaaaccccatctctactaaaaatacaaaaattagtcaagagtggatggtgcgtgcctgtaatcccagctacctgggaggctgagacaggagaattgcttgaacctgggaggcagaggttgcagtggtgtgagatcacgccactgcattccagactgggcaacatagcaagactctgtcacaaaaaaaaaaaaaaaaaagaattccctgctctgcttttctgctcgttgctggcatagaaacatctagaacagaaagtatccactctggggcagatgggagagctggaaaagtagattcaagatgccttttagtcttggaagtttcttccaggaagcaagaccagctggtatgtttacacctgcactccagtgccctggggaggtgaccaggtggagggggatggctcatggaaatctgtcccgcacagctggcccccttttggctgccactgtctagactgttggcctttgacctctctgcctcttgtggcgtctgaacctagacgtcccttttggagacagctggacaaagccctattctccgcagccccagcctctatcctgaggcctctgggagcygcgtgacggccagcatggggtgctgatcatggtcaaggaggcaggtctttgccaggttgccccatgcagccacccatcctcagcatcctaacttgagggggcaggagagggctttgtttttataatccggattaaatttcccttccctgggcacaagtgcctcatgagggcccggggctgctggttgggagggaaagcatccccgtttttgcagtgaggaggcyggccgagggctggggttccacttagacccttggcagaatggctgttgaggggcaggcgctgcccagtgcccacgtctggaaagctaattcccgggtggacgctgaacatacctgctgagagactctgtcccctggtttccaggacagttgtcacaagctgagtggggggggactcccaggacttgagggacccagtcccaccccaaactgctccccctcccccaaattccctttctcctcctgctctttctccccgctgtgcctcccccagttacccacagaagtgcctgcctctccagygctcacagaacacacaaaaagggacaggaattggtcactgggtagtggccgtggctcctgacgatccagaccagcgtctggcccaagccattcagaggtggggtctggggcctgggggttttgtgtcgtgacactttgtctcaaggagattccacatagggatttgaattaggctttctgcttgccaaggcctgtggcatctgagcctggctgagggccgggcaagcctcccctgagcctttggaagccgagttcactctctgcctgcccaggggagcaccggcttggttctgggggctcctctaacatctcaggtttttatcttgtcttaaatttctttctaggaaaaaacccttccctgccaaaggtgactgtgttttctgccgccgaaggagggcccggtccctccaggctcagtgtggcttctccctgaccccygccctagaacttttgccagtgccttttytgaaactcctgtgtcccgggccccccaggcggagaaggatatgccggattctgcctggggctgggctytaggagaccccaaatttgacaccacagaaagcaaataaaacacttgaaatacgcawacatttcctgtgtgtccttttgtggggctggagttcagctgggtgcccggggatagaggggaccccgtgtcactgggtttctattctcggtggtgctgggcccagggcagctggtgaccatgtgctgagtgagcgagaggaggggaattctgcctccagtggtctccttcctcaaaatcagaggcctggcccagcgcagtggctcacacccggaatcccagcactttgggaggccgaggtgggtgaatcacctcaggtcaggagttccagaccagcctggccaacatggcgaaaccccgtctctactaaaaatacaaaaattagccaggtgtggtggcacgtgcctgtaatcccagctactcaggaggctgaggcaggagaatcgcttgaacccgggaggcggaggtcacagtgagccaagatcgcaccactgcactccagcctgggcaacagtgtgagactcagtcycaaaaaacaacaacaaaacccgcggacctttgttccaacacacagggaggttgaggaacttgcctgtggtaacacaggcactggggtttgagcgatgatctgcrtcaacctccagggcatacaaaatccccatcatggctgggcacggaggctcacgcctgtaatcccagcactttgggaggctgaggccggtggatcacctgaggtcaggagttcaagaccaggctgaccaatatggtgaaaccctgtctccactaaaaatacaaaaattaggccaggcgcagtggctcacacctgtaatcccagcactttgggaggccgaggcgggcggatcacaaggtcaggagatcaagaccatcctggctaacacggtgaaacctcgtctctactaaaaaatacaaaaaattagccgggcacggtggcaggcacctgtaatcccagctacttgggaggctgaggcaggagaatggcgtgaacccaggaggcagagtttgcagtgaaccgagatcgcgccactgcactctggcctgggcaaaagagcgagactccacctcaaaaaaaaaaaaaaatacaaaaggtagctgggtgtggtggcrggcacctgtaatcccagctacttgggaggctgaggcagcagaatcacttgaacccggcgggtggaggtttccgtgagctgagatcacgccactgcactccagcctgggcgacagagcaaacaagactccacttcaaaaaaaacaaaaaatccccatcattctgacaggggatgccatgccattgccacctttacagacagggaaactgagtttccaccagttgaagccccttgtcccctatgtcacggccagggagagtaggggtgggaatgtgaacccaggcgggcttctctggagcggagggccttgaagaacacaaatggacatgttcattccctacgcctgtcctcagcaggaatgaagacaccctggtctctggctctctgagaataaacttttgacaccaaagggacttggacaacagttaggaagatgtcctggagcaagtggaccccgtgggttgggggaacttcttggastcacagaggactgagggttcttgcacccccagtggaggtattcatatctgggtggtctttcccatagggtcgactcttattattgttatttaatgtagagacagggtcttgccatattgcccaggctggtctcaaactcctgggcttaagttctctacctgcctcggcctcccaaagctctggaattccaggcatgagccaccatacccgtccctttgctgtcttgagccttagtttacccatttctcgtggggcttttgtggcaattcaatgagattctgcttttacagcccttaacttggagcctggtgccctgtcattgctcagtaaatacaatgatcagggtgtgggctctcgcttataatcccagcactttgggaggccaaggcgggtggatcacttgaggtcaggagttcgagaccagcctgggcaacatggtgagaccccccccccccatctctacaaaaaatacaaaaattagacaggtgcagtggcgcacacctgtagtcccagctactcaagaggctgaggtgggaggatcacctgagcctggggaggtcaaggctgcagtgagtggtgatcgtgccactgcactccagcctgagtgacagagtgagaccccatctcaaaaacaaaaacccggtcgggtgcggtggctcatgcctgtaatcccagcactttgggaggcaaaggcagatggatcatttgaggtcaggagtttgagaccagcctggccaacatggagaaaccccatgtctactaaaaatccaaaaattagccagccatggtggtaaacacctgtaatcccagctactcgggaggctgaggcaggagagtcgcttgaaccagggaggctgaggttgcagtgaactgagatcgcgccactgcactccagtctgggtgatagaatgagactccrtctcaaaaaaaaaaaaaccccacaaaataaatacagttaccatcacctcctcttccaggaagccctcctggctacctaggcatctcctctgactcctacagctgcctgggtgtccccattgtagcactctgggtggtaattgacagcctctgtgagagggtggatgggtatgtgtggggccccctctgtgtcttctgtgcccagcacagtgccagggacacagtagggaagcaataaactgctgrgaggagagstgagtgctgtgggtccactcctgaggccagccaggggctcagcaaggcaccaatgcctcctcccaggagtgaaagatgctggaatcaccaggctcctcctgcagtctggggtccccacctaaggaggcccctcaccccgtggctgtcccagtcattcaggaagtgtccactgtgggctgagccctggactggggacacagcaaggatcaggcagctgggagtacagcctggaggwccccccttgggatgagggctgcacaggcagttaaagggtccaaggatcatcccaggatatggctgagaggctgcaagaggctccatcccctagaggccccctccgccctcgcctgggtgctcccagccttactcaaaggagcaggtcggcccggtgcgttgtctcacacctgcaatcccagtgctttgggaggccgaggcaggcggatcacttgagcacaggagttccagaccagcctgggcaacatagcaagattctatctctacaaaagtaaaaataaatcttataaagtagctgtggactgggcacagtggctcacacctgtaatcccagcactttgggagaccaaggtgggcagatcacctgargtcaggagtttgagaccagcytggccaacaaggtgaaaccccatctctactaaaaatacaaaaattagccaggcatggtggtacacatctgtaatsccagctactcaggaggctgaggcaggagaatcccttgaaactgggaagcagaagttgcagtgagctgagatcgtgccactgtactccagcctgggtgacagagtgagaccctgtatctaaaaaaataaaataaaaatgaaaagatgaggatcttggcctccattcttgcccttccactccattccaactgctgagcctctcacaccctctgtggctccctttcgcctacaggaaataggatttctgtactgggcatttgaaccccattcccttgtttctgctgacccccagcagtctcaatatcccctacttcctcttcccagaaccaccctccccaaagcccttatcgatgcttggaggattcctatgcatccctcaaaatccaaggtttgggaaagatgctgcagtggtctcaagacatcctcagtgtgatgacagcctggggtgggggtaagggggcaaagtacagcaccagaaatcccaactgagtccccccacacgtcttccaccttcccaccctctctttcgggttctggctccctgcctccaggcaatcaccagtttttaccaggagtgcctcagacctgcccggacatgtccaagtcccctagaagcagggaggggtgggtgaggctgtcacctctcccttccctgtatggtgctgataagggcgtggggaggcagagacaggcagagatagacatgatgagagacaggcagaaatggagggagagccagggagagakagacacaaagagaaaaagtggaaattctccagatattttgtttagggtgaggacacggagacacagagagggacttagccagctgaggatgacgatttgggatgttaggtcacccaggtgctgtgctgtgtaactcaggcacagagctgccctgttccgagcctcagtttacccctgtgactcagagcagatctccatacccccatcacagggctgtgtatccgagctcagccagagcctggcatgcagtaggtgcttcataaatacacactgtggacagtagaattatgatgggagcgagcgtgtgaactgggttgctaatgtggagcgtgaagrgggaggcccagggttactcggccaatgggttccgggcagcaagcacgtgggggaagcctcagctgaccacttcctggccagtttatgcaggaactcgcacagccggtccctgaggctgagcccaccacttccgccccccatggtcccagccctgctgactcatactcagctgccacggtccgctttccctgctgagcacgggggtgggggcgggggggaagagggggagggaagggcacctgaccgaggccagaggcccagaaaggacagaaggtcatggctggggagaagcaggcaggagaaccgagtcttggccttaactggctggcaacgtaaaacctgccctccacaaggacaagatgaaaacttggggatttggaggggacaacaaattagactcaatcacaatttcaaacttttggatgtcaatatatccatcaagaaattgaaaagaggcctggcatggtggccgatgcctgtcatcccagcactttgggagaccaacgtcggaggatcacttgaggtcaggagttccagaccagcctgggcaacgtggtgagacccsgtctctacaaaaaaatttaaaaattagctggacaggggccaggcgcagtggcttacgcctgcaatcccatcactttgggaggccgaggcctggatgacagtgagagactctgtctaaaaaaaaaaggacaggtgcggtgsttcgcgcctgtaatcccaacactttgggaggccaaggcagatggatcacctgaggtcaggagttcgaaaccagcctggccaacatggtgaaaccccatctctactaaaaatacaaaaattagccaggtgtggtggcgcatgcctgtcrtcccagctacttgggaggctgaggcaggagaatcacttgaacccgggaggcagaggttgcagtgagccgagatcgtgccattgcactccaggctaggtgacagacagaaaatcttgtctcaaaaaaaaaaaaaaaaaaaaacccaccagagataaaaatgggcagcagatgacattgtttacataatactgaccacaaacttgatgtcctaaaagaacagggacttctctcagagttctggaagccagaagtccgaaatcaaggtgtcacagcaggactggttccttctggaggctgtcaggactcagaatgtgatactccaaagtatggctccttggcaaaaactttgtggtttttgtttttagagacagggtcttgctctgycacccaggctggggtgcagtggtacaaygatagctcactgcagcctctacctcctgggctcaagcaatcctcccacctcagcctcccaagtagctgggactacaggcatgcgccaccacacctggctaattacttttatttttgtagagatgaggtctcgccgtgttgcccaggctggtgtcaaacttcttcttcttcattttttgtttttgagatggaatctcgctctgttgcccaggctggagtgcaatggtgtgatcttggctca

SEQ ID NO: 13427 - DNA, 12792 bp, Homo sapiens
aaaaattcacagtgaactacttaatggagtgaaaaatgtaagttttcttttagtgtataaaaatcttattttaaggccagcacagtggctcacgcctgtaatcccagcactttgggatgccaaggcgggcggattacctgagctcagaagttcgagaccagcctggccaacaaggtgaaaccccgtctctactaaaaatacaaaaattagcagggcatggtggcatgcacctgtaatcccagctacccaggaggctgaggcaggagaatcgctggaacccaggaggcagaggctgcaacgagccaagatcccgccactgcattacagcctgggcgacagagcaagactccatgtcaaaaaaaaaaaaaaaaaaaycttattttaaaaacatgttttcaaagaagaaaaaactactcaacaaaacctagatattgtaatatcctatatattaaggctctaatttaagaaaatgcaatatatggaaagatagcagatactttaaatgaaaaaaaatttgcataaataatggatatagtatgcaactatttctgtatcaacttaacaacaacaaaaaactgcaactatatatctgcacagtagtagggtcagagaaaggaagtctacataaatgccaaaataccaacagtgatcacaactgaggtacggaattagaaaattggagtccttttcaatttatatgcaacagtgttgctcaaattgatattgactacatatcactcttttttaaaaaaggtggaaaatatgtaaaaatttgaacttatgtaacagataaatcraaagagtaaaaattcctattacaaaaggagccattattttgccaagtgatttgctacagacttttatttcctcttaattttctgaggggagaaaattctaatctaatctaaccactaaattatatgagagactcatctatctcacttaaatgtactatgaatatattataattaagactttaacaaaatagggttagtttaagaaacaccttagctcaatggataaaaatacttgaatactgataaacaaattaaaggaatttagcagaattaaaggaagggaagaagatggaaataacgggcaatgctctgaagccttaattaccctctacctcactgctcatgaagaggaaagtttctgttcacctaagatctgtagaaagcattctgactctcaatggtttcctgctatcctaagtcttcttggaggattaaaaatgggtacaaaaatctttcttgatctccttaaaaaaaaaaattcatattaaatacctagatcttcaatactgttgaatgttacactgagtctggtctttatttcctagtaaggagttccagaaaggtattccagacttaaggatgtgtttgcagacaataatttgtaaactgcatagaaagcaacaaggggcactggggagagggrtatctgttggggaaattataatagtctcggctaaaaagtaacaaagacctcaattagcagagtcaacatgaaaaacagaaagaaacatttgcataggattataagaggaccaggacgtcagaaaaccaggagaacaatattacacacaaaaaaggcaaactgctttaaaaaggagagtgttattataagggaaagtgccatagagagtgttattataagggaaagtaccatagagactgaacaggatcaaagattaggaggagataatgatctgactgtggagactctaacctaggacaaacagccttcttcaaaagaacttttcctctttaggatgaaagggaagtgaaacacagtgagtactcacttcagagagcactagaatggccagaacactcagaatatattcgatccattcttgttttattctgaatataggacaagaaagccaggagcaaatcctacatttcaattattccttaaggtcctcaagaataactccaggattttyttggcctagcatcaatattccctttagaggaaaacaccaatgatgttctttaaactctatttgtctatgcttgttttgtgtttgtattggtagaagctttttttttttttttgaaacggggccttgctctgtcatccagcctggagtacagtggtgtgatctcagctcactgcagccccaacatcctgggctcaaatgatcctcccacctcagcctcccaaatagctgggactacaggcatgcaccaccatgcccagctaatttttgtattttttgtagagacagggattcaccatgttgcccaggctggtctcgaactcctggcctcaagtgattctccaacgtctgcctcccaaagtgctgggattmtgggtgtgagacaccatgattggacaagaagcatttattttaatgtttaaaattataaactggccaggcgcagtggccaacacctgtaattccagcactttggaaggcyaacacaggtggatcacttgaggtcaggagttcgagatcagcctggccaccatggtgaaaccccgtctccactaaaaaatacaaaaattagcctggcatggtggcgcrcacctgtaatttcagctacttgggagactgaggcaggagaatagcttgaacccaggaggtggaagttgtagtgagccgggattgcgccactgcactccagcctgggtgacagagcaagacactgtctcaaatagtaaaataaaggcttataaaaagtaaaatataggcttttgaaaacttcttaacatatatatttaaaatgcctttaaacaaaataaacagaaaaaagtactaatgccagtttcctcaacaataaaatgaaaataatacrtaacttactgagcagttatagggattaaattagatcattttatatagaaagcgcctacaatagtccttggaacacaatacaggctccactgtgtttgtaaggtgaccttttctaagctccttaagactgaagtcrtgtaattagtaaactagacagaattcagatgaaagagtcattttatgtttgcttgtttacttatcaatcattaaaagtatatgtcctagccaggcatggtggtgcaagactgtagttccagctacttgggagactgaggcaggaggactgcttgaacccaggagtttgaggctgcagtgagttgtgatcacaccactgcactccagcctggaygacagagagaccctgtctctataaataaataagtaaaattttaaaaaataaaaataaatagtatatgccctgtttaagcaacagaatggggtattaaaatattaggagaattggtttctgcttttaaaaatacactaktctcaatcactgaattgattatataacatcatgcttgacttgaaccaaaactaggtggaatttgaaatatgttaaatatgcattagaaggaaatcrtaaataacataaaatacataagttgttaaaaaaaaaaaaaggaaatcattaccaaaattcatcaaccattaaatccttaccttgttttgacaagaaatggctgcagatcctgmaggatattccctgtttttcgcctaacttctaaatacaggtttggtcgatcaaaaccagtacaggtgatctgaggatttctcagatttaagcaacgtacaatgtcttcccggattgaaraacttgcagtagcagtaagtgcaacgattggaacctgaatgatgtaaaactgatattttaaaaaggaaagagctcattcattcccaacatgtctatagctttcttacaaagagactggtaggacaacagtttgtggtacaatgttaaagacacaactgtaaaatttttttgcaaagaaaaaatctccctactaacytgtttctcagccttctggawacaatatttactttttaaaaatcagaaatcatttaaataaaacattaaatccatgakgtttccaaatgccatttactttgtcttattaaattaagcctacttgttagctatctacttctccatttattattttttaacattacatttgaaatggtgctgatataagcaggggggtatattatgccttatatttgattaatgtataattacaaatgataaactctcaattcactgaaaatctaactatataaagcaatggtcgtttttttttggcctcctatttkaaatatatasgtttatggcwtcacaaatctagaagcaaagctccaatgacccagataacctctcttcagtggtactgagataatcaataacatactatatataggaaatatgtataaatgaaacgtattattaattgattgctagcaaaggcttcttgactggattggcagacasagcaggagactcagcagttatcaggaaaagcatgaatatgtcatcttccagaaattctaargtacrgtaacaacatgcctcccctaaaactagawctsgtgtttttattctattataggaaattacacttaactatggtattatttcataatcagaaaaagtggactgtcttacagttgtttctaaattatcagctgttctatcaccaagaatataactttcttaaaaatattctttttggctcgtgacagatacaagaaacaatattctcataaaatagctcttcagatgcactgcatctattatacaaaccaaccatagcaattatcttgtatataagtggaaatgtatgtgcaatttaccaatttgcraagaagcacttctagaatatgactsaaaattaaaacaagatcaatttattaaaaattataaactaytttttcaatcactataactttactgaattaaaaattatctccaaacttatatttaaaaaaatcaattaagtttaagagtaggttttttcaaattaaaaaaattaaatcaaaactaatgtgatgagataattggcatcatttttgcattctttatccttaaattttgtgacactattttaaaaggcaaccccaaaattaatttcattgatttgtggcttacaatcagattgttctctgaatttacagtgcctgcctagcaacttaaagatgaacaagctaatctataaagaggttggtttctctaattaacccctaacatgggtgcatctgtgttaacacacaggttttaacaaatataaggctgagaataagggaggtttaaaaattagaggttcttagaacatgcacattctcactctcacagtaaagcactttcaccggttaagtgttttggttaaataatttatataaatgcactaataaaacacttgtttaaccacatattaaaaacagtgattttcaggatacagtccataagaaaacagggttgggtttgtttctaagcaatataatgtataagtgagcaggtaatatatttatgaaaatgaggaagtaagcatgaaacatgacatatatttaagaagttaacagaaaaaccaggcaaaagaatggcagcacagtgaaaaargtctgttttggaatcagattgcttgagctgaaatcctgtttttgccacttactagatgtgagattttgagctctttatttaactctctaagcttcagtttcctcatctataaaatggctacaataacagtgccaatctcataaagttgtgaatatcaagtgagataaaacatgtaaagtgctgaacataatgcatgaaataaaatatagtaagcactcaaaaagtttcaactatcataaatattgttattaaaataaataaaaagaattctatataacaacttcagagacatgagtactactcccagatttgcaactgacatttgcaagggctcagttttttcagcaaaaaaaatgagatggagacggctatatgatgtgttagacccttccaacttaaaaattcccatcttgctaccagaaattccctattccagcaatctggtaacagtgaaaatcactataaatttactcttttgcctcaacattctagaaagatatagctaagaatgttgcttctacaattagaaaataaagtatcagactatattaaaaattaatagtacttcgttactactaaacragctagtacttcgttttcattggatacattttcagcatcatgagttgtcacagcctctgagcccctgatcttaagccacaagggctgagtgtattgtaaacttattcttgcatgttgctgtctgggaatagaccacactacagctggtagttctgggggcggtactgccgaaaggcctgaacacatgtattttggctgcaattraggaacttgggatgctgactattaattttgtatttcagcaactgccccttctcctatcccaaagaaccaattactgccctctgcctcagcagtaccagtataagatgacattccaaagactggaggcaactcagcctgagttaattcacaaaattgtgccatgctggggcttgaacttgagcttgggcttaggcttgggctcagcttttgaccctcaggcatctcctttcccttcctgccttcctctcccttctcctctgctgcagcatgattttcttaatcttcagacactcactattttcatgaacarttaccctccggccccacaaccaaagacaactcatggcctcctttggcccttgtgtaacaytgcaaacctgtggctttgcaaaatgyacccaggtcacaaggggatttttttttttagcaatgatatccctttctgggtcactttttaagcttataaccagacttataatcttaaatgtatttttcctttgattaagctgctgcttcctctgtttcactggattgtgctagttatcagtggttcttgggttcaaagtaataagaattccaaaactggaaaaawaaataaataaataaaaattaatgataarcttccacttcagcaatgaatagaaccttttctcttataagtatgtggtattttatgacatttaaaatatataaactagagtgaagcttaaaaacaacacacaggcaggctgagaaaggtgacaatacatcctcatttgccaggacattcccagtttatgcctgcagtcacagcataattattaatagcttgaactctttaattttcagaagcaaactgctttgggtaataaattatactgtcatttagttcttaactcacaaaatgtattctttaagttgacaggtcttaatttcttttttaacaggcagcaagttttgctaaatcaaacaaccaaatataaattaatcttagacatatacttcaatggtgtggtgcccacagactgagaaaagtataaktwtcccacctgcttctaaattcaggtcatgttgctaattctaactttgtactccataacatcacacatacttcattcattcatgcactcattctaaatagttactgagtacctactatgtgctgatctttgtaatagatactggggagaaagtaatagaaaaaccccacatgtcttatggatttcacaattcctcttacttgaaatgtaaagaactttaagactgatgcaaagctttctgcctggctgttctttctcaacactcactttgtctgattccttccaaataggaatctttgtgccaaacagcttagtgatttctgctgtttttgaaattactgaaataatatagtgtgaaacattccaggtttatagcagttgtcctagtataactggaatcagaasgagaagaaaagcaccaagaacagtgagaaaaatgatactactataaccaccaggtggcatgtctcaccacttagctaataaagagggttcttgaaaacaccaggggaaaaacgttttytcagccactgctcggccaacaccctccccgcactggaggcccaacagaaggaatgtgctttattaatcctcccaagaaatgaaaatgatccaatgacgtccatggccagacataataaaagatttaattcaagcttaacaatgtttaagaactgtataaaatatttaaaactcctttaacacaatccttctagaatcaaaggcctaggaaaggattacagaaagtaatcttcctagtttccaaaagcttactttaaaccattctaaatggaatggaaatcggtcctccaggtgcactgtgcctagtgactttcaccacagaaatcccttctaaacatgtactactaacactgttcatctttttatattatttgtaccacttcataataccatatttcatttggtgctattacttctactgttataggtatgaatctaaactcctttactgaactatgagctacctgagggcagaaattatgttttatgcctctttcaaatcatttgctttagaaactagcaggatgttgtatggtgcagctatttatggcccaactctatactgcccactacctgttttggaaagtcactttactgattctcagctttctcatcatcattcattcattcattcaccccattataaattgagcacctcctataagccaggtattgttccagattttataaaccaaacaatcaaaaactcctccctacaaagaatattctagtgaagaagaactcacagaaaattaacaaaatataacacagtaagttagacagtgatagtgctatttttaaaacagcaaagatttacgaggaatgctgaatratgggggagggggaactaatctgatatttcaaatatggtggcccaggaggcctaaatccaagagatctgagagaagtatgggagaacatcctatagacaatgtgggggaaacgtattcagggagaggaagcagcaggcgcaaagcccaggcactgaagcatgcctggaatgtccgaagaaaaacaaggagggtggtgtggctgcatccggtgaatgaggagaccagtagagaatgagatcagagggaaaatggaaggccagattacatgaggatcggtaactcatcataaggacttttgcctttatttagaatgaaatggcatgctactagatggttctgagccgaagacatgatctatcagacttcatttttaaagtatcactctggacgctgtgttgaaacagaatgagggatgggaagagtgaaagcaggaggccctaaggagatggtggcccgtacctggggaatggcagggatcaagagagaagtgatttaattctgcatatattctgaagacctcacgagatttccttactgtttaaataaacagtggagtgtaagaaaaagagaaaagattgaggaaaattccaaaattttggccaatggagctgctgttaaacaagatggaggagagtgaggaaagagcagatctggagtgctatgcagaagtcaattaggaagaggttaagtttgagatacctgttggtcatctcaccagaggcatgttgagtagttatatagatgtgtgcctgtgtatacacacatatatatgtacatatattctattaaatggctaaaatgaactaatagtgacaacaccaaatgctggcaaagaggcaaaaacaactgaatcactcatatactgctgatatcagtctatgatggagataaaaatttgggagtcctcagtatagacttgatatttaaaactgtaggctggacgtggtggctcacatctgtaatctcagcactttggcaagccaaggcaggtggatcacctgaggtcaggagttcgagaccagcctggccaatatggtgaaaccccatctctactaaaaatacaaaattagctaggcatggtggcacgtacctataatcctaactactggggaggctgagcagaagaatcrcttgaacccgggaggcagaggttgcagtraggtgagttcacgccattgcactccagcctgggcaacaagagtgaaactccatctcaaaaataaaaaaataaaataacataaaactgtatgttgggtgaaatgaccaagaaaatgagtgcaaaggtaggtccaaagactaaagtttctggaaggccaacattaaaaggtcagggagatgagaaggaacaggaggctgagaataaagagacagtaaggaaagaagaaatccatgagtgtgtgctgtcctatgtgactactaaagaattatttcaagaaaaagtatgaagattttaatagctaccttgttgaaccatgatactaaaatctgacccaaggccagccacatcattggagckcaattcacatggtttgattttccctcaatataaacttgctaactagtatatttaatttatttttggtttgttctgttttaatatctgctccaaccaaactctgtgagataagctaacaaaagatactatttttgagatgcctctcaatttgctatctataagcaagattaatgagcaatgaaattgaactagacaacctaccaaaagaataacaaacaatttctaacacagtttactcacaaaattgtgaaatcctgggctcagaaggcaccattgcctcgctactaccaagaaaacttaaacataagccaactttattcgttcaaaattaatataacaggctagagaacccagaaatagacccacacaaatacacccacatgactttcaacaaaggggcaaacgcaatttaacaggggaaggacagcctattcaacaaaggatctgctgcaatttaatctattgggaaaacaatgaaccttgacttaaacctcacaccttatacaaaatttaactcaaaatggatcacagacttaaaacataaaactgtaacaattttaggaaagaaccacaggagaaaatcttcaggatctagggctaggtgaagagcacaatccataaaagaaaaaatgataaactggatttcactaaaatgttaaatatttactctgtgaaagacacggtaaaaagaatgaaaaggcaagctacaaagtgaaagaaatatttgaaaccacgtatctgaccaaggactcatatctacaatgtattttttaaactcttaaaactcaacagaaaaaaacaagcactccaattatgtaagaaatttcaccagaggcaaattagtatatgaaaagacgttcaccatcattagccatgagagaaatgcaaattaaaagtgagataccactcgacacctatcgaaatggctaaaataaaaaacagttgcaacaacaaacggtggcaaggataactagatcattcacacactgctgacaggaatgtagaatgctacagccactttggaaaacaggtttgtgacaattccttaaaaactaaaaatacactcctggacatttatcccagagaaatgaaaacttttatattttcaggttgtttaaccattcacccattaaagaatctctgaaggccgggcgcagtggctcacgcctgtaatcccagcactttgggaggccgaggcaggtggatcacgaggtcaggagatcgagaccatcctggctaacacggtgaaacgctgcctctactaaaaatacaaaaaattagccgggcacagtggcgggcgcctgtagtctcagctactcgggaggctgaggcaggagaatggcgtgaacccaggaggcggagcttgcagygagccgagatcgcgccactgcattccagccagggtgacagaaccagactgtctcaaaaaaagaaaaataaataaaaaaaaataaagaacctttgagatatgaacaaatgttcatagcatctttattcataatagtcaaaaactggaaaacaacccaaaagttcttcaacaggtgatcagttaaactgtggtacaaccatactgtggaatactctgtaataataaaaaggaacagaccacyraaaaaaatagtcatgtggtrcttaacggcatttctgtcaatgacagagcacatgtggaacagtggtcccataagattataatggagctgaaaaattcctatcaccaagtgatgtcatagccagcataatgtcttagcacaaggcactgctcacgtttgtggtgatgctgctgtcaataaacctactgcactaccaggcattaaaaagtatagcacatacaattatatacagtatataacttgatgaataataaacaagtatgttactggtttacgtatttacctatacccttttccattattttagagtatactcctcctacgtattcattttttaaagttaactgaaaaacagcctcaggcaggtccttcaggaggtatctaggagaaggcattgttatcacagatgacagctccatgagtgttactgcccctaaagaacttccagtgggataagacgtggaggtggaagacagcaacattgatgatcctgaccctgtgtaggtctagtctgatatgtgtgtattttagtttttaacaaaaaagttttaaaaataaaaataataaaattttaaaataaagccttatggaatgcattaatcaaggaagaaaaaatttttgtacagctgtacaatgtgttcatgttttaatctaagaattattacaagagtccaaagtcaaaaaatgttttaggtttatgaattaaagttacagtaaactgagattaatttattattgaagaaagaaaatttttaaagaaaattttaaaaatttagtgtcgcctaagtgtacaatatgtataaagtctacagtagtgtacagtaatgtcctaggcctttacattcactcgccactccctcactcactcagagcaacttccagtcctacaagctccattcacaggaagcaccctatacaggtataccatcttttatcttttatactgtatttttactgtgycttttctacattagataagtttagatacacaaatacttaccattgtattacaattgcctgcaatattcattacagtaacatctgtacaggtttacagcctaggagcaataggctctatcatatagc

SEQ ID NO: 13428 - DNA, 14341 bp, Homo sapiens
tcaagtgaaataatggttgtgaaacttcccctaagaaggcttgagagcttaatgctctcctcttgcaagtgaaagatacctcagtatttgttaatatatttttacaaaattccaatgtcttattagaggataagtgatgcattgcatatagaaatttatgaaatatttattttctacatcttataatctgtccagactgttttgatgtaaaagcttgcaacattaatatattttcttcaatattaaacttcctacattaataatggtgcttttttattatggggaatttctaaacttctaaaaacataaaaacatataggtaataagtattttttctaacaccactagaaccattagcttatcatattttggtttaaasataaatgtggctctcataggttaagaaattccttttgatagcataatatgagccatagtatcttggtcctttaacaacactacgtaacattcctatcttagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggtaaagaattatatgtctgtcttaggttaccaggtataatttgtattactcatatcacctaaaatgttttcattaggtaagagcattctgcatatctgagaggtaattctcatcaatattcagcagaaaggatgttgaattctttctgagtagtaaatgaagtctcagaaagtccatcaggggttccaaatcaaatggtaggctgctgattaggagagtgagggacccactccattgcttccacctggcaacacatggtccatatattaactctccttacatctgatgtagtatgagttttaataatggccactgtggactttttcatcacattagaattaagacccagatccacgagtcttcttttccttgttcatttctccttcacctccactcttccttacacaccactcccaaactgggatgatgttctccccagaagttttttccccaaatatgtacacacatcttccctcccctccatggcactttcatttccacttgtccagtccatctctcttagagaccaaggtggcatccatccctttgggaaagggaaaaaggtgcttacagccaactccatgtacccccaagccccacccccgcctcagccccctgctgggctgacgggcagacgagtatctcttgacaatcttgaaaaggttagagatcaatcaatagcttgtgaatatgaaggcctcattgacaaggctgtccctgttggggagatagatagatgcatcctgctgttgattctgaaggtcacgaaacatttaaagtacataagcaactccccttattctgaattctaagttcatcgagcaacctcctcattataatcaacttcctttataggtctgcctacagggaaagaatggctagtcatgctgacacgagcattctggccccaaagacatttttggttctcattgtaatgaaaacattggcagaaaggaagccatttcaattcttcttgcccttcttggagccctctgtgacagcaggtgctcactcctatgctttgaaaatattgatgagtttagcaatacctttacccgtaaatgcctacagcccaaaggttggagaagtagaattgtgccctttttccattcattcacccattaattactcatttggaaagcatttaattaatgagctttagggtatactttgcaagggacttcaaagaacaaaagaaaaaataaagggtagcccccagtgtgttggtttttagcaaatgtaactagttcttcctctgttcttacctcttcaatgtttgaattagtttacgaacttggatatatggtatgttaacaccatcagagggctcattggttttcaaattcagtttgtgtgtgtgtttctttcttaggctcttggaatgacagcatcccaggaccgagcagtggtcaaaaagaaactcaaggaaatgaagatgtctctagagaaggctcggaaggcccaagagaaaatggaaaaacaaagagaaaagctraggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttcccccyacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttkctgcrttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccrtattggatactctattaatgtcttgagatgtctggtgctttgttattttttmacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcayctaatttatgatctattatattgcattttyttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgmacattttgttttcyyattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggycactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttytttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctmttagaatggtttacattatgatgggggatggggagctgggggagggctgtacattcccaaaagaaagtagtgttataggaaatccaaatgcrcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttkcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaamaatacctgtgattaaatttaatttgttagtgtaaataaatttcttgccaatgagtattattgttgttagacaacgaatgcaataaaaagaaatactgaggtctgttgaagcaattttttttccctcttccattttcaccttcaactaaaacaagccttgactgggtaaacctgtatcaattgtcaaagcatatatctgtcaatcargagcaaagtgcacatttttcatggaaatgaaactaagtcttaactgtggtaaagtgtaaattggcagctagaaattacatttgaaagcacaattatggaactgggcataaagttaaaagagcaaagcctgcactcgaagcttcctcgcccgtcattttgttcccctgtcgctgcttcaccatcaaagtctctgatatctctcagccaggaaaacctctgtgacaaatccattaagtagdcagtctcacatagcgaggggcaagctaaggaagaatcaggaccatcrtagagtatggggttattttaaacaatattctttctaaagccttaaaaataagtgagggctattaatttcattcattcttacacacgcaaactataatttatatgtgactaagcctatgtcagtgcgaaaatttagatctgggaatcacagaatacatgaattaagctgttttcctctttttcacaatgtatgttatgaaatttctaaccaagccrtgtccctttttgagtgatcttgagtatgtgctgtgtcaaattggataggcttttgtttcttcagtggaatttgcttatctatcatcaagaacaagaaagaacagaatgtggtcattttattgaagatgttagggagcctaactactcaggaaattctttctttctaaataatgaaatatgttgggggtgttccctaagcatcacactcattgataatttcaagacagtctttcagagaacccagcatcctgggctgtgagcagmatctcagaaaaattgagcccatgtagggcacgggatattatgtcactggaatcatgagtaactccaatcttgctgtgaataaagtggttttttgacccaaacaaaatgttcctgtttattacttcaagtcagtgattcttaaacaactgttggtggttctcaatttattggcaaaacattttcccgraaatgccagactatcatcataacaagtgccttagaaaaacttcgtttctggctgggtgtggtggctcgcacctgtaatcccagcactttggaaggccaaggcgggtggatcacctgaggtcaggtgttcgagaccaggctggccaacatggtgaaaccccgtctctactaaaaatacaaaaattagccgggcatggtggtgtktgcctgtagtcccagctatccgggaggctgaggcacaagaatctcttgaacctcggaggtagaagttgcagtgagccaagatcgcaccactgcactccagcctgggcaacagagtgagattcggtctcaaaaacaaaacaaaaacaagaaaaaaatttgtttctaaagtcactgccttaacaccctgaagaagtaattcatcatgaaggttataccttcaaatcagaaaaacaaataaatgaaaatgtgtaacctttatatatcagyttctataacaaaatgataaagtcatgttttcttcctagtcatgtctcagtagatagccaaaggggttgttgatcttttctatttatttgtttgtttacctttctattattttttttcttttcagcctccacaacaagaagtttaaatattaaacaaaaacccaccagcactaccaccacctcaacaacagtgtagtctttggggacacttttagcttcgcccatgtcaattatgggattcattctgtatccartcatcgaagtgaacaaacttcctttaaccaagtcaaagacactcaaatgtacaatttgtgccaagatcatagagactcataattttcaggtgtgacaacactcccaagaattttaagattttcctatgtgtcattgcaacaggagaattgaaaaagcaagagtacaaggggagttggaatarttcaggttaatatttactgagaaaaagtcayatatcgaagggaaaatgggagtaagtaagtctgactgccatagtcagacttactatgtgcatggagtagaggggaacttcataatgcatatgttttctggcctgtgaactggagtccctgggtgagtactggagttcyaaagacacgtgagctaacyctgctcccctgtgtcttctgaacaagacatggcaaggcagcgatacacacatgtgcttycaggcaacacatgttttagggtaagtacttttggggtcacacactgttatttaatatctgacaattgacatractgatttatccattttagtgagaaggatttttatggtaaatgaggttttcaagtattccaagactgatttgatagtgtattctcaaaaaaaagccctacacatcatatcactcccagttaaacagtgctttgatgcttcatgatgtccacatttagggtcagcattcattgttcagctaagaacactgggtcctcggaatatggcaagcggttgaaataatggcctcagtttctatggcatgggtgcaaatcggtctgttagagctcacagtaaagagctttgtgaaacactgtgccaatcagcagtttccctttgtacacagaggcaactgtactgccttgcaacactgtgccattttctgcataaacctgtgtcactttaggttcttctgttagaatgttctggattcgaagcacctgtggaagaaataacattgggttaatatttttgttaagtcacttaaaacaaccttatgcataatagggtcatcctccataagaagccatataatcttatacaatgagataaatcctattttgttccaaaattacacttaacacacctgtttcttcatttgggaacaggtgggtactgatctcaagtgatctttagcagaggtggagagtatctagacctacagggatgaggcaggaaatgcaaatgagcagcgcatcctggatgtgggacattagggagcagtggggatttcagtaaatgtggagggaggaagctgttactcagtatgatrgttaatactgagagtcaacttgattggattgaaggatgcaaagtattgatcctgggtgtctgtgagcgtgttgccaaaggagattaacatttgagtcagtgggctgcaaaaggcagacccacccttaatctgggtgggcacaatctaatcagctgccagcgaatataaagcaggcagaaaaacatgaagaggagagactggcctaccctcccagcctacatctttctcccrtgctgatgcttcctgccctcaaacatcagactccaaattcttcagttttgagactcagactggctctccttgctcctcaggcttgcagaccgcctactgtgggatcttgtgatcaggtaagttaatacttaataaaccccctttacatatatatatatcctattagttctgtccctctagggaaccttgactaatacactcagcaatagccaractgttgccatgcagtaattaaggtccgttttcatgtattttcaggtaagccagggaactaactggatgtttacacttaattcctggtttttaaaatgcagacaagaaaaaaaatgtggccctcaaaaaaccatatctgtgtmccatactcatgtgttctgaacttaacctcctgtctctaaatgtataagattttgtaagttcagtttccttcacttaattgagragaaatgtgattgtatcaataayaacagtgtagtatcatgttaagccaaccatatgaaatagccaatatctgatcattctgactgtaaaaaatagcaatagcgtgtgattcaacttagtatgaaaagcactacactgaggtgggagacctgggtcatgtcttggatcttccactcacatttgtttctcatctgtagaatgaaatgggtgggactagattatctctaaattccccttcagctctagctttctattattaagcctttatgataatatataatgacttgaagaaaggatatctacatcacaaatgtggcagacggtgaaggccactgcgtggatataaaagggtctgtgggaacgttcaaaatgacctcttaaaaacagctggcaccaaagacagatgtcttaggaagttgccatagcattaacatgtagtagttacagggaaatagttgatggtacaccttggcttagctaagcttcttgttaataaaactaaatcactcatctaggggcagtgcattggataaggaattgttactactttttgctactcctttgcagatcaatcattagaaatgaagtattttctcmagaacaacaaaccaagtccatgctatagcaaatgacccaaggttactaaatgagctaacaagcaagaacaaaytagaatctaacattctgctcagktctgagcactgaacactccacagcatacatttcttcaattctattaaacataccattcagcaaccctaatagctaaaaactagcaaaaggcacaaagggttgccattaaacatgatcacaattgtcctgcaaacctagagataaaaggtaagagagccataatgtaaatggaaatacacatttgtttcttttttttttaacccaagagatacgggctttaacacttttttttttcctgttgggcaggtgaaatggactcttaaaactgagctttaacaatacmcagcagtagacaaatatgtcaagatgatatcatatatatgatgtaagtaataagtatccttagtagatactgaaaactcagtaaatgtgcaaatacctatattgaagtaggttgmaaattcttacttgtacccaaaatagttcactgaataaagaccgtggacaaaaaatgggacctttgagtactgtaactaaggtggaagatgagatcttctaagccagaataattccagctatttatcttgccacctgcaggaagatctagagaggctggccagtgtgctccaggactggtccattgcatggacctgtgcgtataccgccacacaggaagggggagttgaataggaaggcaggtaatgaatgattaaaccatagcagtatggcatcattatgttctttgaggatcccttaaccagaggccaagttcctgtcaggcaaccctctccacccaccaccgtctacctgttctggcttctggtattcatttcctccctcccttgctagccctggggtactgcattataactctgttgattaccctacactgtgtccacacattttgtgtatagtccgttgattaaactcccctcaaattatccaatttaagtgtgccatgtgtttcttgcctagactctgactaaagcacctccaaaagccttcatttctgatcatttggatcatctatccatgtccccccttttatttgcacatagaattgagaattggccgggcacggtggctcacgcctgtaatcccggcactttgggaggccgaggcgggtggatcacaaggtcagcagatcaagaccatcctggccaacaggatgaaaccctgtctctactaaaaaaaaaaaaaaaatacaaaaaattagccaggcatggtggcatgcgcctgtggtcccaactacttgggaggctgaggcaggagaatggtgtgaacccgggaggcggagcttgcagtgagccaagattgcgccactgcactccagcctgggcgacagagcgatactctgtcmcaaaaaaaaaaaaaaaaaaaaaaaaaaaccaagaattgagaattatgttgtcaactgaaaaaacagtagctgggaataaagtcacttatctggttcatttttaaaacttacctctgatgcaggaggattctctgagtcatagaagaagattttcatgccattgggatggcatccaacccaaaggtctcctgtctcaggatccacagatatgttatccacgagggtattaaagtcaagggacttaaaagattaaaaacaagaaaagaacaagacataaagtaaaacacaattgtgatggag

SEQ ID NO: 13429 - DNA, 14196 bp, Homo sapiens
  misc_feature (1)...(14196): n = A,T,C or G, or insertion/deletion polymorphism (see Tables 1-2)
actgtgcccggcaggcagctcttaacctagcaagcgggcatgtgagccggcaggccccggagctccccagcgtagccgcggcatctgtggaaagggagcaggccagttcccagggcgaggagtggacgccctgaccctcctccactgaaccctggaccccaatgatctcactagtaattctcggcgaagacccagaagccccttccaaagagccctctcctaacagctcccctgtggggtgactggagaagctggttgtaaaatcaggagcaggtttctgccccaacgcctgccctgagttagttcctgagctcaccgagccggagaaggcccgtgaccagccagaagcacggagcgcagggcaggacagccggcctgaggccggtcaggagaggcggccctggcgctgcgcggtccaggacgagggagaccaggaggtgggggcggaatgagccgcgatggggtggcggcaccacgtggactggccggtcctccgcggggggcgcgttccgagggctgagggcggacggtggcggagagcccggccgtgaccccctccccgcagtgctgcagttcggcttcgtcaccatcttcgtggccgcctgtccgctcgcgccgctcttcgccctgctcaacaactgggtggagatccgcttggacgcgcgcaagttcggggggtcttctagagcgcaccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgtgggcaggggctggggggaggttccccgcggtaagggacggagctttgcggggctggagggcaaatcgtggattctaggtgaattgctagttggtcatagtgtagcaggacgagtcgcagacagaactcctcagacaccggattaaagaaggaagaggtttttttattcggccgggggcgtcggcagactcgtgtcttcagagcggagctcgccgaaaaagaaattcttagccctttgaagggcttacaactctaagggtctacgtgaaagagtcataatagatcaagtaagcgtgaggaacgtgactgtgggctacatacatcagctaacggtacaaaaagttttacggtgctttctcatacagcgtctggaattcacacataacaccagtagttttggtcaggggttaatattattgttattttaaccgccagggccaggtggtggcgccaaggtcatctagctatttatcttctgtttctttccagctttttgctttcttccttttctcctgtcttataaactagggaaaaggggaggttggggagaaactgggaaggacaacaggagaagtggtggcctcataccataatagaacctgcagagcaggtagatgtacttcacccgcagttgtggagacttcctttgtgatctggttacaatgaagttttgcatgtgtttcaataaacttgaaaagcatcatagtctcctaatgttggagcaaatctcagcagtaaaattacgaaaccatagggttatcagtcttttcatatcggtctctctcaggttttgcttttgctctatgtattttgagctttttagttgtgtacgaattcatacttgtgatctcttcataatggatacttactttttccttttattctttatcttttttattcctcctctcctgacttctggtggatgggtaaaagtgttctggttgttttttttattattattcttttgcttatttggaaccgatggcatatatttctattattttaggggttactcatatgtttagcatacattcttttytttttyctttttttttagagactgggtcttgctctgtatcccattctagaatgcactgccacaattatagctcactgcaccctagacttcctgggctcaagcaatcctcccacctcagcttcccgagaagccagaactacaggcgtgtgccaccaggcctggctttttttttttttttttttctttaaagagatggggtcttactatgttatgttactcaggctagtctcaaactccyggcctcaagcaatgccctggcctcccaaagcactgggattacaggcacaagccaccacacccggctagcacacgttctaaactatatattatcctaacaaagcctgaatgaactcagttttgtttcctctctctgtgtatgactaggatcttcacatgccttaccacctagtaagcagcaatctctccatcttattattgttacatggagttttagttttactgttaaaaacacacatgaaaaaacattttcagtcatctgttcatcaaatttatttgtgtattttgttaacttctgtggttacagtaatttcttatgtattgccttctccgagtcttttttttcttgctgaagtatatcctttagtaattctttcagtaaaggyatgtggttagtggggtcttcacatgcagaaatgcatacacatatgtatgcatagaaatatgtatcacgcatatgtatgataatattgccatgcatttttgtccttcaaatagcrgatataaaagtataggtcgagttattttctctcagttctttggaaatattattcttttgtgacttggcttttctgattggaagcattcatagcatttaagaatttttctggctgggcatggtacctcatgcttataatcccagcactttgggaggccgaggcaggtggatcatttgaggtcaggagttcgagaccagcctgaccaacatggtgaaactccatccctgttaaaaatacaaaaaaaggctgcacacagtggctcatgcctatgttcccagcactttgggaggccaagaccatcctggttaacaccgtgaaaccccatctctactaaaaatacaaaaattagctgggcgtggtgctggacgcctgtagtcccagctactcgggaggctgaggcgggagaatggcgtgaatccaggaggcagagctttcagtgagccgagattgtgccactgcactccagcctgggcaacagagcaaggctccgtctcagaaaaacaagaacaacaaacaaaacctggctgtggcagttcacgcctgtaatctcagctgctctggaggctggggcaggaggatcatttcaactcgggaggcggaggttgcagtgagccgagatggcgccactgggggggagcctgggcaacagaatgagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccccgtcttgactaaaaatacaaaaaattagctgggcattgtggcacgggcctgtagtcccagctactcaggaaggctgaggcaggagaatcgcttgaacccaggaggcggaggttgcagtaagcgaagatcacgccactgcactccagcctgggcaacagagcgagactctgtctcataaataaataaataaataaataaataaataaataaagtgctgggattacaggcatgagccaccgcgcccggctgaaagagttacgtctttgtttagttctggaaatgtctccatcttactccttccagcagtgcttctctgcttgtccattgtcgtctggaactcccactgggctgtggcctgcttccccccaagtgtgctctctgtgttgccgcagggtggtctcgtcgtcactgtctcccagtccccagtctctcttctgctgtgtctggccacttaaaagtttattccattcatttgagggattttttttccaatggctatatttttaacttgcaatatttggtttttkkttttttttattttcctacaaagttgaccctggtaatagttttcatggagtgcaacatgtaactttatattagaaaatggaatgtcacatctttaccatgggacagagacacaggaagatgtcaaagtctgaaatagcaagtgaagctgaatgtagcttatgatagggagggagggctctgctggrcagggacagtctctgagcaggtgaactgctgatctcacagaggtcagcaatcggcggattttcaccgtgtaagtagactgawgtcatcygtagaagcacagacgtactggactgtcacatctactagaaaataaagcatctgccacctggggggtggggagggtccagtttagcccaatgggggacaacccagcacatccacctttggaacccaccagttaaaggtattgtcagagtatcctgtttgggaagaattcccatttcaggcaccctcgatgaagagccaggccaggaacatgggatgagagagcraaatggtggaaaaaggggagataggctaattccagaggcacctgcccagccaacactcagccctggctgcgcgcactgagtcctgtgtctgctgcaggtatcgggctttccgggatgacgatggacattattcccagacctactggaatcttcttgccatccgcctggccttcgtcattgtgtttgaggtagccgaggcacctgctggttctcccatccatggcatgasgccccgaccctgtgctttgcctaattcgagcacgtggtgaggggtcggtgccgtcacttcctgctgtgtcatcttggtcaartcagagctcttctctgcacctgcgttttccctgcctggcctcatccctgggttgtggtgtggacattgtgggtgtctccacaggagccccagggccacgaaagctggggtggcctctgccccttctggggttccttttcctgcacagctgctttctgactccacccacagctgggagcaggtgccggagccccggcctgcctggccctgtgaaggccactctgggcgtttgggtgggcgtgagtgccttcctctgctcccagcatgtggttttctccgttggccgcctcctggacctcctggtgcctgacatcccagagtctgtggagatcaaagtgaagcgggagtactacctggctaagcaggcactggctgagaatgaggtgaactgtacagcccagtctcggccctccccscagccctctccctatccttgtcagtggctgctctacctccggacactgagtcacatccctcttcctcttgctgcccttttttggggacaggttctttttggaacgaacggaacaaaggatgagcagcccragggctcagaggcaagtctgggagcagccaggcccctgccccgtgcactccctgaggtcacagggccctgcccagccgcccactgtgcctcgtggccatggcctgctcctggccctagtctgacttgtccctgcccccaaccctctccccagctcagctcccactggacacccttcacrgttcccaaggccagccagctgcagcagtgacgcctggaaggacatctggtggtccttaggggagtggcccctcctgagccctgcgagcagcgtccttttcctcttccctcaggcagcggctgtgtgaaccgctggctgctgttgtgcctcatctctgggcacattgcctgcttccccccagcgccggcttctctcytcagagcgcctgtcactccatccccggcagggagggaccgtcagctcacaaggccctctttgtttcctgctcccagacataagcccaaggggyccctgcacccaagggaccctgtccctcggtggcctccccaggcccctggacacgacagttctcctcaggcaggtgggctttgtggtcctcgcygcccctggccacatcrccctctcctcttacacctggtgaccttcgaatgtttcagagcgcagggcygttytccctcgtgtcctctggacccacccgccccttcctgccctgtttgcgcagggacatcacccacatgccccagctctyggaccctgcagctctgtgtcccaggccacagcaaaggtctgttgaacccctccctccattcccagttatctgggtcctctggattcttctgtttcttgaatcaggstctgctttccccctagccastacaggcagcctctgacagtgccgctttacttgcattctgcagcaattacatrtgtccttttgatccttgcccaacttccctccctctcccagctcctggcccctggcccagggcccctcttgctgtttttacctctgttccttggggcctagtacccagcaagcacccaaatgggggaggttttgggatgagaggaggaaacgtgtatacctgtaacatctggtggctcttcccccagaagtttgtgttcatacataattgttttccacgctggatcataatgtgacgtgcagttctgccctgtgctggggagccacatgaagcttcccctggctaacttgctaccccgcagcaatcccagtktggccgtctgcttgctaaaaaatggatctgtgctcatctgtattgatgtccttggagttctacaagtggaacttaagtgtcaaaaagaatatgtggtttttagctgagcgtggtggctcacacctgtaatcccaggactttgggaggctgaggcaggaggattacaaggtcaggagttcgggactagcctgtccaacatggtgaaaccctgtctttactaaaaatgcaaaaattattctgggtgtggtggcgggcatctgtaatcccagctatttgggaggctgaggcaggagaatcgtttgaacccgggaggcggaggttgtagtgagctgagatctcaacactgcactacagcctgggcgacagagcaagactccgtctcgggaacacacacacacaaaaagaatatgtggttttaatgtgctttgatgagtactgccaaacttactccacagaaaaggcctctttctgaacatcctcgcctgcgttcyatttcacccaccgtgatgcctggcctgagggcrgcgtgcttgcttgtagcatttcttgaggatttgctacttgttcacctgcctcttaggagcactgtgccctgcctccatggaagggctcttccggcagggatgcaggctcacagcgccctggggctggacascaccggccggagcatggcggacagcacacacggcccggggcgggaaccttggaaactttacacagatggggagctcagccattccacgtgtgctttcgctcagcacaatgcttactacaaacccacgtgtacttccttccagctggttgctttttattgttgctgtcttaaactccaaagttttaaggtgaatttattgaaacgtacgaaaatgctcagttcatacaggcttccaggtgaacaaactgttgtaaccagcacgtgggtaaaaggcaagttccacatcacccgacgtggaagctccccgatgcccacgtgcgccctaccctgtgaccctctcccatccagggccctgatgcccacatgcgccctaccctgcctgtgaccctttcccatccagagtagccaccaccttagccaccaagcagagatggaactggggactttgcatttggcgtctgccgtgggacattgcgcgagctccatccrtgccgagcatccatctcagcccctcctggctgctgggctgcttcgtgtttggcttagggtcattttgcagttgtgtgctttrctgtgggttgcatatttagggcccaacagaactgctgggtcagggataaacatgttcggcatttttttttttttgagatggagtctcgctctgtcacccaggctggagtgcagtggtacgatctcggctcactgcaagctctgcctcccgggttcacgccattctcctgcctcagcctcccgagtagctgggactacaggcgcccgccaccacacccagctaattttttgcatttttaatagagacggggtttcaccgtgttagccaggatggtcttgatctcctgacctcgtgatccgcccacctcggcttcccaaagtgctgggattacaggcgtgagccaccgtacccggccaacatgtttggctttaagaggaactgccatacccgtcttcccaggtggggaccagcccagtcagcagcaggaacacctattccctcttgactcttcccgttatctcctgccactcaggtgactggggtggctcctcccactcaacgcccctccctcctcctcctccagccgaggcctccgcccgcaccccccaccacccaactcagctcgtcataactcacaggccgggtccagggtgccaggaatgccactgaggctggcagagtcctaaaagggagtggcaggtgctgctccacaaggacggttgtccaccctcaatgagggctgcagggcaactgctgactgtctggcagccagaggacagggacaggcagccaccctcttgccatgaccacacctgggtctccctcartgtggctcccgaggggcygttgaacacagtgttgagaactgctgagaaaatcacaccaaagacgaactacccacagatgccagtcaccactccagggtgacgagaaagagaacacacaggcggcagcgtgacaaaatgagtcccagcatgctacatctggtttcgggttttattttagaatttataaaattccagtgtcatccatattcatgagcctttacacatgtttgcatataatctccaaattccaaagttaaggccaagggatggattgtagctatggaaacagatgatatggaagacatccaacaaggaggaaaagcacacgcacgcctcacccctgcctcatctctgcccagggctgtcctgacagcacagacgcttcagggagacaggcctggggacagtcatgtcatcacccttgcaacaaccacccaaaggaaaagagagcgctgaacagtttaggaaagggctcgcgtctaagacatcaagcgacatacagagatgtgcaaaacttggtgagaattaaaattgacctttgggagagggtaggggcaggatgttttatgacactgtagaaaagacaggaggaaccygctgcgatggagattgsggggagctggaagcaagcagccaacaggacagagttccagaactcatgcagatggggaagaggtgacagcccttccccactggcctcccccgtggaggtggagtagacagatcccgggaaaggcaggaaaagggccttgctttctttccctgtttcctaagccgtggtcacccyagcctatgaagctggaagctatattccttccaatcccaatttaccattcctgtaaacaggcccattcagggctgcctgagcaaatggggacttgccgaggcagctgcaactagacttgggctaagccgtctgggtctactcaagaattcgmgtctgaagatgaccaagcttgagttattcaactgagagtgaggtgtcaaggcggaagcgactgtccccagggaagggctgtgagatggatgggcgtgagtcagcttttccaaaactcaagtacctgggacaggacaactcrctagcagctcagtcacctccgtggcggacacagataaggatgttaagaccagaaaaccagagactagggccccgtcctcagccctcacagcatgacacagatgcctccctcggagagcagggtctctcggcatccagcggcgtggtctgcattctgctctacctcatgctctaggccccatgccatcgtctcggccctagaccrtgaaaactgccagtcacccgggacctgctcctaggggctggcctgcacagccggatggcctgtgggcggggtggaagtgcccactcccactccagatgggcctgctggccactgacccacctgtgctgagggagagcgccagcctccagcttaggtacacggcgcccacccccagctccacgggaaacccataaccaccagaaacatctcaatcaagagacgggtgtgtggggtggcactaactgcacagagaccactccacgccggctgaggtagaaagaaggcaactgaacacacagcagctagggcaggggcagggaggggctgcaggtggtgtgaagaagagcccagctgtcatctaaggcaaactgcccccactgaggacaagcgtaaggccctacctcccccaacctgtgcgcatctcaatcacagcagacactgtgacggccacaggggacccagatggtgcctaccaccttgcctccaggctccactcaccagacctcaggctgagggtctggcagtggaggtaggggcagggacccttggtgctttcagaccccacggcaggtaaaatcaggactgcctgagaacccgtcaccctctgcctctcaggtcaccccccagctccaggaacctgcctcctgctgtccaytgccaggtcttccttgcaccctgacacctgtgctgaggcgctctggcagctggaggaggctgattgcactccacaaacaggactgtctggaccaagggaaactggcaggagggaggtgggaaaggaagagggcaaacgtttggcttttataaagtcaaggacgtttatttcctgaggtcatgacacaggaagtggaatcctagccacggctgcggagctctcgtgatgaaggccagagtgctgactgacatgccgggtggaccaggagctggagtctgttatcttagcacgaatgctcatgaccttggtttagtgttaaacagtggagcaggtcctgagcgggcacggccaggcctggaggagcggccgcacacacagccaggcgctaggctccctgcgggacctcgggaagggggaagagcgtcaacaatttacrgagggtccagccrctgggtcagattgagacaaaccattgtgtrgttgggttygggycagcaggctggagagggttctgttctttttgatcattatcgtttggggcccmaagggagggtcttgggagccacctgagccccaaagctgggaaattcctcagagctgctcatgtcaggagcctgtgcagagagaggacacggcttcaggaggggatgctccccaactcgcaagcagcttccgacgcagttgccaccctcaggacaccaagcccgcctgcccgcccaccctccctgggacccaggagggcagaagcccgcatctgaccttctcactgctgctggcggtccagggtgcgtcccgcaccacaaagcctctggaaggtgccttggcctcttcgtgtgctgggggtttcatgtatacctgcagcgcctcactgtccaccacgtcagctagctgcaggcagaagacaggaagacagggtcagtctgcccagcacccccagcatcccgcccgcctgctcacccctgcacctcgcctgcctctggaaacacaagtgccaccttgtcccctgaagctcctggctgggcctcaggccggtggacgtgccagggcgcctcagggctccaaggcccacagagactcacgtattcctcctccagattgaggatgtggtcgatggcttcctccacattctctgggagccccgtcacagtgacgcagttggggtctggggstccgctctgtgggaagcgaatgtccacctggaaggggtgtacaacgtcagatgaggggactccaagcgaggaaaagggttaaaattatgtgtcaatttctagtgaagcattttctgagttagcaaacgttttaaaatctggtttcagagttgttctgaagtcagtcagcctcatcaccacaccaagttaggtgtatctcaggagcaccttgttcccagcagacagagggccgcagcacgtactgtgcgctcttgcatgaaattcccacccacagaggacgagctcgccaggcagctgtcaaggagatgccctcctaatggccaccgtggcagtgcagcctcacacaggccgtcgcctgcactgacccgtggtgtccatgaggacagttccactgccagccctggggttgtggcctcatcatcttgaggggaaggccatgccctgctctttcttctggccagccaggtgcccccggtgagagaggattctcacccactgtgcttccagccggctcaccttgaattcgtccatgattttgcgaatggctttgccgcgggcaccaatgatgcgggcgtgaacgcggtggtccagcgggacgtcctcagaaaccatctgctcaagttcacccacaattctcagtatagcatccctggcagcttctgtgttcttttcgtaccctgtgatggtaatttggtcctggggctaaaaaaggagaatgtagtcagaaaaggggatgccttactgggattcccgtcaggggcaagagccggcccccactgctgaggaaaacagctcaggagagaagatggaaagcaacgtcacggctgatttaaaacaagaggttaacaatgtccactcagggccgggcacggtggctcacgcctgtaatcccagcactttgggaggccgaggcaggcggatcacctgaggtccggaattcgtgaccagcctgaccaacatggagaaaccccgcctctactaaaaatacaatattagccgggcgtggtggtgcacgcctgtaatcccagctactcccggggctgaggcacgagaattgcttgaacccgggaggcggaggttgctgtgagccgagattgcgccactgcactccagcctgggcaacagagcaaaactc

SEQ ID NO: 13430 - DNA, 47941 bp, Homo sapiens
cagttctcctgcttcagcttcccgagtagctgggatttcaggtgcgtgccaccatacctggctaatttttgtattttagtaaagacggagtttcaccatgttggccaggctggtctcgaactcctgacctcaagtaatccacctgcctcggcctccaaaagtgctggaattacaggcatgagccaccatgtccagccagaatacattgtataagaaaattgatttcaattataatgtacctgtggtacttaactaccaaggattgggaacygtttgaccataatttttccatctgttggataagagctgaatcagaatgtcattctaagctaatagtggctatcatccatgacctaaaacggactcttgttaggggactgaagattggcaaagggagaagctagaggccatatagaagaggaaagcatgaaggtagaaaccacaatcaggactgccttcaaatatgaacttccagggatacttcttggttctgggtagctcccccaccacactgttttcttttgctgtcctcaggaatcagcttgcttgtttcgtttcattgctatcatctgtagtttctaatgagtttttcactttctgtgatctctacagaacagattttacttttctctcttctcccctacatttgtgtctgtgaagtatgcatgctggtgtttttactacttttaaggaaagagaagtatttagaaacaaaaacgtatttcatctgtctttgccacaaggattttttcctccctagttacattttcacgggaaaaacaagttgtacataagtgcatcttacatttcagaggaaagtcagactggagttatagtggacttcttatcattagttaggtagaggtagaggcagcagcctggtcttaacaggactctgcctctgtagggagggatgaggaaactaaagactacaggagtcaactgcactggggtactgggttacaggaaggctagtgatcttgctaacctagaagactagaaagtagaggaaattcatatgcccttttcctgagtttgaaaaggctttgttctttcatctcacagggagacttcagcacaaatgatagaagaaaatttgaactgccttggccatttaagcactattattcatgaggcaaatgaggaacagggcaatagtatgatggtaagttttgtgtggatatgggtgcctgctttggctatgttgggtgcaaaaggtttaactttccatgctagccttatctggcatttgggatgcatatgggaaatagaagaactcaagaggaaagagcatttggggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtayatttcctctttcattaagaaaaatagcagtggccaggcatggtggctcacgcctgtaatcctagcactttgggaggccaaggcaggtggattgcttgagcccaggagtttgagactagcctggccaacatgggaaaccctgtctttataaaaaatataaaaattggccaggtgtggtggcacacacctgtggtcccagctacttgggaggctgaggcaggaagatcgcttgagttcaagagtttcaggctgcagtgagccgtaatcctgccattgcactccagcctgtgacagagtgagactttgtytcggggaaaaaaaaaaaaaaaaaggataatggtggccagccatatgacatgtacctgtagtccgagttactagggaggctgaggcagaaggattgcatgagcccaggagttcaaggctgcagtgcattatgattggacttgtgaatagccactgtactccagcttggcaacatarcaagatcctgctctcttaagaaaaaaaaaaaaaaagaaaagaaaaggaaagaataattgtttacttcaaatatttatgaaaaaaactctgaaatttttttaaatcaggaaataaggtaaatgaaatgatttttcaacttttgattatgaaatgtccaaacagaaaacttgcaaaaatgaacacccatatacttataacttatagtcaacatctaattgtaactttttcatgcctggttttagaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatmttagttggctttcataaatcatgttgktgtgtgtrtatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacakactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaatatgaaggttccatgaagtggaattaagagcatagaataactgtactttccttaggaataataggacttatggtaaaggtagtattgggcaacttctttaagagtgttttcctctgaratgtcctatcaccactatctacatctaaaaaacatgctcgattcttgccctataaactgatgtcacagccccaccatccccatttttgctagtggtatcattttcctagtcaaccaaattttttagtcatcacatatcactgttcgtcatctattataataggcagtctctctcttgtttccctggttttagaagattttartaataaacatttattgggtacctgttacttggagggtattaagctagatggcaagatctgaaacaacataggcagtatagtaaaagtgcttatctgggagtctgaacattacaagccatccaagcattgcaattattgttaaggattattttcaatggtcatgcattttctaatattttaataattggttaaagatttgttatagcgtgggggccgctgctggtgtgtggctggggttatgtcagggcagcctgatctatataatttgggcagatggtgtgagtcagaacagactattatagtgggatccccaaacttgcttttgatgcatgagttggaccactattttttggtgggtaacaacttttcagaggggaatggcagttgtgaattgtatacatttcattctttaagcaatattatgaaaaacttcagagaatgtctacagaaaacagggtatggagcaagttattttccattctttttgctttttggaagttaaaatagctaagctctgcaaatatcatttatttggaacagataaggtcccagacattcctagataataaaaatcaaatgaatgatacaggtaagtgtatttattgaagggtgtgggtagagtggtctgggaagtcttgctttaatgaagacggattgattctatttacctcttcttacttccactactaagtaaccctgggcctgcagtttcctaaccacttgacttccttgccaacagtctgtctccactttcagccgttttatagattcattggccctaaagcactgctttcccatacttccctacccaagagggcaggggtccccaagccctgggccgcggaccggaaccagacagtggcctgttaggaaccaagccggatagcaggaggtgagcggcgggcgagtgagcattatcgccttgagctctgcctgctgtcagattagcgagtggcatcagattctcataggcacgcgaaccctattgtgaactgcacatgtgaggtttgccggctccctgtgagaatctaatgcctgatgatctgaagtggaacagtttcatccccaacccacacacacccccaccccgtccgctgggttagaggactttacaaccctagtccaccttgtccagttatagttccacctctagcctttcaaggcttaaaccattaatgtccttaatttctcttgtattcatctatctcccaactatacctttttccttcccttttttatttttggcaatatgtgcccatggttttttaatttaaaacgaacagaatatgtartgacgcctaccatagcactccttcccatcacacaagccttcaaggaaactgaagtacttactttggtctccctggaggattccctccgcctcccgccccatgtgcttagcaattctgttcctgtagtctggatggccttcataaagccctcactggaccagcattctggcacataataggaacacttaaaaaacgagagaatgatgccgttatatctaatatcttcctcttctgaactttcacagcactttatttgcaacaagtttagttgctcctgaagggcaggatctctgccggaagcaagtgcgtgccacacagtggggctccgcatacactgcaaaaggacaaataaaccgaacagctaccgtttgagagtgagcgagtgggttctctgcacaagaacaaaccaaccagtcccttgtccgaaaggscgtctccttttctctgcttcgctgctcactccagactgcgggctgtcctcttccgaagcagttaaccagcagtgtacagaaagcgacttgcctccaaaggagcctgcgcggcccgcggctaggagaattttgtcccatgcgctccccgtctcactagccgcgggccggggctacgccgtgtgcgtccccgcgcagccgcagtgctgggcgagtgggcggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagttagtgccttccacccgggagcgacccttgggagagggagtttcaggaagctcaccgagcaggggcggcccactggcctccgggggcggaggagttggcaaggggtcagcgggctcagccagaagggaagaatgaggggacaggkgtactggactccccggctcagcctgcgagagagcgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacakgtgagcggcatgtgcagtcagttagggctctagagcagattaaaagggtactccagagtggagtctgggaagttgttccctctgcaacgttcgggggcgcatgtcccatctctagggagagcacgggggtcgaagcgggcttttgcggagcaccctccagatgttggacagttttagtgctatgttcgttttgttgcagagattaagtctccctacggttattcctatacacagcaaactcaattatttgtagaaaaatgaagaaggaagaaaggaagtagtcactctacctctaactgaagagatggataaattatagttcgttcaactgtacaggctttagtttgccgctgtagatgctgtatgtttatggttgtttcttagactttttcatttaaaagcttccagtgtctggttacgtcttgtaacaccatgatgactgtgatggtgcttatgtccctggacctccagggacataagcacaacactgatgggccatgctcctccctccttactgttgctgttcaagttggggacaggagtggtgtgggagctgttgctctcttgttgagctcgcttagcttttccttcagcctaattaccacaagttccttttgatacagactagtaagagaggccagtttgtggagaaattgggataatggtgtattcaaaaagagcgtcaactttttgcttgtttccactatccctcaaaactgatatttctactttcaaatccatcctgaatcctagaaaaagagcaattttaatggtatatcttagcagatggagctctacataagaaattacagattagtccagatttccttccagtttaaaagcattgtctttctgacagtaaaaccagagaaaggacatttcaargaatgactcaaagaattagtaatgaacctcaaacagttcatctttccttgttattatgacyttgcaaatgtgtttatattttcaagaccggtagctaagttctatgaatttacaaggtgcaaaataggactttgttttctttgctccccaaatgyctcctttttataatttccagggcttgctttcatagttttcacattccaggatttggttaacaagcccttatgctatttatttgtatagtcttgtcacccttcatcttttcatgctaattttttgtttttatatagaaattttatgttcccagtattttaattaccttgtagatagatcgaaagaattataagcctcagaaattttctctttacttcaaagtttgcattgtctttttttcaacctggtgattaaatgtattatatattttgatttggctcttgttatgtactattaatgtacctctactgaaagccattagaattttttaaacaaatatttctcagaaggttaaagaccgaggagaatcctttgaaccttagagcagtgctggagacccagaggtacggttggttgagcttatgaaacaaggtgtaacattggcagtttaatttgatctttttccctttttaggtgtggaggtattttaagcagttgttcattatgagcaattcatattagtgaggctttagtaggtcagcagcatgagcaagagtgagtatttattatagcattttagatttggaaagataatttttctttttataattttgtcaaattgaaacatctttttgcaggggaggagctttactaactagccccagtggaccaggctatcatatcatgttgcctttcattactacgttcagatctgtgcaggtgagtgattcctaggggaagcctccataccagatagacaggcatgacaggagttaccacacttgtgggtggagatagatttccttattgcttaagcagatggtggtatttacttaaatgcagaagttaacgttcagagtacagttgttacaacacaagttatgatgttaaaccacctcacttacttgaaatgaattaaaggtatgaaccaggaagcttggaaggactgacttctaccatctatatcgtggtatatagcaaattttctgttgctgctgtcacaataaaagtaagaattagaaacacaactagacatacaaaccagtgattatgtggtttagaacagtgtttagtttccatagaggcaggctcctgggctactgttaacatggaggatcaaaatttttatacacagcctttctgcctcatgtttttttgcctggtatattaagcacaattttatgtggaaccttagtgaatgttatattttgatggcatcccgggatatttgaaataagtgtctaatcctcgaaaagtgtcttggccatgggagacaataaaataagtatctttcaatgtaacaagatgacaaaaccaggattaggctgtgaccactttcgcaagcccagtgtgatcataaatctttggattcagaagtttgtctgccatctgctgctaatttttcaggactcaggaaaattctgtgttatttaatcttgtaatcttatgtctaggcttcctgctaagtgagagtttaattataaattcttaaatcccctaggttttcttcctgtccccttttasatggcttagggaaagaattgtgtctactgaagtgaaatgtattcttcccctaatcagactgatttccatatgttgttccatatttattttacccattctttccttagttcatgccatcacttctttatctgccatctcactctccattccttytctcctgtctaaatcttgccaggcttttaaaggctcatcccagattcttcctcttctgatctatagctcttaaagtctatattgtaaattttggccctttgtcttattttctttaatattgttgtcttgcattgtttgctaagtttttttatgtgttttctttccagaaaggctccagttttcttaaaggcaggagttgtaacacatttatatttctggctttctatttatggtggaagttgttaaattgagctgatttctcaggaagcaatgtggtgtaatgaacatggggacccagcgttaccgccagttggtggcatgactttggaaaaattgcttaactgtcatagacttcagttagtcttctgtgaaaggaggaattttaattacataacctcatcaacagccgaaacaatctataataatgttagcaatggcagcattagacccttaaaaatcaagactctaaggcccggcgcagtggctcatgcctgtaatccgagcactttgggaggctgaagcaggtggatcacttgagcctaggagtttgagaccagcctgggcaacatggggaaactccgtctcttaaaaaaaaaaaaaaaaaaaaatcaaggctctaacaaatagatcttgttcaaaaccaggtagatctgtctctgccttcatgcttagtatgttaagtcatactgatgcaaaaatataaataaaggagatatagataatagtaaacagattttggagtttaattgtgtatatatataacaaatatagtgtgtgtatatatttaataataaactatcataagagatgtaaatgaaattagtacagagacttcagtgtaaactaaaatacttcgcatctacaaaaaagttttacatgrgctagagccagccagtgtgactaaataggaatgttctttatgtgtaaaacggtaacattctaggaaataattatattaataaaaccatatttaaaaagtgttcttggccgggcgtggcggctcacgcctgtaatcccagcactttgggaggccgaggcaggcagatcacttgaggtcaggagttcaagaccagcctggccaacctggtcaaacgctgtgtctacaaaaatacaaaaattagctgggcgtggttgtgcgtgcctgtaatcccagctatttgggaggctgaggcaggagaatcgcttgaacctgggagaccgaggttgcagtgagccgagatcgtacccttgcactccagcctgggcaacagaggaagactccgtctcaaaaaaaaaaaaaaaaaaagagtgttcttaagagagtaagacataaatttatttttaggaatttttggaacatattagaagacatagtccagataaacaaatggtttaacaaacttggcaattgaaaggaatgtatataaatgtgaaattccatatatgatgtaaaaagaaaaagcaatggagaaattatatgaaaaccttcagccttcataaagtaaccatagattcactttttaaataaattttctgtcatactgggaaagtaatttttaagaggacataraagaaatataaaagtacataaagatagggtgttaaatggaagatttaacatttgaaccctttcctagttcttctgagtttgaaaattggctagagaatatccttttggtttaaataggaacgtgtatttaaagttggtgtggaatatggaaactgaattaatgttataaaggaaataaatataatttgtctcttcatcaatccccttaacctagaactgccaccartgtttactgtcattctaatgtctcaacctaagagttattttttattctttcccctcctggaattttatatcaaccaagtatcagatacctcctctattatgtctggattgacagctttcatggcctttactgaattaatctaaataaattaattatttagcctcccagctggttttcttacctccctataagatggagaatgagaactacatcacatgtgagaaaaggaattaagtaaacatatttttgaatggttcgttttgtgactgtatataaggtgaactagagagatcccaaactccccagccagcattcagggccctctgtctagtattaccatggtctcttgtcagaatttcatctttcatccaaattgtcccttstgctccaggcaagcctatctactttcgttcgcctatacacatgttgtcttcaactgtgtgtatttcagtaggatatttattgagcttaagatgttcctctgcctcatctgttcttatttctcccactctagacctggcttataaatccttcacctcagagagcttttcaaactactatttttttcactttctgtaatttaccacttaacagttcagtttataatttgtgtttttggttttgttttgttttgttttgtacctgttgatggattgattgcattgtaacattttgtctcctgtgctggattgtgaactctttggaaacagggactgtgattcctttttcctttgctttgtgcttgataagatgcagtatgtctagaatgtactcattaggtgctgacctatttgaggccttagagtacagcaggaagtcattcattctggatctgaacaaaggtgtgacaagggcaaagcaattaagtaccagattgttggttcaccaggaggaagcagtactggtggtagcacttctattaaaaaggaaactgaataggacatgtgagagatcactaggtattaaactaaaatgttgaccacagctttagagaagaaaggttgctgttggattcaagggcagctttgagtcttagagtacttgtatgcataaaatctcttttatcttcaacataaatagtaatattagcagtggaatcaaagttcagagtgcaagttgtagccagagtatctatgtgagcaagctgtgttgtttacaacccctggccagctccaggcaggtaagggactctggaagagttttctacttattagcagactgaacattgaacctttcccagtgaatcttaattcaaacattcgctgtaggccaggcacagtggctcacgcctgtaatcccagcactttgggaggccaaggtgggtggatcacttgaggccaggagttcaagaccagcctggccaacatggtgaaacctcatctttactaaaaatacaaaaattagctgagcgtagtggtgcatacctgtaatcccagctacttgggaggctggggcacaagaaccgcctgaacccaggaggcagaggttgcagtgagccaagattgcaccactgcattccagcctgggtgacaaagcaagactctgtctccaaaaaaaaaaaaaaattgctgtaaaatattttctgtctcaagtctttcatttctactagaatacaaaaagaaatgactgttctgagagctaatctttgggaactgaaattgtgatggatctctgctgtacttactgtcagcagctttccagagatttgcctctggtaccagtagttttttgacaatgtgtgtcttgagtgttgatgagatatcttttcctccctagacaacactacaaactgatgaagttaaaaatgtgccttgtggaacaaggtaagctttctctttgcctacgagcctccctttagctcagacagagtttctgttcctacagctatgatcacttagacatatctcarataggcatgatagttaacccaaggggacttctgatctgagcattgtttgagcaaaggcctatctccaaataggagcttttccatcttaagaaccattattgttcttatggtattattggaaaaaactggagttttagagcaagtagacctaactgtgyattagcactgctgcatctgctttattgactattttttaaagactttattttttacagcagttttaggttcatagtgaaattsascaaaaagtacagacagtttttatatacctctttccccaacacattcctttattgacactttaaagcttagtttcctcctttataaaggcagtaaaatctaccttgcagagttgttgtaaggattagaattactgtatatgaagtgcctaaccagaacttggcccagaataggtgcttaataaaacatagtttaaaattaatcatcccaccgtcttctcatctgtagtgttaaatgccatctaatttagagtttctgattcaataggtctggggtgaggcccgagaatttgcatttctaacaaaagttcctgggtgatgctgatactgctggtctgaagacctcactttgagaattgctgtcctaaagaggtttagggaaagaaaggcaagcagggcccaaattatttctagggtataatcactgcattgaattgtatcaaaagaagaatgtgaagttcaaggtattttttaaattacttattttaaatgactattwcaagtgtaaaaaagacattgacatctatagagggacagaaatgctatgaaaaaggaagcgaactctttctgtgttttaagtgaatattagtatgtttcattatcagcttctcyccaggtctatctataactgtgttttatggattgcctttagtagttcacactytttttctttgtttttagtggtggggtcatgatctatattgaccgaatagaagtggttaatatgttggctccttatgcaggtatgttacccatctacctgtggtttttatagttatagccagaggatttatagctgagagattctttgaggaatagaagggtactttgaaagttttatgacttcattgatcactgattaataaatttctggggaatagaggcaaaaataggtcagaagttctggacagagttgactttctgcaactgtatgagttactcttctctgagcttagtgtttctaagagcaaaatggtcattggttatttctagaataggaaagtagtattttatccagtcaggatgagagataatttccttgggtgttagaaatctgtaactgatcaattccttggcccacactgatttgccatcaaagagaagtattttctagttgagatttgctataatttgcaaagcagtctgaaagccttcaacgtggggaaagcattttcttgataaaagatgaaaacctacaggtatggggtgggtaggtactgttgtaatcaaaaacttaattagaagccctgaagaaagatataccgtcttatatgcatgcttgttaataaaactggcatgtctagtatgtacagaatattgtgtttggcaagaataatttgaaaagatgaaattacagcctttgccttcaggggttttaattttacttgagaaracataatacagagctaaaaaaggatatattgggatgtaaggtcataataaatttcacataaccggtacaggcacaaatagtgaaaagatttcagagtagagagcaggcgtattactgtcaagggcatttggattatatttttcagagagtaagcattttccttgtctttttttcctctcctttccttgattacaaatcactggaatggattatgattgaaaaagggaagggactgatgattctttaaccagagattaaataggaaactatttagatataattcatttgggaaatgatcaagcaaatgatttagtcattaagtatttattaatggcctgtccattaattttttttcttttttgagatggagtcttgttctgtcacccaggctggagtgcagtggcatgatctcagctcagtgcaacctctgccttttgggttcatgcaattctcctgcctcascctccctagtagctgggactacaggtgtatgcctccacaccaggctaatttttgtatttttagtagagacagtgtttcaccatgttggccaggctggtcttgaactcctgactcaaatgatccacccacctcagcctcccaaagtgctgggattacaggcatgagccaccgcgcccagtcggatttgaaatccagttgcatctaatatcccacatgggaaggccagtggagcaaattcttggatctgaagacagaagtagaaagcagcatgtttttgtagataaagaacaggttctgacgtggtctagtatgtaccttttgggcatttctaaaattctctgtttcttagtttcctaatatgcaaatttaggagaattcagtgctaatttatgtaaattacctgatataaagcccagctcagttaatgttttaacaactttaaaaaatygcctttttaaaaacggtcttttgcaactgctttcttcttttatttctactgttcctcagtttgcctagtctctctttacctcttagctaaacttttgcagtaattgccttatgctttccctgcctctgatctttatgcttctcagttcatcttcacactgctggccaaagcgtaaatctgactgtcatgcccttgcttgaaacctttgatagttccttattacctccaaaataatggatactttagtgtggactttaaagttagcccctgtttgatgggctaaccagcaggtgtttggcattagtattacaaatgcaagggtatttggaaaattgagcacaagcaacacatcaagatttgttagttgtggtttttggtttcactattttgttggcacttttcctcatgtgtaatatatcaccctgacttttaccctggctgaatttgaaggtacctgtgtcattgttgggtaaaacaaacatgggttgtacctctccttcagtgtttgatatcgtgaggaactatactgcagattatgacaagaccttaatcttcaataaaatccaccatgagctgaaccagttctgcagtgcccacacacttcaggaagtttacattgaattgtttggtaagtgtcttaattcttatgtatgtaaatagccaattggaaatctttgttcagcttacttattgaggttatattggtaaaccttagtgctatttaagcatttcttctgaatttatcatagagcaattgtctttaaaatattttttatcttaagtttaaaattttttatataacttgttagagattggaaaaactactcagactgtattctgtttttactgtaataacttagtgaaaattagctttgttgatgttttaatagataatttgaaaaatttagaaacctgtgtcttgaggctcccatttttgatgatttggtaggagactgacaggactcagcacatagttgtgttcacagctaagatttattacagccaaagggtacaaagcaaaatcagcgagaggcaaaggcacaccagcaaaatgcagaggaaagcaggtgcaggcttccaagagtcaaacatgtgcctaattcccacagcaacaagctgtgacaacacatgtgaaatgttgtctactagggaagctcattggagactcattgcccagggttttcactgggggctgattatgtaggcaccctctgcctaccacrtaaaaattccagactcctggaaggaatgcaggtgtttggcataarccacattgtataaacagttcacagcaagtcaattgtattagctctggggatagtgggacccttctacaaatccaagttcctaggtgccaaccaaggacgagtttacaaaaggcctttctaaggatygcagtatcagccctgctttcttaactcacttctgtacaacttacttttcatttatgatagtggaagttctgaccagggaatgagttgttgctgttggtagctcacttttccctcctgaaatttttagtgaatttctaagatgaaggaataagcaagagtaatcaatttaaaatctaccaattgagtcctctttggtgattgtcaaccactgaagtggcatgtgaggaaactgatgggtcctgctttgtctcaccaccagtcatttaaatagcgaaagtaccattgaggtgaatagaaagtgcatagttacaagcccaagtgttcatgctgtgtatatttcaaatacttttctatgagcttctctctctgtctctctctctctctctctttaaatccaaaataacagtgaggctgagatccatggaaatgaagtttagttatttgggaatttgagtaaagatttactgaacatagaaatttgtttttctttgagaatgaggatacatattgagtaagagccctgaattaagatactagagatccagattctccatttattagatcaacatattttacccagtagttgtttatccagtaaataagtctaataagttacccagtaaaaaagcttatccatagttaagtaatacatttagtgggtaaacttattggataaacagactatctgcttgtcatcttcrttccttaatttctttattagataattccttgcaatttttttcccacacaaaagggaagaaaaggcagtttaagctctgtaaaagaatagtactgtggaaactttaggtctaataatgattagttttgtttcattatgaatacaatgtaaaaaaaattgactatcatgagatctgttgttcttggcttaaaaaacagatcaaatagatgaaaacctgaagcaagctctgcagaaagacttaaacctcatggccccaggtctcactatacaggtaagttcttttcctagggaagttctctggggattttgagagctttgagtttgttcctcctttcattggattgttttattcagcaattatttgagatgctatggtgatttatagaatacctttctcaatttgactttagrtctctgccaaaataaaatactcttgtagcttrctatgggtgacatttgtgaactcctagagggaactgataagctgaggctcttacaaggaagtaaaattcatatttctgccatgtatgaagcattaagatacagtaatggttataaatcagtgtaagcataatccctgccctcagtaagattatgaaaagggagttcaagtgtaaaatttgaacaatcctggacaaaatagttatcacaaagtattaattgacagatgaatctattgaatgattattgctgtaagagtaagagaacattggaagacagtgtgtctaggagagggctgtgattgagttgagattttaagtaggtttggaaaaattaattggatttaaatgggggaagaatgagaaaggtatttcaagtgggagggacagccctagtaaaaacaaggtagcaggtgaatttagtggtagtggtgatggtgacgttgggaaatagaatggtgagaggttttacccctgcttttttttgggtcactgtgttttccagattgtgggttgtaaaatcaactttagtgagtcatgaacagcattttaaataaaatggaatagaataggaaaagaaatggyatgtaataagtttaaatattctgtgacacttgtgtttcacagtgtggsggggtaggtgtttatattggacgtcagtgcaaaatgtgtttcttactgtgtccactgtcagtaacattcgaaagccactgctctggatccagatgacctaagaagttatattgaggcttctctagtgtcctttctcaggagctctaggagaccagttgattgttgattgttgtgatgaacattactgcaactaaagcttatcacatgtctctcaattctttacactcagcaccactgctactgagagtgtgcgctcactgtgattgtatgtgttcgtgcttctcaaaaacaagactgaaagataggtggggttttcctcatggcctcattcatgcaatgtcattatctcaggcgcttgagggtgagccaccagagttaaggggtcgtttgaaatgtccagaggtaactttgtaaaatcctctgagttgttcaagtcagttgtagctggagtagctttttagttttaaagatagtgaatgtgaaggtcagctcttagattctgcccagggtgttactcagagatctagctcattcaactgttgtttagaattccttgccttatattacttagccatttttctgttcccagttttttgctattaaacaatagtgtaatgaacattcatgacacatgttcttrtatgtacaaattatctttcaaactgactgtacaaatgtacattcttaacagcaatatgtgcaaataattgtgacccatgaactcaccaacattggaagcaatcagacatactgattgttaccatatggatgggtgggcaattatatctccctttgatttgcattcctttggttgttaatgaggttkaacatcttttgatacattyattggtcatttatactgtcttctgctgattgcctattcatatcttttgcccatttttctgttggattgttttctttcttactgatttgttctgtataaatttggaatttttatacacacacgttatttatgttgtagaaaaaagttagatactaggaaaatgatgaagaataaaatgaaattcaccagtaatcttattatgcagggataacatcatttgttatatctttctcgactattcttaatgtatatgaacaaatgtttgtagatataaatgcatacatgctcaactaaagcagaatcataccatacttgcttttttcactaacattgtctatgaacatctttccaaaacaaaaatataggtttggtaaatcattacttttaatggttatatttagtgaatctctatggtttcaaattttttactactgtatgcatgttggaatgaccaagcttatatattctgtacatctttttaaatccctctcttacaataaattcttgaagtgggattgatgatcaaagtgtatgccctgtttgggggcttattgatacatactaccgaatcaccttttagaaaaattttagcagctccccccctcattagcagtgttggtaagcwgtagttcttacacatttgattgcatgattgtacccaaataattagcagatgcaagctttccctttctctcttaatccttttggagaaaattagtctgttattttgtgttaattattgaagttgaataccctaggttattagctgtttttatttcatttataaattgttggttttgctcatttttgtagttaatggtttttctaactgattttaataagctatttttggctgggcatagcggctcacatctgtaatcccaccactttaggaggctgaggtggaaagctcccttgagcccaggagtttgaggtcagcttggacaacatagtgagaccccttctccacaaaaaatttttttaaaaaattaggtaggtgtggtggcatgtgcctgtagtcccagctacttgggaggctgaggtgggaggatgacttgaacacagcaggttgaggctgcagtgaactgtgttcatgctgtactcttgtctgggcaacagagcaaaacccwgtctataaataaataaataaatagcatttgtatatagagaacttgtttttgaaccttaccctttgagaggggtagaattcgtttttaaaaataaactttttcatatgttagttattgtagctcttttttatatttataggaaacattttcttcmaattttttctttgtcatttaactttgttttttccttgctgataactttgaagtgttcatgttttacatagtaatttcagtgattttgtctttatrgtgtgttgctgagctggcatgttttaagagcttttcaccaccttaaaagtatagcaattaaaattagaaattataaaaattgtatctgcttttacagttgtattcttagatttaaatcttttaattcatctgcaacccattttgatctcagttgcaaggtaggccttcagctccatcccctcaaccccaaattgggtaacagcggtaattactgaatagtttatttttccatcttcccccttctttgaaatagtttttatgttacatactgcattccattatatactagagtctttttctgaacttagttctgttccattgatcttcccattcctactctttcattagttattgagtccttggtcttttctcatcaaatcgaattttctcctgtgtttttcatcttgtcagttaatggtaactctttcccctcaagccartctagaagtgtaggaggcatctttgacaatcgcctcaccctcagcatctaatcagtccctatgtcctgcagattccaccaccaaaatccaygtattaataaaactgaccacacctccatcttcactgtcatctcaagccaagctaccaactctaaccttgacatgtgcagtagcagtagccgcctgtcttctttccccactttcacttttacctttgtctacttcattttctgcacaacagccagaaggatcttttgaatttacttatatttatttgctgtttttataaaaagttattgattgaaaaaatgtagttttgttatacgttcttaaagtggtagagatctccattgttttagggtttaaaaaaattttwaaataatttttatattttgcaataacttaagcataccctgagaagagaagagctcctttgctttggttgcttttgtcttgttataaaattttttttacaatagttggaatgcattttaagaatttcaaggctgtttttgagctttgttatttttaacacattaccatatggttgtgataattcaactttttattttaaaatctggcaagagacatcatcttttaaaaaataatggcctttgctgtttctgccagcttaatcttccagatgagttttcattatcgatattttcaagctatatcaggcacctaagtggtcatatacatgttgttttgttttgttttgttttgagacagggtctccctctgttgcccaggctggagtgcagtggcatgatcataggtcactgcagccttgaactcctgggctcaagtgattctcctgccttagcctcccaagtagctaggagtacaggtacacacccccacatctggctaatttttttattttttgtagagatgggcctttgccgtgttgcccaggctggtctcaaactcctggcctcatgcaatcctccaatataagttaaaaatagaaacatagtttatggctttactttatcatatcagcctttttggtttttagaatttctgatttaggggagaaactcatatcctaagttaaattaataccaatggatttaatgaattttaatgctgttcaatatgtagtcttttttttttttaatcattgaggaatgtgattgattcttggtagatttatcttatatctacaacttgaattcactgccttctagtaatttttgggttactatttttacagtcactattatatttttttcctttccatatatttatataccatttttcttcttgaaaaactactctggcaaattagaatgatgaaaatggtcatctttgattttttttttcctatgttatttaagggagtgactatattatagactggcttttgatatataatatatgcttaaaacccaggggtcagtttcaatacatatattcctttcattagccatttttttcctccattcactctatgtatgtgagtgggatgggggcattattttattatttgaggttaagagcagaggtttaataggcaaaagaaacagaaaggagaatagctctctctcctgtgagggagaggggtgcctgagtgggacttcccacttttacttttaaaatctcttttgatgcaacttactcatggtatctgtacagtaagtgtttatgttttcacatatttgaaaatctgtgagatttcccaagattggcaagcacaatgtagtatgttcttcagcctcattcagcaaaataggagtcttcaaaagacagtcctggccgagtgtggtggctcacgcctgtaatcccagcactttgggaggccgaggtggttggatcacctgagttcaggagttcgagaccagcttgaccaacayagtgaaaccctgtctctactaaaaaacaatacaaaaattagtcgggcttggtggcgcatgcctgtaatcccagcaactaaggaggctgaggcagaagaatcgcttgaacctgggaggcggaggttgcagtgaactgagattgcaccaccgcactccagcctgggtaacaagagcaaaactccatctcaaaaaaaaaaaaaaaagtcctactttacgcttcttttaataaggctaaaaagatatgtggccagtctcttaattaaatgcagtatgacagtgcttccttgaatcatattaatccatattggaagtaatcttatgtctgctagtcacatggtgaaatctgacatctcacaaaatctggtcctgaatttttatttgtcttctgcatgtctccactgagttgtgaggcctcacatgtgtcactgccagtgtgttgtgagttttttccacacagccttcagctgcttattccattccactgtaatccttatatttagttatgattgtcctcaaaattacctacaaatttgactcatctatttcatataggaaatgctatatcgcttaaaagttttaaaagcctttaaagaagactaagtgcttaaaggctttgttattcttaaaaggttagccagttttcagaaggaaaacttcttcagaccagcaaagtgttttttgtgtgtgtttgcagtataggtggggcggcggggtatcgtatgtttagtaaaatcaaaagcttttgagagatcaagtccttgatgtagaaaagtcagccttcaaaaaacagtactgtccaggtagataatcttaattgtgtcaaagaacactatgattagggaaacaaagtgtctggtaaacagcctctacaaagacagactttgttctaagtgagagttaaggaagaaagaatataagcttttaattgatatttgttttccttcagccagtgggctgtttacttacagcaaataccaagtgattgcaggggttggaagtgatagattaatttactcactactcactgtattaaattgtatacaccaacctgggtttttttgtttgtttttgtatttgactaattgtttctgactttacaatttcagtcttggaactttgccttcccggcttctttggtttacagggttgaaaaagaaagcaaaagtatctaaygacctttgtaaaacatcttttaagtgagaacctttttcataaggcagttgtttcctcagtgggtagatggtttttcctgtaatctggcattgtgtaaggaaataagaagcagcttgtctttgattcttggtgtgatggcatgaaaagtaaatgttctggtgggatccccaaacgtgttagtaggccgctatattatagctgttgtttattagattagtatcatttgaggggcttttctgtagaagatttaatttgaagatttatctttcaaatatactttggctttttcacttttattttttaggctgtgcgtgttacaaaacccaaaatcccagaagccataagaagaaattttgagttaatgtgagtaatatgcatgggatcccaatatttctgtttagggctgtctgcatattaataytccagtctagaggaaacatgtgagacaatacactctggggtggagtatgtgtcttatcttctttactcttactctagtaatattgcctattcttgtgtcttaattcccactagactcttactagtgttctctttatgtatggacatttcaggagcagtttcagtggctaaagatgcagtttgctgtaaaactattgctggaagcttaagsagctataattttatatgaatagtaccttgaattaaatatttaatagaggaaagagtcctgaagccgttagggttgaagagagtgctcatattttgtttctgtgttgtaatggtaggaatagataccttgttggtataaagtttggttttccattgtatgtgattgtatatctaaaattagacctggttctttataatgtgcctctagggaagccttgcttctgttgactcctggtagtcttctcttttatgtatccagggctgactgggaatgagaagacatgaaattagtttctgacaggatcccttttaggggaatacttactgtgtttgaaatggcaatattgttttcgtatgactggtactgaaaagaagaaataaaagtctttaggaaatttggctgatgtgttaaaagggaaagtataagacgctggaaaaataaatttgcacaagtcaaggataccacagatgtataaatactggaagtccaaggagcagtaatactactttatgaggttgtttacttctgagtcctttttgttaccatgcagatttttattgtttttttcttcttttatattttccttttccctcataccttctctgagctcatacagagttttatttctctttttcttaatttttttttttttgagacaaggtcttgctctgttgcccagactgcagtgcagtggcacaatcacggctcactgcagtctcaacctcccaggctcaagtgattaagcgatcctcccacctcagcctcctgagtagttgggactaccagtgcatgccaccacacctagctaaattttgtatttttcatagagacggagttttgccctgttgcccagcctggtctcaaactcctgggctcaagcagtcctcctgccttggcctcccaaagtactgggattacaggcttgagtcaccacacccagcctgttttctctttttcattgtagacaaagaactcttcttttaaaagtataaaatgtagactgccaggctgggtagattatggatgtgatccacttattgaaaaaatatttataggcgggctgtggtggcttatgcctataatcatagcacttcaggaggctgaggccggcggatcacctgagttcaagagtttgagaccagcctggccaacatggtgaaaccctgtctccagtaaaaatagaaaaattagctggacatggtggcaggcacctataatcccagctactggggaggctgaggtaggagagtcgcttcaaccggggaggtagaggttgcagtgagccgagaccacgccattgcactccaacctgggcaaaagaacgaaactctgtctcaaaaagaaaattttattaaactgtcagcatgtcttaggctttaaatatgattgcttaggctgggtgcggtggctcatgcctgtaatcccagcacttttgggaggccaaggtgggcggatcacgaggtcaggagatcgagaccatcctagctaacacaatgaaaccccgtctctactaaaaatacaaaaaattagccaggcatggtggtgggcgcctgtagtcccagctactcgggaggctgaggcaggagaatggcgtgaactcaggaggcraagcttgcagtgagtcgagatagtgccactgcactccagcctgggtgacagagtgagactccatctcaaaaaaaaaaaaaaaaaaagattgcttctggtgacggaaaaatgaatattgtgtgttttctgctctcaaataaatcatagtattcagactgtcatttgatgtctttatcaatgttatcagaggaaaggggaaactttgaggggaagtgttttggggaaactattggagttacttttcagatgattctggatctttcttaattttatggactattggaattccagaattaaaagctaccttgggatgatccagtataaccttgcacctgatagtagtgttttcttataccatttctgccacgtggttacccagtagctacttgtacatgcttagtaatatgccagccatttccattacaggtttagtaccccttatccgaaatgcttgggaccagaagtattttaaattttggatttgtaaagattctggaatatttgcatagacataatgagatatytcagggatgggacccaggtctaaatataaaatttatttatgttcttccttgttggtatagtggttagttttttttttttaaggtattttatttatgtcccatatacacctatagcctgaaggtaactttataaaatattttaaataattttgtgcatgaaacaaagtttaccttaagtgcttatgtgtggaattttccacttgtgtcataatgtgggctctcaaaaagtttcagattttggagcattttggatttcaaattttcagatcagaaatgctcaacctgtrttagacactggaagccttagaaaattctccttactgtaagccccagtttactacctaataactaccacctagttatatcttctgtgcaacaaatayggtcactgcrcatgggtgcccacctgaggagggcaggggctgaaacccagcttcattctgcatgtcaaaccatgcacctgcaggactgtagaaacggctggtgccgttttctaattggcacagagctgctgtatggactagctggaggtctaacagcaaaggaagtattgatatattcccttccaaatcacaggctttacacaatacaactaggagaagaaagccaaactaaaattcaaatgtactaartttttttcctatctctgggtgactttgggcaaatcattgaatctttcaacctcagatttattataagtaaaataaagtaacacctctcttaacctaccttaatgggtccaaaagctcatgttgacaaaacggttctctgactcactgtagggtcagaattactggctgtgactgcacataggagaatcatttctaatttttataacattttgcttcacagggaggctgagaagacaaaactccttatagctgcacagaaacaaaaggttgtggaaaaagaagctgagacagagaggaaaaaggcagttataggtacttggatttctctgaaatgattgtctctaagtacatttgtttgtcctgttctttgtcagtctcattttgggtatcatgggactcagtaagattgcatcataggtagtggggaattctggaatctccactgtacattcagatgttctaaagcctttaaaagtaggtgagaccagtacttaatgatgtgctgtggctgtccatcatgttgttagatgctactgttgtctctttcaagaacagggagaatggatagggtttataggcagcttgagtctgtggatagcattttcatttgtacagattaagaatagggaagttttttgaccaaagtttcagrttgtagtatgcatccttgttgttgacatgcacttagttttacctggataggtagtgccgtttatgaaagcatggcaggattgtttacagttcatttcagattacagtggcttcccttatactccaggtcactgtgtattagattgccctctttggccctcggttgatgctgaaagtttaatacrtctttaattaaataattcaattatagaggaatgtacagagaacaatataatgaaagcttaagattttgccttattcccttcagatcttttttttttttttttaagaaaaaaattaaatatctgtttgaagcctcctttgtatgttcactggtcctactctttgacttttcttctcagattaacttctattctgaagttgatgtatatcctttctgtccatatttttatacttttactgtaagtgtgtaagagtttataaaattgttttacctgtttgaaactacaaaaatgttaccaaactcttattttacaacttgccttattttcactaacattgagttttattcatattgatacatgtagatctagggattttttctttttttggcattttatccttattctctgtgagatggtagatcgtttatgtttagctgctacatttttcgttctatgagcgggcctagttttattgtaatgaattaccaatgaggagttaggtagtttctagtttttccttattacaaacactgccacaataacattcttatccagtgcctcctggatacagtgtacatgtgcaggtttccatagagtagcattactcagtgtatggtgtgggccagtgccctatcaccagctttttgtttctgagcctcaatgagatgagtatagaaattgagaatgagtgtttagaagtttttatagcattttaatacagcagttttatgtctgttgaatcaaaaatwaaaaatcagagcttatatatttatgtttttgttttttaatttcttttttctagtactgtaatttgtttttgttatagtttacaatttattggttcctcataaattgaaatacacacacaaaaaggtaaggtayttttccacaggtrgtttgagaagcactgctctagaatagctatctcaaagtagaattgatgggtcatagggtagcatgtcttcacattcaacatattgacaaattgctctctcaagtacttctttgattttaccatctcttcaacaatatttgatatccagtttctatgctgccatatttgaattcccatttccacacatccttcttggtccttggagttatcagacttaaaactttatgtctgtttaatggaagacatggtatcacataatttcaatttgaatttccctgattgttagtaaagttgaatattgcttattggtcattcaagtttccttttttgttgttgttatatgaattgcctgttaatgtccttagcccattatttgattgcttttttgagttgatttgtaagagtcctttctgtctcctggatactgatcctttttcagatttatgcatttccaacatctttcaatttgtggcttgtctttgaactttacaatgtcttcgatatacatatatgtgtagtttttgtgtagacaaattcattagtcttttcctttatgttttgtgcttttcctatcttaagaattctttccctagtccaaagtaagacttttattctaaaagttttaaagttttgcttttcatatttaagtctttagcccatctagaatttattttggtgttgagtatgacatagggattcagtttaattttttcaagtggcaagccaattgtctcagactgtttattgaatagtttattatttcctctacttatttctaatgccatatccatcatataataagatactatacataatttattctgatgccataatctattattttccaattttttggtctctccttcctcaatattaatttgttttaattattgtagcttttatgttaagtcttgcgatgtggagagtgagttgtgtaactatttctcttacctgttaactattcctaactatatttaaaattatcctggactattctaggccctttattcatccacatgaattttagaaccagctccttaagttttgtgaaatattgtgttgggattttgattggaattgcattgaatgtatgcatcaatttggagaaaattatgatattgagtcttataaatctgtttctccatttaggagagttgtcttttaaaaagtgtcataattttcttctaaagttcttgcacatttattaaagatttgttcttatatacctttatttttttattgacttttttaaaggcacattttctaatgggttttgtataagtatgctgttgatttttttatttagcaatattgctgaagatgctcttatttctaatagtcgcttagatttcccatgaacaatcatatggtcttcagacaataggtccttatcttcacataaggacaattttatttttcttctaagtcacatactttttatttcttcctgtcttactgctttaggctatgacttctaagtacagtgtagaaaagaaagtgacaagtattcttgtccttaactttaaatagtcccagtgacatttgctgtacttaacactggttaataaagtttcaatctgtactttgcttgctgagagctttcattttgaatggctgttaaaactttcagaatttttttgagacagggtctcgctttgccacccaggctggagtacagtggtgtaatcacagttcactgcagcctcagcctcctaggcttaagttattttcccacctcagcctctcgagtagctgagactacaagtgcacgccaccacacccaggtaatttttgtattttctgtagagacagggtttcaccatgttgcccaggctggtcttgaattcctgagttcaagtgatccacctgcctcagtcttccaaagtgctaggattacaggtgtgagccactgtgcccagtctgaaaattttttctacatatattgagatgtttttaaagctgttaatatggtaaattatattaacagatttatctttgtgtttctgggacaaacaatccacttggtcattatataggtcattatatacatttttatatagtttgctgataatttctttagaatttttacctttattttcataaatgagatcagcttataattttcttatacttttagtgttaggtttttttgtatcatggttatactatccccaagatgagttgaagagcatggcttccttttctgtgttctattgtatatcacatcattatgtatcagatctgtataatttcatctttgtaggtctggtggaactcgtaaaagccatcttagtcttgtgaggtttctgctttttttcatttgctttttgtggtaacagttaatctattgatttaattcctgtattgagtataggtatattcagatacatgttttctttttaagccagttttggtaattatattttcataraaaattgttcatttcatctgatatttcaaattttggggcataaatttgttcgtagaattctctcatgatttttaaaacctctaccaaatctgtgtgccccttttcattgctaatactgttttcttgtgccttttcttttgctgtatcaattttgccagaggtctgttttattttatttatcttttcagagaattggcttttgttttggttttgttgattgttactttgtttaaattatattatttacactttttaaaaaatatttccttccatcttttttttttttttagttcatttgttcttttttaacttcttgagttggatagttaagtttaagtcttttctagtggaaacatggaagattataaattttcttctaaggattgctttagctatgtttcacaggttttgaaatgtactttgtatattggtgttcagttttaattctwaaccttttccttctaatttcttctttggctcatgaattattaaaagtatatgcttcaatttctggtttagtgggttttgaggggctacctttttattgttgatttccagtgttactacattgtagtcagaaaataagacctgttatatggattcttaaatatttattgaaaattgctttgtggcctacctgtacacggtccttttttgtaaatgtctgtgtgcttgaaaagattgaatctgtgttctctggttgttggatgcaggtttctttatatactcatttggtcaggcttatgaattgtgttgttcacatcttctgtattcttctaatttttgccttcttgacctatcaattactgagaaggatgtgttaaaatttcccactatgaccatgggtttgttgacttgtaatttttttctttatatattttgggactatatcattaagaacattcaggttcaggattgttatatctccctggagaattgcttctgttttgtaataatctttatccctagatatgtttttaacttaagagctattttgcctgataatatagytataccagatttttcttggttagttattttcttggtgtaccttttcccattcttttactttcaacttttctatgtcattatgttttaggtgtgtctcttgtaaacagcatatagctggattttgtaatcttatccaatgtgagaatctgtcttttaactggtgagtttagtctttttatatttattgtggttactgctatatttggatgtgtttgtatcatttgattatgtgctatttaccatgcatttttctctgcttctttttcccttttctgattggtattgaattgattgaattttcttttcttttcttccttttacttgattggaagttttacattccattgctggaatgtataactagttgttaatcattctatcctcttcttgaacagtaccttagaatgctttaactcttatcactgtcctccagtcttacattttattattgcrtagtattttagtttcatgttgtctttatcctcccatcaattatgatcattatgattaatccttacagtaaacacttattttgattgacatgtgttgagtaatgttttttcctctccattgtttctggtgattttttttttctagtaatttttttttcagtgaagactaaggagtgaaagttatcttcggtcctccttggtctgaaaatgcttttattttatccttgaatggtaatttagcctacaattctaaaccaagctaatttttccttatcaatatggcagtattatttcaattttgtttggctgcttgcacctatttacaagtatgytgttagtccagttgttccttttgagtaatcagcctttcttctctttttgcttttaacatgtttctgtctgtatttgggtgttcttcagtttcactgtgatgtggctaggtagagaagaggttacttcttaactgggctggttggtagagtgttttagttcccctttcattagagttgcagccctctagaggtctcagttttatgcaagggtcttagtcctaatatcacaaggcctcatctcctggtcttgcatgggtaaaaacccaggtcccactcccttcttgtctaataaccaccccagggacaccaccatacaggctctcggctcccccttggcttaagttacttgaggatctctcattctttcttacaactcagccatgcattaaaaaacaaatttgctatatttcatctagcattttaagaggttgttagctaaagggttttctctctggccttttggccttttgcaccatttttctagaagtctggtcgtgctttttattgatttattcccacatgacagagctttgttgaatgagattaccacaacagtccccctatgttgaggtaacatcctttgggttctagctgcargcttcagatccctcaccttttattcatgttttatcttgagtttctgcttacagttcaatttctagccccattgaacatagtagtttagtttttggatggtgtaatatagattgattttacattggtggagaaagagggaattatctcctggagyagttcgtaaagcatactgttttatggaaagaaaaaaatcacttggaagttttctttccattatgtactttttctaggggtcagagataagatgtcctaaaatacccatcttctttgactgaaaaggagaattgagaatgttctttaagaatagcagtgattgaatgtaaagtgtaattcaagtctttcttccttgtcctgggtcatttgggtaggccagaggtttattaagggtgttgagtttcctctgcatgtacttgcttgccacaccaacatgttcactcccaatgcttgttttcaccttctcaaatgaatcacyctgctttctgctttatttccctacagcagttggaatactcctcttctgataccattttcatcctgtcatttccctaatggtaacttaacagtagatcctgagtatagtaaaactaagctccttagcctgtcactcaagacagaggtctcctagccctctttctcttcttattttwtgttgtcttcgcttgttggctggttccatatcacctctccattgtgacttgttcatttgtgccttcttgtctttcttttttttgtttttgtttttgtttttgaggcagggcctcactctgtcacgctggctggagtgcagtggcatgatcatggctcactgtagccttgacctcccaggctcaagagatcctcttgcctcagcctcctgtgtagctgggactataggcacgcaccatcatgcttggctaattttataaattttttctagagatggaggtctcactgtgttgcttaagctggtcttgaactcttgggcttaagagatcctcctgcctcagcctcccaaagtgctggggttacaggcgtgaatcaccatgactggcccttcttgtctttctctgtgcttcctggcatgtcttcttaggtcatatccattatttcctttaagattacttccagaaggtcttccttggtttaacttatgtcactcattctttctttctcctgccacattaattgtcctgtgttgccatgcatttatgttgctctgtttttgttctgtggtactttcataaagtatctttttttcccattagcttgtggaccgttgctacagagttgcatgaaggactggcactttaacctttttttactccttcttcccacaaaactagcactgtcaaaatagaacagtaaattaggaaataaattcccttttttcctttgagtagtttacagtctgactagataaaacttagtgaaacaattagcacataaaactttctgtaattaaatgttagactgtgtgctgctggttcgaagtgcctcaggtactgtagaaatggttttgaatgtgtcttcttatgttgtatgattatagaagcagagaagattgcacaagtggcaaaaattcggtttcagcagaaagtgatggaaaaagaaactgaaaagcgcatttctgaaatcgaaggtacattgtggggagaggatgaagctctgcctgtcccgaactgcctcctctctgctccagggttcaggcctttgattgtggtgggtgagaaggccatagacagaataatctggtctggaggaaatagctggcctgatagtctaaataaatttttttaaattgctatcacatttccagcttttgggtttgtttgtgactgtgggtagctcagctttccttttcttccttaaattggggcttattagctaccactttattttcaggcagacaagrtatgaaaattacccataatcaatagtaaagaatatacaagataataaaccccatctctggccgggcgccgtggctcacgcctgtaatcccagcactttgggaggccgaggcgggcggatcacaaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaaccygggaggcggagcttgcagtgagccgagatcccgccactgcactccagcctgggcgacagagcgagactccgtctcaaaaaataaaaaaaaaattaaaaawaaataaaccccatcacgaccagtttcttttccacctgtccaaaaaaaaaacaaaattaattggggggaaaaacagttttcatggagggcctcacactasttgatttcacatagtgagatgttgatgttcttagctcggtcttgaagtcacttgttatatattgctgcttcctgtctgtctctgttgactgattctggatgaaatttgkgggggggctggagacaatgcagtaaatagagcttttatgtctggacttattttacttgaagcttagtacctgggtggaatgtaaggctctgggtgataggaggtgggagagtgggtggaggagagaaggaacaacttagagtagaaaacaagtaggctcagatgagctgagagttatttgrcagtgaaaagagtattcctcgtagagaagttgctstttggggactgggacttgaaaactgctaataggtttttaaaactttcaatgtgaaataagcagtcacaatattaagcagtggggaaagggactcttaactagctgagggaatggattgacacctttcctttgtttatttgctagatgctgcattcctggcccgagagaaagcgaaagcagatgctgaatattatgctgcacacaaatatgccacctcaaacaaggtgactggctccctggccactttcctaatgatgcatttcggggttttgctttctcttttcaggagctctgatatgatagaagtgattttatccattgtcaagaaagtgtagtgaccaagacatcctccagaattagtcagttagcaagaaatatttcacattgattgggtagggacacaggccaaatgccgwaattccattcatttgtactgctatataaggctgaataattaattaagttgaaggtcttctgaaataagagtgacagaagagtaaagtctatttagaattgctttccaaataaggtagtttttttggtagatacttagcttgattagagcagtatttctcatcaaaggcattcctggcatttggggttgagatactttttcattgttgaagaccatctcatgcattgtaggatattttgtatccctggcccttgtctactgaatgtcagtagtggtcaccagttgttttaactgccacacacacatgcatgtatttccatatgccccttgttgagtactccttgtttattggatttaaaaaactattccagtcatgaggaatttcatgtgggataacttgagaaggcaggttgggtgatatataggtgataatttggtgtaaggactggggtaagctggctagacggtacagggctagtgagcaggggctatttaagaggcagctagaactccgatagtattctgagaagggaagggtatgtccaagatttataaggttatcgtggagcagattggaacagataaagggttgagaaagagattactaaagtggatgatgcagtttgaaggattagagtcaagttttaagatatagacagggcttttaatttagaaaggaacaacataatccgtatttagaagaaatgataagatgatagaatgagagttgtcagtactttgaaaaccaatataaattttaaaatgaacataacattgaaagacacagttctatagacacagaatggaatttggccaaaagaaaggcatgacaggaaactccagttgaggaaactaggagtccaaatctaatgggagaagctcgtcaggcacaagtttcaagaccttgccattgaggtctaccttattcagaaaggggcagtagttttatgccattttgaaaaatgtgactcagatactaacctatattaaaaaggcttgaggaagaaatgtggttgtgcactatgaccagatttgattggagtgtttcgacagaggatatgaatcacctggagaagatagagatccaaagagtgaaagatgtcaaagtgtagaaaataaatgctgtaggactgtgaaggacaagatggacttttgcctgggggacaggccaggactcaagataaggagaggatcacagagcagggtctgaggggctttgaaaggcatatgttacagggaacagtggaaatgggttttaatcaaatccagatagattctggttagatacatcttggcatcctgatttagacaaaacaaaacagtgtgacagagggagatctggtggtcgacgagttttaatcaaacccagataggttctggttagatacatcttggcatcctgatttaaacaaaacactgtcacatagatctggtggtcgacaaacatctgtctgtcacaagcagcttaaacatccagcttctggggaaaggcagaaggccagatcaggtgacaacttgagattttattctagttctagaatttgttcaagaaaagcagaatcacagctaatgataagataatgagcaccagcccttcctttgaagttctgctctcatccactgacctgtgtatctctctcaagagaatcaacagagaaccaggcatgatggctcattcctgtagcctccctggaggctaagatgagagtatctcttgagcccagaagtttgaggctgcagcagcgagctataattgaaccactgtattccagcctgggcaacagagtgagatctcatctccagaaaaaaaaaaggctgggtgcagtggctcacatctttgattccgacactttgggaggccaaggtaggaggattgcttgaggccaggagtttgagaccagcctggcaacatagaccccatctctacaaaaataaaaataatttttttagaaaagagaatcaacagaaactccagaccaattccaggttgaattcaactagatgaaatgaaagtcactttagaaatattagttattatcattagttatcacaaattgttttccaactcccccatccttttattaaaaagtgaacagcttctcttgcattaagtcaggagcttaatgaaggaattttaagtcaggaacgcagctgttaatrtgatagccactctccaaagtgagagagggtcattggcagttattcagacttgactcatgatactcaggagarcaataggtgaaatgtatatagggagagagaagactgttgcaccagagtattctgatgcctttgctcttgtttgctcccacacagcacaagttgaccccggaatatctggagctcaaaaagtaccaggccrttgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctrtatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtmtgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccytgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacrctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcagtgatttgtgtttttttttcccacgtcttcatttttctgtcatcttaacatgctcctaaggctgtcttgcacatttcaactagggagccagtttatttgcgggtttaacttaactgtagaggcttttgttatactcttgccagaatactgcctacctggtataagaatgtttaaaacaaggtgtccactctttgctgactcctggaatttaacaaggggtgttcttctaatcctttgtggsacagggcctgtggcagaggggcaaggagggaggatggagcatcaggccactgggatccgtccctgagagcaaaagtacttctgcactgaggaggggaggagacagaccaagccagagaaggacaatttgtgtaaattataactggtaatgtaatggcacaatataaccaacttgactattaagatgttagcggcccaagagccagagttggacctgctcttcccaaacgttctgtatttcctcctgggatcaatttcctggtgatcttgggccagcagggagtggtaatgggagttgtggggaaagcagctctttcctcctgttcttatgggatcaaccccatagtatcctaggtcagttgctgtggacctgagaataatttgaactgaccatcctataggttattggtaggtattaaaatgaagtgatttctgcctcttctgtggcaaaagaatttgtgaattagaagccgtggyttctaatcgctttaggattaagtctcaaatgtgtacacacgaagttcgtgatctggcccctgctgtcctctccagccacccttctctaaggtccctgaatgcaccttctgtctgtcccttctcatacgttgttccatctgcctggttcactttccttccctcgtagtgctgactttcctcagccaactcctgagtcttcatcacttcttcagatgtaaaagcttcagttcactttgaactgcttggcctgggttagcatcctgtatttcccccccgtcacacatcatgcacacttcatgtctcattatgtgctcaatgtctgttttcacaaatgctaatctctctgagggcgggggcgggggctgtggctgtgctgttccctggggattgtttctgttgctaatgcctaagatggcatctggcccatatgagatggctttgttgcatgaaagaacaaaaagttgaatatgacatgcaggtaaatcaggcaagtgagtcatggaaaaaacttagaagtgagcctacagtgtccatgtcaggactttatgtgtaaccatgggaagttacctaacatctctgaacctgattactcatccttgcagggtgactcttcagtggattcaggaggatatgttgttgcatctagtgtagagattcgcacgtggtaattgctgggatgcattagttcaccttgtctacaggagtcagttgtctacaggagtcaatatatgtgtctgtctctgagtagctataagttcccatagtggagagagtgagcacagtgcctgctacctgcaattgcataatagaacacgtagattaatgtcttcaccagctatgagctaagctagctggatgttaaaccccaaccacagccctccaggagcatcccaacaagctgggccagcttctcatctttctcctggtctctgccctggtaygagcacttaaaatgaatttactgggccgggtgcagtggttcatgcctgtaatcccagcactttgggaggctgaggcggtcagatcatgaggtcaggagctcaagaccagcctgatcaacatggtgaaacctcatctctactaaaaatacaaaaattagctgggtgtggtggcacgtgcctataatccccagctactcaggaggctgaggcaggagaatcacttgaacctgggaggtggaggttgtagtgagctgagatcgagccactgcactccaggctgggcgacagagcaagactctgtctcaaaacaaacaaacaaaaaaaaacaaaaaatttactgttaattcattgctcactcctagtgtctattttgacatagactgtaatgcagaatgacgttttacttgtttcccttaccatatttcttctgaattagtacctgtctttccaatttttcttatttctttcaatcaatttttctactttttttttttttaattttaaaaaatgtcttcttccrgtggggctcggtggctcacacctgtaatcccagcattttggaaggctaaggcgggcagatcaactgaggtcaggagtttgagaccagcctggctaacatggtgaaactctgtttctactaaaaatacacacaaaaaatagtctcctttctttcttcctataaatatttaytgagtatctactgtaggctagttgctgaggcaacaaaaagccatatagccttgtgtgtgtgtgtaggatggggcaatacagcaagtaagtaggcaagtgtgatagtgtggtaagtaagcagggtgttcactgggtgctgtggggcaccagtaaagatcagcccagccttttggtttctaggaagcaatgtctgatctgagccaaatttttaaggatggacaggaggcagacagccagctgaagagagcagtggtgatggtggagtgtgttccaggcagtgggagaagcacttgctattgcatttcaaaatgcagtgccaggaggcatgagaggctgtccactgcaaaccttatgaggctctactattacttcatttcatagctgagatctagagagattacattactcaagatcccatgaatatgagtggcaaagtaaggatttgaacctgtcatattccagatccaagtttaccacagccctttatatttgcctttgaagccattaggtttagggtgatgaaagctctaaattgagggsagattttagaggatgtttatagagatttgtaagccctgcagtcgaggtcaggaaaagggataatgagatggttcatgtgtgaagtggtgacttatgggtgacttctctgccctctgcaggacttggcagaggtgctcttagtaagctgagcggtatgacagctgattccagaaagatcagccctttggagcctgggggagcagctccccttatttgggttacaaagcaagtggaggtgaacagtgcagggctgatggcacaacacccagatcctgtttgcagatgttaatcactcattctcctggttgctgggagtgttcatggtgacagcttttagcagagtcgctctgcagaaattttcctcggctaaagacccctgccccgggccaagatyacatccccttcctggggacagcacattccataagtggttgatgcaggggtagaaaggcaatttgttcaaaacaaaattgcattggttttctccatatgcaagtctgtcagggtgtgcatcctaataggcacaataactgtaactggatttcagacacctaaggcaggttctgacaaactgggtgtgtctgatgcctctggcgccctatcgcaattccactccaccccacctctaaytccagctgtggccatggtagacagttccatgaggcatcaattcactttcctctgactgcatctcacctcacacatgagctgcacttactgcttttcaccctagggatcctccaacgctatggaggctgcagtcagtccaaacatatgctcaactcgagcacaagaattaatagcctctgggacaacccccaactggtaggagacaggaccacaaatggttagagaggaggtgacccaaaaaaaccttttcaatggagacagcaaccctcctgacacaagagaaactgtgaaaatcacattaaatacaattcgacagatgtttgttgagtacctgatatgtgccaggaaacctaaaatgtataaagtaatgggccagtaatgaacaacagtgagtcagacagacatagtctctgctctcttagaatcaacagtcttgggctgggcgtggtggctcacgcctgtaatcccagcactttcggaggcagaggcaggcggatcacaaggtcaggagttcgagaccagcctggccaatatggtgaaaccccatctctactaaaaatacaaaaattagccgggtgtggtggcatgtgcctgtagtcccagctacttggtaggctgaggcaggagaatcacttgaagccaggaggcagaggttgcagtgagctgagatcacgccactgcactccagcctgggggacagagtgagactccrtctcaaaaaaaaaargaacagtctggtgggaaagtagaccgtaaccaaagcacttgagagacttatcaaagtgggaggaatgcagtgctaggagggtctcaaaaaagagggagaagataaagaatgaaaaagagcatccgccagttaaagatcggggaataacaactcaataaaaagacaacccaattttaaaatgggcaaaggatctcaacagacatttcttcagacaaggtatacaaatggccaataaaaacatgaaaaagggccgggcgcagtggctcaagcctgtaatcccagcactttgggaggccgaggctggcggatcacgaggtcagragatcgagrccatcctggctaacacggtgaaaccccgtctctactaaaaatacaaaaaattagccyggcgtggtggcgggcrcctgtagtcccagctacttgggaggctgaggcaggagaatggcgtgaacccaggaggcggagcttgcagtgagccgagatcgcgycaccgcactccagcctgggcgacagagcaagactccgtctcaaaaaaaaaaaaaaaaatgagaaagatggtcgacatctttagtcattagaggaatgcaacaagatagccacttcacacccactaggatggctataataagaaaggcagtaactagtgtgggcaaggaagtgaagcaattggaatctgcataatttgctggtaggaatgtaaaatgagggcactgccttagaaaacattttacagtttctcaaaatgttaaacagagttaacatacgatccagcaatctcacttctgggtatctacccaaaagaatgggaacatgtccacacgaagacttgcgctctatagcagcattatgcatagtagccagaaggtggacacaaccccagagtgtccatcacctgatgaatggataaatcagatgtggtctatccatgcaatggaatattctataaaaaaggaatgaagtactgatgcatgctacaacacgaataagccttgaaaacattasgctaagaggaagaagccaggttctagttacattaaatgttcatcatagacacatccctatggacgaaaagactggtggttgcctgaggctgggaggagagggaattgartagctgctaatgggcacggcgtttcttcttggggtaatgaagagattttaaaatttgattttggtggtagttgcataattctgcatatactaaaaactattgaggctgggcacggtggctcacgcctgttatcccagcactttgggaggcygaggtgggcagatcatttgaggtcaggagtttgagactagcccagccaacatggtgaaatcctgtctctactaaaaatacaaaaaaaagtagctgggcctggtggcctccgcctgtaatcccagctactggaggaggctgaggcaggagaatcacttgaacccaggagacggaggttgcagtgagccaagatcgcacgtgccactgcactccarcctgggtgagagagcaagactccatctcaaaaaataaaaatttaaaaaataaaaaataaaaactactgaactgtatactttaaattataaattacatggcatatgaattatatctcaagctgtttttttttaaaggattgagtaatagtgtgaagacctcagttcaagaaccttccagaaatggtaaaaaaatattcaatataggtgcaacattattagtgagaatgagagcaccaaaacaggaggctgaagaggtgggtgtgagaagaggggaagggc

SEQ ID NO: 13431 - DNA, 47622 bp, Homo sapiens
aatcagtcttaccccttcttccaacccttttccttttccgtgcatgtattgatctattttttttttttttttgagatgaagtcttgctctgtcgcctgggctggagtgcagtggtgcgatcttarctcactgcaacctctgtttcctgggttcaagcgattctcctgcctcagcctcccgagtagttgagatttacaggtgcccaccaccatgccaggctaatttttgtatttttagtagagacggggtttcaccatgttggccaggctggtctcgaactcctgaccccaaatgatccacccacctcggcctcccaaagtgctgggattacaggtgtgagccaccgcacccagccatgttgatctatttttaaaaagtttttatttcctgttacactgtgttcagctatcttcagccaccttaaattcccatggatgagttttcataaactttttgaaaatagatttagatttacgggaaagttgcaaagataatacagaatttaatggatgagtttttttattgatgtgtaatagatgtatgtattttcagagtacaagtgataatttaatacatgtatataatgtgtaaatattaaatcaagagttattgggatgtccttcaccttaatatttatcttgtctttatgctaggaacattatttgaattattctcttttacctattttgaaatgtacaatagattaacattagctatagttactctactgatctatcataggtcttatttcttctgtatttgtgtccactaatcaaactcttcatcctcacgtccccaccacctttcctggcctctggtaaccaccaatctacctccatctccatgagatccacttttttagctcccacatgtgagtgagaacatgtaatatttgtcttttctgtgcttggcttagttcagttaacacaatcacctccagtttcatccatgttgctgagaatgacagaatttcattccttttatggctgaacaatattccattgtgtatatataccacattttctttacccattcatccattgatggacacttaggttgattccatattttagctattgtgaatagtgctgcaataaacatgagagtgcatatatctctttgatatattgatttcctttcttttggatacatacccagtagtggaatttgctggatcatattgtagttctatttttagtttttggaggaaactatacaattttccatagtggctgtactaatttacattcccaccaactgtgtacaagagttcctctttctctgcatccttgccagcatctgttaattcctgtcgtcttgataggaaattttaagtgggatgaggtgatatcttgttgtggctttgatttgcatttctctgatgattggtgatgttgagcattttttcttatagctgttggccatttgtatgtcttgagaaatgtctattttgatcttttgctccccccgctttgtttttttaagagatgagttctcattatgttgcccatgctggaatcaaactgggctcaaacagtcctccygggactgggcatagtggctgaggcctgtaatcccagcactttgggaggctgagtaggtggaccatctgaggtcaggagttcaaggccagcctggccaacatagtgaaaccctatctctactaaaactacaaaaaattagccaggcatggtggtgagcacctgtaatcccagctacttgggaggctgaggcaggagaatcacctggaccccagaggtggaagttgcagtgarctgagactgtgccactgcactccaacctgggtgacagagtgagactccatctycccaccccctycccctyycccaaaaaaaccctcctgcttcagcctcctgagtagctgggactacaggcaagcaccaccacatatggctttgcccatttttagacaggattttttgtgggtttttttcgctattgagttgtttgagctccttgttatatttattctggttattaatctcttgtcagatggatagtttgcaaatattttcttccattctgtgggttgcctcttcactttgttgattgtttcctttgctgtgcagagctttttagtttgatataatcctattagtctatttttgcttttgttgcctgtgcttttgaagtcttatacaaaaaatttttgcccagatcaatatcttggaacatttctccagtattttcttctggtagcttcatagtttcatgtgttaggtttaagtctttatccattttgatgcgatttttgtatatggtgagagatagagttgagtttcattcttcagtatagggctatccagttctccaagaatcatttattgaagagactgtcctttcctcattgaatgttcttggcacctttgtacttttggtattgacataaaatgagttggctgtaaatgcatggatttatatatgttccattggtctatgtgtctatttttatgtcagtaccatactgattgggttaccatagctttgtagtagattttgaggttgggcagtatgatgccttcagctttgtgctttttgctcaggattgctttggctctttggggtcttttgtggttccatatagattttaggattgttttttctatttctatttctgtagagcagcagtccctaatctttttggcaccagggaccgcttttatggaagacaatttttccgtggacgcggggggatttttttttttaatggtatgaaccatatttattgaaaacattatttctggcctttctcaaattgaagactgcaaaaaataaaagcagtgctttattgagttgtcattaaccttgagagcagtggcgctgcctctccacgctctggggacggtggaaaccgtggctggtgcgtgccacatctatcacacctcggtctacaaaacagtcctgacgtcaaataaaactattgtggccgggcgcggtggctcacgtctgtaatcccagcactttgggatgccgaggcgggcggatcacgaggtcaaggaaatcgagaccatcctggctaacacggtgaaaactcgtctctactaaaaatacaaaaacaaaattagccaggcatggtggcgggtgcctgtagtcccagctactctggaggctgaggcaggagaatggcgtgaacccgggaggcggagcttgcagtgagcgtagatcgcgccactgcactgcagcctgggcgacagagcgagactcagtctcaaacaaaaacaaaaacaaaacaaaacaaaacaaaaaaaacaaacgctcgtacatgacatttacattagaaaaagagagctgaaagtagggatggggggatggtttggggatgaaactgttccacctcagatcatcaggcatcagattcttgtaaggtacgcagcgccgtagaaccctcgcatgtgcagttcacaatagggttccagcctctgtaagaatctgatgccaccactaatctgataggaagtgagctcaggcggttattctcacttgcccaccgctcgcctcctgctgtgcgtcctggtttctgatgggtactggtccatagcccgggggttggggatccttgctctatctagagaatgccatttgtattttgatggggattggactgaatctgtaaattgctttaggtagtgttgtcttttttctttctttcttttttttttttttgagacggagtctcgctctgttgcccaggctagaggctggagtgcagtggctggatctccgctcactgcaagctctgcctcgcgggttcatgccattctgctgcctcagccttccgagtacctgggactacaggcgcccgctaccacgcctggctaatttttttgtatttttaggagagacggggtttcaccgtgttagccaggaaggtctcgatctcctgacctcgtgatctgcccgcctaattcttctaatccataagcgtggaatatctttcctttttgtgtgtgtgtcctctttcatcagtattgtatagttttccttgtatagatctttcatttctttagttaaattgattcctacgtagtttatattctttgtagctgttgtaaatgagattgcttttttgatttctttttcagattgtttactgttggtgcatataaatgctactgatttttgtatgttgatttggtatcctgaaacttttactgaattcgtttattatttctaacagtctttttcgtggagtcttttgatttttcaatacgatgagtttttatgtcttacttttgtatcctcttctgggaattattacctgctcatgtttggcaaacttctactcttcttcaagattcagtcttgagtgctactcctgggcagtgctgtattatccaaagagtaggaaaaaatgcatgcttatgtgccagcaaagcagagccaccagttatgaggcaagaaacaaacaaaaaagaaggcttgtaggctgtgggaaaagccagaactttgtagttttgtttggttattgagacagggcttgctgtgtcacccaggctggagtgcagtggcaaggtaatagctcgctgaagcctccatctcctgggctcaagtgatctccccacctcagcctctggagtacctgggagtacaggcatacggccaccatgcccagctaacttttttttttttctttttaaatttgtagtagagacgaggtctggctatgttgcccaggttggccttgaactcctgttctcaagtgaacctcccgcctcagcctcccaaagtgctgggattacaggcatgagccactgtgcctggcctgtagttcttctttaatcttatgttttattaattttgaattatttagatgcccttgatgagtcttcctttccccgcagtcgtcaggaactctctcttgtttccatttccttacacacttgtttcctaccacttggcctgaacccttcaaaaaagtcaatattacaaaaactaaaaccaaataggtaggagggcttttgtagattaaaatagagacagaaccaaatgcaagtgtgaaacttgattgcatctgaatcaaaacaagccccaaatataaaatcagtttgtagggaaatatggagaactttaaatatggatgtatattaggtaatattattgaataattaatgttaattttcttarctstgttaatagtattacgsttatgtaggaggatatcctaatcttaggagatraatggagatgtattcctgwtktccgcactttattttattttwttttttgacacggagtctcgctctgtcgcccaggctggagtgaagtggcgcgatctcggctcactgcaacttcctcctcctgggttcaagcgattcccctgcctcagcctcccgagtaactgggactgcaggtgcgtgccaccacgcccggctaattttttgtatttttagtagagagggggtttcaccgtgttagccaggatggtctggatctcccaaagtgctgggattacaggcgtgagccactgcgcccggcctgtactttactttcaaatgattgagtgagaatggaagggcttgggcactttgagagaaagagaacacaagcaaatttgccaacatgctgagacttactgaatcaaggtaatagccattattcttttaacttttttttttttaatttgagacggagtttcgctcttgttgtccaggctggagtgcaatggcgcgatcttgactcactgcaacccccgcctccctggttgaagcaattctccaccatgcccrgctaatttttgtatttttagaagagacggggtttcaccatgttgcccaggctggtcttgaacgcccgacctcaagtgatccgcccgcctcagccttccaaagtgctgggattataggcgtgagcgtccacgcccggcctcttaactttttgataggttaaaaacttacaaaaaacgtggatagagggggtctgtcttgcccactagaccgatatggtgttggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcrctgacgtctgattgttgcgcggtcgcatttttccggggarcgcggattcgcattcccaattttaggtggcagtcgcaacccrtactattcggacagatggcacagaaaccgctgcgcctgtgagtgaccgtgaatggaagcctctctccctgtgtctctttcgtgtgtgtaggtgacgacacgggcgggagtctttcccatgacgggaagggagaaggaaaaggcggagagacacggggctgctggggagcttaggtgatgtctttgcctggccggggctgacctcttttcctggcccttttcgcttctgagggggtttctcttggcgacgctcgttcggagaggcggaagctcccagagttaggcctcctccatcttagggggcagtcctggcctytgacacatcctttccccttcgtttctcctgaccccatttatttactcgccaaatagccattgggcccactgatgggccctgggcagtggtggacagagtagatagggacccttccctggggcattttttttttttttttttttttgcgaggaggaggggtgggggtggtggtgaagagagggcttcatgcagcaagtatttattgaagaactgcagtgtgccggacgctgtgctaggtgttgcaacagatggagttcctgctttaatggagcgtagagtctagaggaacaggtactaaagaatccagataatgggccgggcgcggtggctgaggcaggagaatcgcttgaacccgggaggcggaggttgctgtgagccgagatcgcgccactgcactccagcctgggcgacagaacgagactctcaaaacaaaacaaaacaaaacaaaacraacaaaaaacaatacaaataatggccgggcgcggtggctsacgcctgtaatcctagcactttgggaggctgaggcgggcggatcacttgcggtcaggagttcgagaccagcctggccaacgtggtgacaccccgtctctactaayacaaaaaaaaaaaattagccaggcgtggtggcgcgtgcctgtaatcccagctacttgggaggctgaggcaggagaatcgcttgaacccggaggcggaggttgcacagtgagccgacactgcacctctgcactccagcctaggtaacagagtgagactccgtctaaaaaaaaaggaattcagataaatgtaaagttaccatagtgatagggccaggcgcagtggctcacgcctataatcccagcgactccggaggccaaggcaagagaatcacttgagtccaggaattcaagaccagcctgggcaatatagcaaggccccgtttctacaaaaaatacagaaaaaaaaaaaaattagccgggcgtggtggtcccagctaattgggaggctgaagcaggtggaccacctgagcctggggaggtcgatgctgcagtgagctgtgatcgtgctgctgatctccaggctgggtgacagattgaaaccctgtctcaaaaaaaaaaaaaaaaaattgcaatagtggtaacttttgggaagaaaatattcgtgaatctgggagagtgcataagaggggtatttggcttaatgataggagtcaagaaggcttcccgagaatgttaggattgagccttgggaaataagagtaatccattgcttaacagcagggttatgttctgagaaatgagttggtaggcgatttcgtcattgtgcgaacatctttgagtgtacttccagagacctagatggtatggcttcctgtacacytaggctaaatggtatagctgtacgtcaagttactgtactgaatactgtaggcaattgtaacacaatggtaagcatttttgtatttaaatatagaaagggtacagtgaaaacacctggcyrggtgtggtggcttatgcctgtaatcccaacactttgggaggccgaggtgggtggatcacctgaggtcagaagttcaagaccagcctggccaacatggtgaaaccctgtgtctactaaacatacaaaaattagccgggtgtggtagcgggcgcctgtaatcccagctactcaagaggttgaggcaggagaatggcttgagcctgggaggcagaggttgcagtgagccgagatcgcaccactgcactccagcctgggcgacagagcgagactgtctcaaaaaaaaaaaaaaagaaaaagaaaaaaagaaaatactgtatacaggaaaaaaaaaaagggcacaacctgtgtaggacacttatcatgaatggagtttgcagaactgaaagtttctctgagtgagttagtaagaggtgagtgaatgtattactttacagtattgtagactttatgaatactgtacacttcacctatattaaatttattaaaatattattttcaacagtaaaccttagtttactgtaacttttactttataaactttaagtttttttacactttttgactcttgttataacacagctaagacataaaacacattgtacagctgtacaaaaatattttctttatatccttattctacaagcttttttctattactttttttttctttttaccttttaaactttttttttttttggagacagggtctcactgtcgcccaggctggagtgcaattgtgcaatcacggctcactgcaacctcaacctcctgggctcaagtgattctcccacttcagcctcctgagtagctgggactacaggcggaagctaccacacctggctaatttctgtattttttgtagagagggggttttgctatgttacccaggctggtcttgaactcctgggctcaagttaccctcctgcctcagcctcccaaagtgctgggattacagacgtgagccactgtgcctggctttaaacttgttttgttgcaaactaagacacacacacgagtctaggcctacacagggtcaggatcatcagtatcactgctgttcacctccatatcttgtcccactggaagggcttcagtagtaataacatgcatgaagctgtcatctcctatgataacagtgccctctggaatacttcctgaaggacctgcctgaggcttttttacagtcaactttttttttttttttttgaatacgtaggagtrtactctaaacagtaaagagcataccatactgaatatatttttttttttttgagatggagtcttgctctgttgcccaggctggagtgcagtgccrcgatctcagctcactgcaagctctgcctcgtgggttcatgctattctcccgcctcagcctcctgagtagctgggactacaggcgcccgccaccacgcccggctaattttttgtatttttagtagagatgaggtttcactgtgttaaccaggatggtctcgagctcctgaccttgtgatccgctcgccttggcctcccaaagtgctgggattacaggygtaagccaccgcacctggccatagcatgctaaatattatacataaaccagtaacatagttgtttattatcattatcaaatattgtatactgtacataactgtatgtgctacactttttataaccaccagcccagtaggtttataccagcattaccacaaacaaatgagtaatatattgcactatgatgttacaaatggctagacatcactaggcgataggaattttttagttccattataatcttatgggaccaccattacatatgtggtcccttgttgaccgaaacattgttatgtggcacrtaactgtattcttgtctttaacctaaaaaggttattgaaatgcttaagaacgctttggcatgatcaaattttcattttggaaagcagttctgtctgcaatgtggagaacaaatcagagccaaagtagagaacagctgggattaggtagagtgatgacagaggaatagtttagggattcagggtttattaaggaagtaaaatcaacaaggcttgtgatggtttaattgtgagtgaaaaggagctggccttgttgggtcatagatttctatctttattcagtgggatagagaacagtggaaaagggcccagatgaggagatgaggcacctggtgatgtataaactggacagtggatctcccagagacaatggtaattccgtgtgacaactgctgtgatggaagaaatgcaggctcctatgggaacactagaaattggtaactgataggtactagaaggcttcctagaggaggtggtgctcaaaatataaataaaagtcatattagtttatgacaaagctttctctgaaatgctgtaatgtggttttctgagtttttgagaaggtaatgacttctgagccagccaggaaggcttcagaaatgtgctaaaccttgaaggatgggaaaaacttggatttaggatgggtagggtggaactaccctagggaatgacagaggcagagagtaatcaaattgccagttcagttaagaaaacttggagaaagtactagaaagrtgacaggtcagggcctgtggaaagctgtggttctataggcagtggggaacctcttaatgttttgaggaaagaacattaaactgactactttctgtaggatggacaggaggaagagaaggcattagaggaaacataaatgtattctctactttgaatctaacactagatgcattgtatttttgtctgattcttcctctgccataggaagggggtgaggtggggtggagtggagtggaggttgcagtgagccaaggtcgtgccactgcactttagcctgggtgacagagtgagaccctgtctcagaaaaagaaaaaaaaaaagtttggcgaggtgtacaataaaagcacgccagaaagagacactcacaaaacaataaaattttaatatttcaagatgagttaaaagacattaaggaaatgatataagccgtggaaaaaccacataaatcagaattagaaaatctcagaaatgagatgatagtaaaagtcacttcacaacgtagggccagtttaccttaccaatgtcagctcttgccattttctacttcctgccccataacacttcacacatacctctgttgtagcccttttcttataaatttataatgattagagtgtcttcctttccctgattataaactctttgaggcttaaactgagtcttcctccaccttgtactgctaacatgtttttagcatagtatacttggcatattgtacttagcgtatggtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtccacaaaacttaggaatgaggagaagaagctggctcaattgtggagtaaatgataagctaaattttagatacggcgagtgggaggtgttggtgagaccctcagtggatctgcccagtggtttacgtgcactgaaccttgcaaggtaactgcagagagactagatcatgtatctatctaatccaaaagaccartatataccaaacccggcaggcccatttgtttcctgaattgctataatgtttatctctttgtttgcagcttggcttgtggagatgttgaaggaaagtttgatattttattcaatagagttcaagcaattcagaagaaaagtggaaactttgatgtaagatgtttgtttttactgaatttaattttacctttgtagtcayacataaaaataaagtttgcactcctttaagtcttgattgaacacataccatttttgttaaattgarttcccttcatgagcataggaacttagtagctgctgagtggctgggggagggagacctatttactgtttactattgatctttatattttttgaatttgaatattgttactttatcactgtacaaaaaactgaaaacagactagcaacacttccctaagtgattctgacctctgggtttgggaagcacagatctatttcatgaatgtgatgaggattaagtcaggtaacatacataccaacccatcacaagcttaaaagctctatatgaatgttgtgtatggttgccaactagactgtaaactcctaagagtacagaagagagtattccaggtatgaggataatttgttcattgggttaaaggttgggtaaagacaacaggcaggaaatgtgttttttataccttgtatttctcagattctaatattttaagtttttttgtttcacacggggattctttaaagatctatttctatgtgactgtatattccagggaaggatatgtggagagagccatgaatggcagagtgggactgggaatttgaggagcacttgaattctaacttactttaaaagtttagttccttgactctctcttacccatctctaacttgaatttgacagccaaagagccaaaacttaataattcatagaatcagtaactgttaacagttgctgctaaagaattgtatattgaaatctgcaaattgattaagaattaaaaactgatttgaaactattaaataactagttgaatattactatcaattatgtactgtwtgatattttaaaatctcatatatctgtttaaaaaactcattttagctgctgttgtgtgtaggaaatttctttggctccacccaagatgctgaatgggaggagtataagactggcatcaagaaaggtatagaaattatttttatttaacatatgatttctaataaaatttcaagggccagagttcttgcagagttgtttttcattatttaagaatttaagagttattttcagtatttaagaatttaagttgcttttcattattaagactatccggcgcagtggctcacacctgtaatccccgcactttgggaggccgaggcatgtggatcacctgaggtcaggggttcaagaccagcctggccaacatggtgaaaccgtgtgtctactaaaaatataaaaattagcagggcatggtggygcatgcctgtaatcccagctcctcgggagactgaggcaggagaattgcttgaacctgggaggcggagattgcagtgagccgagatygcaccactgcacttcaccctgggcgacagagcaaggctctgtctcaaaaaaaawaaaataaaataaataaaatagccaagctacaaggttgggtgtagtatatccttagtggatagctgttccacatttaggattgctaaatatggggaatgtgaatgcatggactatttacttttaatataagtattttttctatagagaggcatatcttaagttctaaagcagatctggtaactatatggtgtcatgtctgtttcyctcactagctcctattcagacatatgtgcttggtgctaataaccaggaaacagtaaaatatttccaggatgctgatggatgtgaattagctgaaaacattacttatctgggtaagctgatacttgttgtattttttttttgttttttgttttttgtttttgagacggagtcttgctctgtcacccaggctggagtgcagtggcgcaatcttggctyactgtaacctccacctcccgggttcaagtgattctcctgcctcagcctcctgagtagcttggattacaggcgtgtgtgaccatacccggctaattttttttatatttttagyagagacagggtttcaccgtgttagtcaggatcatctcgatctccttacctcgtgatccgcccacctcggcctcccagagtgctgggattacaggcgtgagccaccgcgcctggccgatatttgttgtatttgtaatgaacataatatagtgttctcaggaattagtctcccaggaaatttttggctagatttttcagtgattgcagcctgagataatggggtttggagggttttttcccagagtctgtatatgtgctgctgtgcccttaggacaatgcctttaggacagtggcattttttctttattatttctaccacttagccccaatatcgttgcgttcccacaacccggtacacacttgtttagccaactggagggataaactccttgtctatagtatatgggatacttaaggtataaattatgttcacacaaaggaaatttcatgtatgtggctttaccatacaatcttgctaggtatatacagcttacttgttaatgagcctcccaactatttatagctctaggtttcactctaaggttttggcaactcaggtttttagtgctgttctttgggggctttttactctttttttactctcctttttctggttctaggtacactcttcagttccagcttaaagttgtttcctccacagccctctgtattgcttttagtggctctttcaatgtctggctgttttcaaaagcactgtcaaattttgcttttgttttccccccacctgctggcagtctgctgcctcttagatcattcaactcttttttttttttttttttaagacagtgtcttgctctgttgctcaggctggagtgcagtggcatgatctcggcttactgcaacatccgactccctggttcaagtgattctcctgcctcagccttccgagtagctgggattacaggcacgcactaccatacccagctaatttttgtatttttagtagagacgggatttcaccatgttggccaggatggtctcgatctcctgacctggtgacccgcctgcctcagcctcccaaagtgctgggattacaggtgtgagccactgtgctcggctttttttttttttttttagttgaatttactattcttcacatttcctccttgttggtcttatttctctagaaaacttcttcatttcctttgctgtaaatgtcctctctctccttccccatcatagttcatcttggcctttagtctttatttggctatggccctcccgttaccagtcttattttgcactaatcctgtgggacttctttaagcaaaaattgaaggaaggactttatttgttttgttgttttaatatggaactcttcatgaatttgcatgtcatccttgtgcaggtgccgtgctaatattctctttatctttccagttttagtatatgtgctgctgaagtgagcactgtttagttttaactacacatatcagatacgcattttgaaattctgttgtagattttaacatgagcctgacttatgcagttcttggtatagtttgtagatttggattaagggcattactgtagatatttggcagccattttactatatgaatttagtgccaggaaaggaaagagcagctaaggtacttgggttatttctgtgaaatagattttttggatccagtaggaggatcaagcartgaacttggtagtgaacatgtgatagtgagcttgaaatactggtaggacatccaacatatagttggaagtgagagttattattattattttttgagatggactttcgctcttgttgcccagactgaattgcaatggcatagtcttggctcactgcaacctctgcctcccggattcaagcgattcttctgcctcagcctcctgagtagctggggttacgggtgtgtgccaccatgcccrgctaattttgtattttttagtagagacagggtttcaccatgttggtcaggctggtctcgaaatcctgacctgaggtgatccagctgcctcagcctcccaaagttctgggattacaggcattagccactgtgctggtccgagagttctttctagagtatcagtgttgaagagtataggctttggagagttggtcccataatgatgaaaaatagagctgagaagaggatcaaattattaaggaagaaatacaatcagaagggaagcaggttgatgatagtaccttggtgggtgrggatggtatatcttcatctagggggtaggaacaaagacataaaagtgcttagaggactgtttgagaggtaaagatattgtcaacttcatggaatctactgaagataacatagtttcaggagaacattggcaaatatagggtgacctttaagagagtgatgggagagggaaactgattgcagggggttaargaactaataaagtaggctgggcgtggtggctcacacctgtaatcctagcaccttgggaggtcgaggtgggcagttcacgaggtcaagaggttgagaccatcctggccaacatgatgaaaccccatctctactaaaaatagaaaaattaactgggcatggtggcggtcacctgtagtcccagctacttgggaggctgaggcaggagaatcacttgaacccgggaggcggaggtggaggttgcaatgagccaagattgcgccactgcactccagcctggcaacagagcgagactccatctcaaaaaaaaaaaaaaaaaaaaaaaaaggtaaagcacttagcatggatgactcttcagaaattcaaaaytgaagaggaggaagtttcttagtatgtgtgttcattttggatggcgatgattgagcatatttttttctgaacaaaaagcgccagctgagtagactcagtagatgaaagggaagtgaaaattgatggagcaaggtcttgaaggcaacaggagggaatggaaacaaggccacaagccaggaataaccatagaagagagtggcgtcttaaatttttcctaaacacttgttctttccaaatgttttccttcacttggaagttgctgcctgcctccaagtagctgggactacaggcacacgctgccatgcctggctaattttttgtattttagtagggatggggtttcactatgtgcatcttttctagactgtagcttccttagaactgtatttttcttcgcattgccttttcctgtstccagatgtctgcatttaagtccatgtagaatcttctctagaacgcagaaagccttttccctaatcttctcttcccaactttttccagtaatatttgtaaggcacctggcataaacatactggcccgtgggctccagcagcctccacgtagggctgttcatatttactgagcaggaatactgttgtagccattcaccattgatgcctagcagccagaagggagctgctggagagtttacacttcagacatgtaaaatggcagggacataggagagtcatgggagattcatccccctattgatggcttttcattctgcaattytgactaaaatttgttcatttttctttgaacccaggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtrtgtggggaactttgggaattcttctgtgagtagtgtttgtttagttggaatttctaaaagcaaattgcactggcttgagttgggacttttttcttttcctgtttatattgagtattttagctcttgggtaccttttattagaagtcttctgtgaaaattttcaggattctaaaagttctgtcaactgatcaaagcaaaagttaatttcatgaaagtgtgattcatagatgagactgctgaaatcttaattataaaggaatggttttttatattctctgcttcaagtgccctttcctaagcctcttaatgttttgaggcttcactgatttttttgttttttgttttttgtttttttttgagatggagtctcactctgtcgcccaggttggagtgcagtggtgcgatcttggctcactgcaacctcctcctcccgggttcaaatgattctcctgcctcagcctcctgagtagctaagattataggcatgcgccaccacgcctggctaattttttttttttttttttgagatggagttttgctgtgtcacccaggctggagggcagtggcgccatctctgctcaccacaacctctgcctcctgggttcaagcaattcacctgcctcagcctcccaagtagctgggactataggcgcacactgccatgcctggctaattttttgtattttattagagatggggtttcagcatgttgcccaggctagtcatgaactcctgagctcagacaatctgcctgcctcggcctcccaaagtgctgggattacaggcggatttttttgtatttttagtagagatgggatttcaccatgttggccaggctggtctcaaactcctgacctcaagtaatttgcccacctcagcctcccaaaatgctgggattacaggcatgagccaccgtgcccagcctaatttttgtatttttagtagagacagggttgcccaggctggtcttgaactcctgcgctctagtgatccacccgccttggcctcccaaagtgctgggattacaggcgtgagccaccatacctggccagattttaatattttatgagtaatcttgaaaaggatggtacaccaggagtgacaactatcatggggagtgaaacrctacactggtggaagtaagcctaaggaagattttgaaaaggttatgtgtgagggcagaaaacactgggtgagcttcattgaagggaaatgtaagaatgcatttsggaacaaatctccatggttggattcaggattatcagtgatgatccagaagtggagcctgtataccaccccttgccagtttcagcaccatgtgtccatgaccaaaaaggccaacaggataccaggcattatcaaggaggatgctctcttcctttttgacaaacccatgattactctttacgtagaatacaaggcatagagctggttggagcacaaggatatagcaaagctagggaagatcgagagaagggctgctaaagtgatgaaggaagagagaaagacacatatgatgctctgtaaggaaggatgakaaaatgaggcccctttgttttgcggggagctaaaaattgattttgatcaaggcttataaataaccatacagtatatttatggaggagaaaagtatagttcaccagtccctaagatgctaggactgacctcaaagctaattccctgcccttcagcagaaacctgaaggaaacaagcataagacaaaaggaaattcctgctttacgtagtggaaaacaaactttgttagcttatttccaagtaataccttctcttagaatagagttcataaataatgctgtgggtgagagatcacttaattggttgttaacagaatctggggatgttctgggagcaagaataactttgagcaaacttcatattacttaagaagggtgtggttatgcccttcctcaaactgccacttccttgactgaagcaaaataaaggattatatgctggtgatgaagtccttgaatactctataccagatattctgtggatcctaggagccctgaagcctagcttttcgctttgattttctgaattgactatgactgtctggacccgtgaactacagatgcactacgtaacaaactagaggctgggcgcagtggctcacgcgtgcactttgggaggctgaggcgggcggatcacgagatcaggagtttgagaccagcctggccaacatggtgaaaccccgtctctactaaaaatacaaaaattagccaggtgtggtggcacgtgcctgtaatcccagctactagggaggctgaggcaggagaatcacttcttgaacccaggatgcagaggttgcagtgagccgagattgtgccactgtactctagcagcctgggtgacaaagcaagactccatctcaaaaaaaaaaaacaaaccaaaactagaagcccagtctgtgggctccagagggagagcttactttccaaaaaaggttttaataatttgtgttttgggtattgatatggaggagttaccttttaatctctggcttccaacagttgttcctatttctacattcatagtagttcagctcccttatttgttaagattttttctctgattgccatacttatgaaattcaatgtgcagttccttctgtccacatctgtattcatgtataaatttcaaagacatttcaaaatgtcttattatttatttgcatttcttgataacttttggtctgtatggatgactaagtttttgtttactagggagaagtggataccaaaaaatgtggttctgctttggtttccagtcttgccacgggcttgaaaccaagataccattttgctgctttggaaaagacctattatgagaggcttccatatcggtgagtagcatttcattcttcttggctttttgaagaatttgccatggatcttctgtataaacttctcttgttcgtttttaaccatataacatcttggttccatttggttactcagacactgaagtaagtgactctcaagtcattcatcttctctgagtttgttccctaatttgaaatcactttggaaatccttcagtttcagaatcaagaacttgtatcagttttttccttttcagggccaggcatgatggtgtgtgtctgtggttccagctacttggaaggctgaggcaggaggctcgctcgagcccaggagttcaagactatagtgtgcaatgactacgcctgtgaatagccactgcactctagcctgggcaacatagggagccccatttctttaaaaaattttttaccacaaataaatatgagataatgtatatgttaattagcttgatttagccatcccacagtatatacacatttcaaaacagcatgttgtatacmataaaaaatacaaattttagttatcaattaaaaataaatgagagggaaaatttaaaaaatttttttttgtcttttttttttttttgagacggagtctcgctctgtcacctggctggagtgcagtggcatgatctcggctcactgcaacctccgcctcctgggttcaagtgattctcctgcctcagcctcctgagtagctaggattacaggtgcgtgccaccacgtccggctaagtttttttgtatttttaatagagacggggtttcaccatgtcagtcaggctggtcttgaactcttgatctcatgatctgcccacctcagcctcccaaagtgctgggattacaggcgtgagccaccatgcccagccaagaaaatatttttttttattttttttcttttgcactcagaggtggagtttttatttttttaatttttgggggtacatagtagcatagtaggtatatagaggtcaagttcttttttttgagacagagtcttgctctgtcgcccaggctggagtgcaatggcatgatctcggctcactgcaacctccgtctcccaggttcatgccattctcctgcctcagcctcctgagtagytgggactacaggcgaccgccaccacacctggctaattctttrtatttttagtagagacagggtttcaccgtgttagccaggatggtctcgatctcctgatatagaggtcaagttcttaaagaatatactgccaagaaaaccagtgttttacaagtgagagagttaagtaaaagctcagaattatcttcactgataaagggcatggattatccctaaaataacttctttcccttcttttttacaaaagtaatatttacgtgttgctagttaaaaaaatttaagtgagcaagaagagaataccccccttaccataatcccacagcctaatgcagaatcataggtaatacaggtttttctgttaaatctccatatactyattctagaagaatgtcttgttctctaaaaatatactgcgaaaacagaagttttgggaacaagccactcaaaacttacacagttcttaagaatcggaatacagtttttcatagaacatataaaaatggccaatagggctgggtgtggtggctcacgcctgtaatcccagcactttgggaggccgaggcaggcagatcatgaggtcaggagatcgagaccatcctggccaacacggkgaaaccctgtctctactaaaaatacaaaaaattagctgggcatggtggcgggcgcctgtagtcccagytacttggaaggctaaggcaggagaatggcatgaacccgggaggtggagcttgcagtgagcagagatcgcgccactgcactccagcctgggcaacagagtgagactccgtctcaaaaaaaaaaaaaaaaaaaaaaaaggccaatagacatataaaaagatgctcttatcattagccattatggtaatgyaaatcaaaagcacaatgatacaccacttcatacccactaggatggcagtagtcaaaaaggcaaatacataataacaagtgttgacaaggatgtggaggaattggaatcctcacacattgctggtgagagtgtaaaatggtgcagccgctttggaaaactgtttagcagttcttgaaaggttaartgtaagagtcagcagcatggtaacggcaattttattcctgtcccaagataagggaaaacatatgtccacacaaaaacttgtacacagatgatcataatagcattattcataatagctcaaaatgcaaacaacccaaatgtccatcacctggtgaatgggtaaattaaaagtggtaaatatatgatgaaatgttatttggcaaggaaaagcaatgaagtactgacatgtgctacaacatggttgaaccgtgaaaactttatgttaagtgaatgaagccagacacaaaggactacattttttttttttttaattttttttttttgagacaagatctcattctgtcttccaggctggagtgctgaggtactatcaaggctcactgcagcctcaacctcgtgggctcaagtgattctcctaccttagcctcctgagtagctgggactgtaggtatgcaccaccatgcccagttaattaaaaaattttttttgtagagacagagtctcactgtgttgcccagggtgttctcaaactcctgggctcaagcagtcctcctgtctcagcctcccaaagtgcctggcctattttagctttttattacacaaaagaagaggcaatagtaaagtgaaacctcatgtgtccatcacttagcttgaactattgtcaacattttgccaattttacaactcttttaaagccaaaagttggagttttgatggtttctgaagacataatctcatctcttcctaaaacagccttgtgaggtagggattgttgccctattagacggatagatagtaacttatctgaaatcatttgactggcgatgatgaactgaggacctctgctctttttatggccccatagagtccacatattttgtcattgcaaatcaaaagtaaaattgtttgcaattttttgtctctcaaatatgttgtagaaaccatatcattctacaggaaaatgcacagcatgccacccggtttatagctctggcaaatgttggaaatccagaaaagaaaaaggtaaagatttacctatttggtggarggttgatattcatggtctgcctgataaatgtatctcttgtccagtttagcattcagatcttctcttctccctgactgcaaggtctcagcagtttcggagactcctttgtaaaggtatggtaatgaaaggtcaagtctctttgggtctttttgtaggagagtttaaagaagggtttgggaaaataggcccagaggaataaaggcaaaatatcraatgaacagtgttcctttacttccacatctatgtggttgtctctatgggtatttgtgaatttgccctcagatgcttgcttacttctttagcaacttcatttagctgaaataagaaaaccccaaagagctgggcatggtggcccacgcctgtaatcccagcactttgagaggctgaggtgggcggatcacttgaggccaggagtttgagaccagcctggccaacatggtgaaaccccatctctataaaaaataaaaaaaattagccaggtgtggtggggggcacctgtaatcccagctactcaggargctgaggcaggagaattgcttgaatgtgggaggtggagactgcagtgagctgagatcgggccactgcactccagcctgggtgacaaagtgagactctgtctcgggaaacaaaaaaaaagaaacccagaggacttacctaagctctccttagggctaagatttcctgagggaaatcttagtgatacctggaatctatctttgtattggaaaacagtgcagttgatgaaaagaatataccagaaaaataggttgtttttctcacttctctgagagtatttctgatttcccagggccaaaactaacctattgtggattgagacagctaaaataagaacagttagtgaagtgggaaaataggcagataaagagtctgaagattattccactatcacatgccatagacaatgcatacaaaagataagcaaatcgatattttgwttttttcataatatttcaagctttttttgggggagggggcggatctgaagtgattttgcctttatttccttcactttaagccaatcatgaaatttcatagtgatttctagggttggggcagaaggaagacagtgttaagaatcatcagggctgtggcccagttggcctgcggaggtgcaggcagggtggcccctcaggggcagctggaggagcatggactgccccgctggcagggagctgatgttcccagagtataagagctggaatgtgatgtcctccacagcttccagcttgcgcagctctatcaggctgttccctgcggtggccagtgagttggcgatcagctctgctgccttggaatcgccctcagcagagatgatggctgcctttttctgctgctcagccttttctgccacaaatctggtgctctctgcttcccgctgagccacctgtttggcttccactgcttctgtgaactccttcccgaaggtcagatgtgtcaaggacacgtcatccaggatgagcccaaaggtggctgctygctctrtaaggtcgttgctcatctgcctggagaccagctctctttaggtgattagttctccagcatcaaagtgagccaccactgacttgaggatctcagtagtgatggacagcagcacacgcttatcataatcctcttcaatgctggtcaagatgcgaggaagctggctagcgacaggcccccatgtgcaccgtgatgttgacattctgtaaatctttgctatcagtgatgactggcacattacatggtcaagaacagcagtcaaagataataggtttgtgtacccatggaatgagaaagtgagtcccttcccstaccacagtgttctgtactccatggaatcggtcaaagatgacagctctttgctcagcatccacattatatagggcagagttcaccacgtctcctgcaacagctaaggccaggccaaacttgccaacggactcaaaacactttggcagccatgttttcttctgctggaccctttcatacctgcttccactctgacctccacataaattccccagcctattttcagcttttttgcccaattcttagcaaatgtagatttgtaatttttcttttaattgccctttcaaactgaataacacttagtattttcagtctgttttattctcagggacatgttagcctcagccataagcracttatactttcgtcaaaaggtgtgcacattataaaatttggcaagcattgttaaattcatctaaaaactttgttccaatttatacccctaccccagcagtgkttttttttttccccctccatatttctcactggatcaagtcaaagtttttgtttgtttgtttaagatggagtctctgtctattgcccaggctggagtgtagtggcacgatctcggcttactgcaacctccacctcccatgttcaagcgattctcctgcctcagcctcctgagtagctggaactataggtgtgtgccaccatgcctggctaatcttttgtatttttagtagagatgggatttctccatgttggtcgggctggtctctatctcctgacctcaggtgattcgcccgcctcagcctcccaaagtgctgggattgcaggcatgagccgccacccccrgcccacgtcaaagttttattaaagtttttgccaatgtgataaatgatatataattgttacttagttgcatttccctaatcagtagtaagtttaaacatctatttatatcttatctaaagttttcgatatctgtggcattagtgcaagattccaaatatttatatgaatatttattgctttactgctagtctcctaagaaaattttattagcatatatagcagaatttgtataatatcagagagagaaacactaagttcgtttgtaattttcattaggaaaaataaatggcagtgccacaattctgtggacagagtacacaaagataagggactcagagacagaagcagtttgtcttcaagggttatacagcaagtccctctgggccttgtagtgacagttgtcactattccattatccgagtgagaactcctggtttgtgagggtgggggctttgatttcttgttcatttctttgtcaacccttggtgagcccctgcagaggccactgaattggcatttgatttactgtttactctctgagctatggatgggctggttgctgttcttttaattttactgagtttcacatgttttctgtgaaatcttcacagtaaaataggttgattacagttgggtaaatagtatttcccctaatgtcattatgttctttttctctaaagtatctttacgcrttcagtattgttcccatgaagctaatggatgcagcagaactggtaaaacagcctcyggatgtcactgaaaacccttacagaaaatctgggcaggaagcatccataggaaagcaaattcttgcccctgtggtatgttctgattgagggttggcatttttatatgtgttcttttcctagttatagtttagtacataagacaagtttaatcgttagaatctaaatcttttttttccccttgggaaatcatgatgrtgtttagaaaatcttagtagatttcarctaagcttagtgttttttattgtagtttggggttaacagtttgatacattaggtctttctttgtccaaactggattcagacgtttggggttacagttttatttgtaaagtctttgtctaaagtgattatctgttcttagctctttaggcaaggctctagcagcttcatagcaatgtaatttgtgattttatgatgattgctagtaggaaaataagattcactctgaagaaattttcttaatagcagagttttctcaaattaattttttccccactaaagcaaggaatgtcaagttcccttactagcatgcacggtctgctttctcagacttttctttctttccaagcagccttctcatctcttaaggctgaattaggcttgtttgacctgtgaaattgtatgactacactatgtccctgttgagagaaaaaagaaaagagaatttaggtgggttcatgttctgctttaggcaagaattactttataacttgcattttaactcgtttttccaaagagatgaatttggcagtagtttggataagtgttgatgtatgactgagacttcaggcatcagaactgggaagatattttgcttccctagagtgtgcagaaaggactgagaagaaagataggtatggcatggcaggaatgttcccttgtatgtgagtggtcggctacttatctaaaggttagttgaataacatttaatcttctgcttttggccattccaggaagaatcagcctgtcagtttttctttgatttaaatgaaaagcagggaagraagcgttcatccacaggtagagatagcaaatcttctcctcatccaaagcagcctcgcaaacctcgtaagtacctttattccagaggtttcttctatgaacagtaactgttattttggcttttctttggaaagcagcattgctaagagagcctcttctggcaggggagaattgtgcaatgagtcattaggaccaacagtaaaaataaaatataaacatggccttggccaggtgtggtgactgcaccatcttatattcccactggcaatgtatgaaggtttctgcttttccacatccctgtcaacatttgttatagcartagccagttttacaagatagctccctcttttcctgtctcataaataggtatggttctctaggggtgatgcttttatatacttcttggactctgtatttttagcccatctacttgagagtgatgagttccttttgctaattaccatttaaagcaattttctttgtcctaaaaaggcagtcttctgttgcttatatacccatattgggataaaagcgttgatattcttggccaggtgtgggggctcatgcctgtaatcctgtactttgggaggctgagccaggcggatcacaagttcagaattttgagaccagtctggccaacatagtgaaaccccttctctactaaaaatacaaaaattagccaggtgtggtggcacggtcctgtagtcccagccactcaggaggctgaggtggaagaattgcttgaacccaggaggcagaggttgcagtgagccgagatgatgccattgcactccagcctgggtgacagagtgagactccatctcaaaaaaaaaaaaaaagttgatattctttttatagcttcagattcagaaactagagctttatgaatttttatctagaattatgtaatgctggaaactgattcacactaactgtaatcccagcactttgggtggccgaagcgggtggatcacttaaggccaggagttggagaccagcctggccaacatggtgaaaccctgtctctactaaaaatacaaaaaattagcaaggcatggtggcacccacctgtagtcccagctcctcaggaggctgaggcatgagaatcgcttgaacccaggaggcggagattgcagtgagccaagattgcaccactgcactccaacctgggtgacagagcaaggccctgtctcaaaaaaataaaataacgggccaggcgcggtggctcacgcctataatcccagcactttgggaggccgaggtgggcggatcatgaggtcaggagatcgagaccatcctggctaacacggtgaaaccccgtctgtactaaaaatagaaaaaattaaccaggcgtggtggcagacgcccgtagtcccagctacttaggaggctgaggcaggagaatggcatgaacctgggaggcggagcttgcagtgagccgagatcrcgccactgtactccaccctrggcgacagagcgagactccgtctcaaaaaaaataaaataagaatggcctgacttcgaggctgttctgaggcgcttcctgtactatggaaaaagcacctttcctttgtgtctgtaaaacataatgaggtgaagagcctccaaaaccaatatgggttcataaaataatagaatgatcaaactcgaaggaaggactttaagagtgtttcattgagattctctttcttcatctttttgtttcacacaagaagstgaccttgggagggtaaattttccagggtcatggctaatggcatagctggggctttaattggggctcctgacacccagttcagtgttcttttgttgtagcctattgccagttatgtgctactttagtcagtgtgtgattttgcacttgtgggttacctacctgtggattggttacaaattctaatggaagtttaatttcattgaaaatgttcatagggggtcgtagtgaggagcacaggctcagcccattgtggcagtgttgtataccagtcttttcaggatataaaaatcagacaaagctgagttctgtggggtgattatatgctstagtgcttggaccatagtaacacctggctttcttttacatgaagctcagcctccaggaccctgctggttttgccttgctagccctgaagtggaaaaacatttggtggtcaacatcggcacacatgtgagttacttccttggactttatagagaaggagatgcctatttgttttttattaactttattgaggcataatctacatataacatttacccatgtttaagtgtatgattcggtgattttcgtaaggttactgagttatgccaccatcacgtggtatagttttagaacatttttatcattgcagtaagatctcttatgcccatttacagttaatccctgttcccaactttagcctcaggcagcaactagtctacttactatctccatagtttgccatttttggacatttcttataaatggaatcatacaacatgtggtcttttgtgtctagcttcttttacttagcataatattcttgaggttcatccatgttgcagcatgtatcagtatttcattcctttttattgccaaatcatattccagtgtatagatgtaccacatttcgtctatatctgttcatcagctgatggacgtttgggttgtttctactttatggctattagaaataatgctcccataaaatatctgcatgcaagtctttgtgtggatatagacctaggaatggtctatatkttggatagacctaggaatggatttgctaggttatatagtaaatttatgtttaacttttaagaaactgctaaactgttttccaaaatgactgcaccatcttatattcccaccagcagtgtatgaaggtttctgcttttccacatccctgtcaacatttgttatagcaatagccagttttacaagatagctctcttttcctctctyataaataggtatggttctctaggggtgatgcttttatatacttcttggactctctgtattttttagcccgtctaattgagagtgatgagttccttttgctaattaccatttaaagtgattttctttgtcctaaaaaggcagtcttctgttgcttatatacctgtattgggttaaaaatgttgatattctttttatagcttcagattcagaaactagagccttatgaaatttttttttttttttttttgagatggagtctcgctctgttgcccaggttggagtgcaatggcrtgatctcagttcactgcaacctctgcctcccgggttcaagtgattctcctgcctaagcttcccaagtagctgggattacaggcacctgccatcacatctggctaatttttatatttttagtagagacagggtttcaccctgctggccaggcyggtctcaaactcccracctcaggtgatctgcccgcctcagcctcccaaagtgctgggattacaggcgtgagccaccacccccggcctatgaatttttatctggaattatgtaatgctggaagctgaktcacactaactgatcacatcaaagataaaatttcagttttgcttagtagtggagggtgtagcttactaatgacaggaatacccatattcacactcctggtgtgagtatctaggaacccaagatgatgatgatatggttgtttggtaagcattgaatcagactatgagaacgggatggtcttgagtatgattttattcaggtggtggaaagcttgaatgtgtgtgtctcatgggaaagtcattctatttcacatttccccagatacttttgcttgggtagggctggattagacattaaataataccagtgtttgastctgatttccctgggttttctrtagaccattgttctttttcattcatttagaatraagaaaacttaatttttaacactatagtcaccagtgactagaattggatgttccccaagattcctgaggaaaatatttataagtcatttttgttttgtgacagttttgggaggtggggcctaataagaggtgatttggtcataaggactctgccttcatgaatggattaatgttatcacagtagtgggttatcatgagagtggctttgttaaagtgagttcaggtccccttttgcttctttactctcaccctcacttgcccttctgccatgggatgatgcagcacgaaggccattgccaggtgccagtgctatgcacttcgacttcccagtctacagaaccacaagccaaatagatttctattcaaataaattatagtctgtggtattctattatagcaacacaagatggactaagacaattccttaagtgtgtagtgcttctgaagacaggtgccttcatccatttctcattgatttgttctacttttggtttctggggttgatcstttcaacttatcctaacaatctgaggaccgttttttgtgtcttccttcctgtagactgactagagtctcaatttcatcttacactttaaggagttacacttctgcctgtgttgtttccacctgaagagtctcagtcttttacattttaaaaaatgtcttggccgggtgcagtggctcacgcctgctcacggctgtaatcccagcactttgggaagctgaggcaggtggatcacgaggtcaggagttcaagaccagcctggccaagaaggtgaaaccctgtctctactgaaaatacaaaaattagctgggcgtggtggcgggcgcctgcaatcccagytactcaggaggctgaggcagagaattgcttgaacctgggaggtggaggttgcaggccaagatcgcgccactgcactccagcctgggggacagagcaagactctgtcacaaaaaaaaaaaaaaaaaaaaaaaaaaaaggcttaattagtggcacactcctgtctctagggggagcactaatgaagtcaaggccggtgacacaactgagccatagaacctgtggatgaagtcttcagtggaataagagcaaacttgagaagctctagcttttatagcagtgccctttttggatgatctcttttgcatcttttttcgtctttggattagtttatgctatttttctctcccacacaatttgtatagtaagttaggctttgaattgccttctgtttgggaagcttcaataggttcaagatcacaygcaggagataagagatttggaatgtgtgacatagctcagtgctgctctaggcctcagtgagaagtgacttttcttttccattcatctttctattgtccaggttactctaactcagggtgtgggcctgggcaacaatcaaggaaacctgttttcttctcatctaggcctgaaactagaggggaaaaaggtcttgtttgtggcccaacccaacatcccaagtaggccacatgagtatttcagcctagagtctacaytgtccttaggtagaaacctcttacaaacctgtaatgacctttgggtgtctgtggaagagtttgggatctcctccctgcaattattctttttgattgcctttttttgttttttaaattttttccctggctttctctttgtcgtgccttcctcaaaggtagtacatagaattgtgctgatggtccatagccacagattagtaaaaagggggaagggctgctgagagtgtaaaataattattgcaaaatcaatgcattttacttacggggagaaccatttatccaggtcctatttacacatggttagagataattctagtatagaacagattagaaggtgagagtttgaaagagagaggagattaggcaagcgtgaaactattcacaaaaattgcaagtacaggattagagatggtgcagaggagctctttagtttagacatcattacctaaagaatgcacatcataatagagaagytgatgtttatggcagtgaccttctgacaaaaatagctagacgactcaggcttctagagtaaccttttaaacaaatacaatataaagtggttattatacaaataaaaaaaagtttttagtgcctgtgaggttttcatcarctttagtcatctggaaaattaactttgtcaatatgctcagtcctctctgccaaacaaatcaaggacaatcatgctttagtatctttccaatacatatcctgtcattctgttggactttcttattatagatgagaagtgattccttccttcagccttaactttgagcccaccacactaagagcatagttggaataattttttattttttttccygagacagtcttgttctgtcgcccaggctggagtgcagtggcacgatctcggctcactgtaacctccgccttccaggttcaagcaattcacctgcttcagtctcccaagtagctgggattataggcacgtgccaccatgcccagctaatttttgtatttttagtagagacggggtttcaccttgttggccaggctggtcttgaactcctgacctcgcgatccatttgccttggcctcccaaagtgctgggattacagtcatgagccaacgcacccggtctggataattgttttctaamgtatctatatttgcctgtactggtactcattgggcccttctgtgctcactcatggcatcttcccatcagagaatatctgagtggtagaccattcttgcatgttttggtttttacagaaatatttttagttgccattaaaggctgacatccattgttggaaatcattcttttctgcctctttggatgcatctgagtttgaggttttactttccttctaccccattaggttgtatgtttgcttttgttttgtagaatttagtcagcagsttaaggcttaggaacattagatgctaatcatgccatcttagctttttttgtgagcccaaggagtatattcgggggtgggggtgggaatgaaagttactggggaggcagaaaggggtcattttttttttttttttttttttggagacggagtctcgctctgtcacccaggctggagtgtagtggcgcgatctcggctcactgcaacctctgcctcccgggttcaagcaattctcctgtctcagcctcccgagtagctgggactacaggcacatgccatcacaggcctggctaatttttgtatttttagtagaaatgaggtttcaccatattggtcagcctagtctggaacttctgacctcaggcggtccacctgcctcggcctctcaaagttttgggattacaagcgtgagccactrtcccagccgaaagtggtcattttgaaatcaraagttgtatctttttgtggttgagggtgataaaaactgaaaaactgttttcaagtttggagcatgggagggaaaacccagcgatttgttctggtctccctcagctcagtgtgtttgaagccaaaagcctgcttgtgtgcctctcccaattcatttgctcctagttcatttgctacttgcatagaaattttcatgccgaatctcactcttcagcggatacctgagaacattgttgctacaatctctaaaatcagattttttcaagaaagaatttttattaataacctcaagtacttttcgcctacaccctcaggctcactttttgtataggyttttctccctggagaatcctacatgctgtattgatgtctcaattctgtgtgctgcttcttcagtgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtaggtggtctgttcatagaaacttggaagggcgctatggggactttgatattggtaaataagtatttaaataggctgggcgaggtggctcacgcctgtaatcctagcactttgggaggccgaagcggttggattgcctgagctcaggagttcaagaccagcctgggcaacacggtgaaaccctgtctctactaaaagtacaaaaaaattagctgggcgtggtggtgcatgcctgtaatcccagctactygggaggctgagacaggagaatagcttgaacctgggaggyagaggttgcagtgagccgagattgtgccactgcactccagcctgggcaacagagcgagactccatctttaaaaaaaaaattatataaagtttagctttaatatgtaaaatatttaatatttttatattaatatttaaataacattcatttaaaaagtttttaaagagtatctggtggtaaccccagagacttcacagggaagtgtgtggtcagtacatgtaaacagcatagatagtaagttccttgtttagaaaaggaatgggtagttgaggaagttccaaggaagatgtggggcttgctggataagaatttggaagaaagtgagtattttgtgtggaggcccagcatgagggaaagcttagtggtaggaaatagtctcaaagcctgcatggggctagcagctcagaaaatcagattgtaaatcatttgtagttgtggtggttttctttttggcacatttgttaagttttcaaatgggcctaactctgccacatatataatatcggagatggcaaaggcttgtgacggagatatctctcttaagcctttcctgcatcagagaatggctcccacatgtgtcaggctatctcataagtttaagtccttacagacaggctgacacaggcttgtctggcctgaggatattctgtgctgaggggtgtttctccacccctgtgatggatttgctacttctcagagactrtgcaggcacaacttctctgggacctgcacaaggaatttctcctgtctccccaacccccaggtcattcctgtcccaatcagctgctctactactgatgacattaaagatgccttcattacccaggcacaggagcagcagatagagctgttggaaatcccagagcactctgacatcaagcaggtgaaacaggggatggtgatattcagggaagagtaaatatctgttttttttgttgttgtttgttstttgtttgtttgtttgagacagagtcttgctctgttgcctaggttggagtgcagtggcatgatcttggctcactgcaacctccgccttccgggttcaagtgattctcctgcctcagcctccccagtagctgggactacaggcatgcgccaccatacctggctactttttgtatttttagtcragacggggtttcaccatattggccaggctggtctcgaactcctgaccttgtgatctgcctgcctyggcctcccraaggtattacagkcatgagycacccacgcctggcaagatctggtttttgacatgttgagcctaaggtttttgacatgttgagctatcaaggcattccaaaaatgttattaaataggcaatgggttgggcatggtagctcacacctgtaatccaacactttgggaggctgaggcgggaggagcacttgaagccaggagtttgataccagcctgggcaacaaagtgagacaccttgtctctacaaaaaataaaaaaataagcttggcatggtggcatgtgcctrtagtcttagctactcaggaggctgagagtcaggaggatcacttaagcctaggagtttgaggatgcagtgaggtatgattgcaccactgtacttcagcctgggcarcatygcaagaccctgtctctaaaaaaaaaaaaaaaaaaaagaggcagtggacaatttggaactagagcactgggtattgactagactggagatgaacagggcattactccaaagtttagtgctttcctgggaagagcaagaaattagaatttcctaaggtaggaacttagaaggatagacgccactgggaggatattgttagtatcttccagttagactttttaagccctagttccactaagtggcttgggatctatagcaacatacatatctttttttcttgtgcatttagactgaattatttgcctagagatgaactcagattatagatttttaaagcattattggacatcctcatacaactctgtttactttagattgcacagccaggagcagcatatttttatgttgaacttgacacaggagaaaagcttttccacagaattaaaaagaattttcctttgcagtttggaaggtatgtttttcttcttttcaatgtattttcactagacctgctatgaacagagtggtgggctacatgggacaattgataaaaagctaaattgtaaacagtccttgccccagaggacccatggtcttagggcagatgtttwcatatatgacagtaatgtaatgtagaatgtgaagagtaccatgacagagttttggagaacaatgtgctgtagaaattcagaaaagggacagctcatttctagttggtgaaagccttcatgaaagtggcaaagttgaacctgagaggcatatttagagggcaaagattgaggtgagggcattctagccagaagtgctagggaactttaattgagcayatactctgtgccaagaactgtaccaagaactttacacatacatgactcatttaatcttcataactctgtaaggtaggtactgtcatcccgatttaccagtgtggaaaatgaggctctagagcagtgcccggtagacttttcacaacgatggaaatgctcaaatatctgcactgtccaatacagttgtgactagccacttgtggccmctgagtgctgaaatgtggctaatgtgactgaggaactaaatttttgattttatttaattaattagaatttaaatttaaatagccatacctggctaatggttaccccactrgatagcaggctgtagagagcttaggtagcttgtcctagtcacacagtggtaggttcaaacccaggcctgttggacctcaaaacttgaggtcttaacctcagtgttctacagtatggtaaaggcctagaggaggcttcagttctgttcctcgtatcaggcaaaacatgactgcaaaaccatagagggagtaacataacttaagcaaagattgaagatgggaagttgctggcaagaagatacagtttgaaggggagtggaaaatgtgtagaacrgagtatctgatgctggtgtctgtgatttgcagctgttttttctcccctagttaaaaatgggctttgagtgagccttgaacctgtcttggactaattcagaaagcctccaagagattgcccccttagataagtccagtaaatgtagttgtctacatttttcaaaaagataaatgggaacaagtgtgctacgagattcagacatctgacgtgatgttttcgttgttgcctcagcaacagatgcggttatgaacattgacaacataagcacacgattgcagatacacataggcgtataaagcacacaaaaagaagattctctgaatggttttgtgcttatgatgtattttcaatattgagtaattatcaagatactaatttatagttatatagcattttatagttaacaaaatatttgaaatggcatatttttttcagctgtacaagaaaggtagttctattttccttttatatttgaaataggctcaaagtttgcccagggagcttaggttctttgacttatagagaattcatgatttgtttctaactcttctatttactgtaacttcaaagtggaaaatgaaccatataaatgtgtaatagaattatttctaatatatcaaaataagtaaaaataaaaatataaagcaatggcgattagaaggcagcttgtgtgtgagtgtgtctgtatgtagttattctttagtcctaagagccaagatagttgttttgttgacattgggcttgtgctgctgttacgtgggcctgagtyccctagaaggagaggcagaggaattttaaatcagagtgggtatgactaggctcctgactctgcaaactcatgtctagttgaggtgacaaaactacagtttaaggcaggttgtaatcacagctaatatggcactttgactgtgttatctctgtacctcacaaaaaccctgtatggtgggtgttcttatttgcatttcataggtgaggaaatcaagactcagagatgaaatcatctgtctagatcatagatagcaagtggcaaagctggaaatgggatccagtctctgatctttctcacaccagggcctgccctttttctatgtggtgttgcttctctaagtaccaataatatagttccaagttttttaagagagggagaagcaagtggggtttgaaggatcaggaaatatatagtacctgagctggtcatttaaaacgggtatgattttgatcaatagtatggcagagatggcactcagggcaggagagcaaagtcagagaaatttgcatacctcctttgggtgatgttgaggagagctcaggctgatagtttccattttgacttctttgtgctatttctgcagggaggtcctggccagtgaagccatccttaatgttcctgataagtctgactggaggcagtgtcagatcagcaaggaagacgaggagaccctggctcrccgcttccrgaaagactttgagccctatgactttactctggatgactaaaacaaagggaagaactttttatgaactccacaggaagtagtaargcttttttttttttttaattaaaagaattttttttgagacrragtctcgctctgtcacccaagcaggattgcagtggcataactgtggctcactgtagcctcaacctcctgggctctagagttcctcccacctcrgcctcatgagtagctgggaccacaggcgcawgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcrcttgtartcccrgctrctcaggaggctgaggcrggagaattgcttgagcctgggaggtggaggttgcagtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttgagaagtgtcttgtgttcatgttgcctgtgaccgttgaaatgaagtagtatgtgtaatagcaggggctagagctttaggcccagctgttactccaaaatcacacagggcagtttctccctgaacaacccaaagtggaaaagggatccaaggcttttgctatttttctcttaaagcattcatcttattcatagataagagcccatttagtccttcggatatttaactcctatgtgccaggcatttttctaagctccaggaccatagtcatgtcccaatatggtccctgttgtcccagagattacagtttaatggggaatagaagggacagatttaagaaaaaaaagataattctcctttggatattgttttaggtgcttgatatatctaatatgtgtctgttgtgctgctgggcagttctaaactcatcagtacctgggttggttacagggctttggggatcatcagggtataggccataggtgaaattaagatagggtaaatacagtsctgagctgaagatgattacctgagaaatatcagtatttaaggagtgcttgaaaatagtgatctaacatttacatagagaaggagcaaagagaatgctacatattaggcgcaaaaagaaaaatatttttacctttatattgggcacttatggtccagacactgtttcatttaatcttcacaaaatctctgtgaggtaggtattacctctattttactcatgaaaaaaaaactgagactcggaaaattgaagattgtggagcctggggtcaacaggcttaggctttttaaaaaacaggccaggtggctcatgcctgtgattgcagcactttgggaggctgaggcaggcagatgacctgagatcaggagttwgagaccagcctagccaacacggtgaaaccccgtctctactaaaaatgcaaaaaattagctgggcgtggttgcatgcgcctgtaatgccagctactcgggaggctgaggcagtagaattgcttgaaccctggaggtggaggttgcagtgagctgagatcacaccattgcactccagcctgggtgacaagagtgaaactccatctcaaacaataacaacaacaacaacaaaaaacaactcaaattactcatggccctgggaatgggggcatttaaaaagttaaccaagggaaccaacctggtttccacaaagatggccacttctgggtcagcccaatcatcagtatccctgggtcctcagcatcccttcctacctcttttgactgggaattacgagattacagccccacctacggaaattgagcacattagcactggccatgctgtacatacagcaaatgagaggkcttcatactgttacaacaatctgtaccacaattctctgtgcggtctgcccagctctaaatgacatgtcctcagaggcatcatcatctccaagtccatggaaaccatgcacttacagaaaccagaacctcccataccacatgttactaatgacctacaacatcgacttcgtctgtatcatgcagtgctcaacattctggttgcagcatcacatttatcaataatttgattccatgctgattcctttacttggagtattgagatcccccaggtacagtgaargtatgaccctcttaaatggaagaccaggagttgtttcccctatgctatggcaatccgccacccggaagcacttgctgcaccaacagcattcccaaagcttgcctctgcagccctgtagcacccattagaaacacttctcacaatgaactactgtgctggcaaacccataactggactgccggacagcaagctctgtgaggcatctaggaaaaaagctcgcgaaatcccgagaaacactcttcactccggaatagcgtcacattcttgagtcatttgggatgacaggggatatcctggagcaggtgtattgggaagtcagtgaacaagaaggctaattcattagtgggcctgctagcgtagtattttaacgatttcgcagcctttaaatcattggtggtctttagcgtgccggatcagctggtggtggagttggaggatagatggcagggatctgaagaaaggtgaagtgtagataggagtagagacaatatgaagtttagaaaagactaattgctggacgcggtggctcatgtstataatcccagcactctgggatgccraggtgggaggactacttgagaccaggagttcgggaccagcctgggcaacgtagcaagaccatgtctctacaaaaaataaaaaattagccaagcgaggtggtgcgcgcctgcaatcccagctactcgggaggtgagaagatcgcttaattccgggaggtcgaggctgcagtgagccgtgatcgtgccattgcactccagcctgggcaacggagcgagaccccatcttaattaaaaagaaaaaaatacaggagagactgggctgctttgaaaagtggatttgasgggaatgtggggtttggagagatcttatgttttccaagactagaaaaacattgtggttccgttcagccctcccggaaaatacrtaggggacttaaagagcggaccgagtacctgtttgtttccccatcccttagccggcagggmtctggcagcgccctgggagaacttagggaagggccttctcgcagcggttaccggaagtgacgcattcattctcgcgagaacaaagacgcgcgagcatcggcggcccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggtgaggcggggcrtgagagggagcggcggtgggttggagcggcggtgggtttgagcgtctgtggaacacagggctgacagtgtgggatagatggttggtgggaccttgggcagtatttgggggccagtgggcttgtgtgtgtgtattagagagaaagatactatgcctgygtgtccaaagttgtatttgaggtactgggcatagatagagctgttgcggggaacttgggtatgactgtcaggctgtgaccaggtgtttagtgagtgtgacagtgcgtgtgtgtctctgtgaatgtggagtgtcagggtgtgtgaggcagatgcacgtcacagtgtgtatgtaggagcacgaatgtgtgagaagagggctgaaggggactgcctttgggaatgtgtgcgtccgtgtgtgtgtgtgtgtgtgtgtgtgtgtgtgtgygcgcgcgcgcgcgcgcttggaggccatatgatatcagtggggactggagtagacaaggaaggcttcatgatgggtccagagttaagcctttggaagcatggatgggctttggaattggggatgtattccaggtcgggacagtatgagggtgagttggtgcagagcatggcttcaaacgaaaggctatattagtagatggagatggggggcgctctagtaggtggaggacagttaacatcagactcaagaattttactttgatttaatagagaatgtttaaccattgtagtagcagttaaaaaatcatatttgggtcttgtttgtttgtttttgtttttgagacggagtctcactctgtcgcccaggctggaatgcagggcgcgatctcggctcactgcagcctcctcctcccgagttcaagcgattctcctgccacagcctcctgagtagctgggattacaggcgcccgccaccgtgcctggctaatttttttgtatttttagtagagacggggtttcaccatgttggccaggctggtctcgaactcctgacctcaggcgatccacctgtctcaggctcccaaagtgcagagattataggcgtgagccacggcaccaggcctgggacatgtattttttgatataccgataaaagctgtgaaccctttccccagaaaaatgcacagatgcacattcacacaaccatgcattgccatttgagaggttcgtgccttcctaaaggacattttaggtaaatagaccctggactaataattcctgtaatataggctttgttttgttgcctgtaaagtaagtatagtataataattacatgcatcatggatttgagagttaaataaaatagtaatgtgtgtaaagctaaatacggtacctgacccatgaaagccctcaactgttagcacctgctgctactttgttgttgttgctgctatgatcataatgctcctcattaattggccttaaggaaatgtcaagataaaaagtgttgttctaggaaaatggttttgtaaaggataaatttgagtggaacaacatatgggacaagatgaacaggtaagatcttactaaaatgcctgggcttggcttgtgaatagagaagttaattcaagaggaaaagtaataatttgttatctaaaggaacatgggtgtagtgagaaagctcgtaatttggggtgggagaaaggggagataggagtctaccttgggaaaataggcatatttagggtaattagaatgacaactgaaactgttagaactgaggaagttttgtgaaccaggtttctagatagggcataggagaaaatcttggagaaagagaatggaaggtgaaggactaaggcattaagtcctgtgatagcaggataagtagtaaatttaataattctcaccatcagagggaacataacacactaaaaaaaaaaaaaagtgggagccaagtgcttccagtggcatgttgcctgtgttacctaagcctgcctatccgcctggtcataaggaaaaaggatgcatgctggcagcttttgtgacttcttttcttggtccctgggtggggatggatgaattaatcactttttgttttattatggtaaagtatacatmacacaacatttatcactttatttttaagtgtacagttaggtggcattaagtacattgacgttgttgtacarccatmaccctatctccagaatattccgacttttttgttgttgttgtacatctataaacttcccatagaatattctttgtgaaaaggtagaatttcacagagttgatgaaatataaattaaggagttgaaggatcttacaaagtgggatttttgaaatagataacttattgctccattaacatgagcattcagggctcagtgttgttcatggttgtgcctgattctcatttccatggtggtaaaggcctgcatgggacatagatataactggtcacctgctcataacaaaaggaagattgaagggagtgagaacygtgggtaggctagcatgcagtctatcctagtttccttcttctctatgcaccaggtatcatcttatctctagcttcttttttcctctcaccctccaattcacactaccctatccaagctatgtcttscttccccacctataatatattttttctgtcctggcccctgggctcttctctctgtattcatacacagcctttattacaactctggtttgtgtcagagattacatatgttggaaattcttttgaactctccttgtgatatcagaaacatagtgtagcctgtttagccctgactgctatttctgagctgcattattaatgttgccagaatatgatggggtctggctatttcctgtaatatgcatcagaatgggtttaatttcagtcagaattggctaaattactagtcacaggcaagagatgttaggttcattatgtagctatggaagcagaagtacactcattggtaggattttttttcttcatgtcatttgaaatgcatacattaggattggagttttttgctttaggcttggttatattaaaactttctcttgctgtttggagtccaggaagccctgaattaccttcttcattttagttatgctagaagctggggcacatattagttgtcttgattaagctctgaaaggggtttgctgaggagacaggatctttttttttctaacatta

SEQ ID NO: 13432 - DNA, 12252 bp, Homo sapiens
agacctatgagaaccaacacaacagctaggtgtaagcaggcaagctcatgaatgagcataacagaaatctccaatgcctaggaggccaggccatttctacaatgagtgaagcaggcctgatgggtactatggcaaaccacagggcacatgccccagctaaagaggggcagccgctgctcaagtccagccaactgtagccaaatgtaaaatgcaggcaaaggatgccagatctgctttgtcgagataagcaggaaatcccaattttgatgggatgtctcccaagttttaaatgttcacagctaatttatttcattaaaaaatccaaaacaaacttcagcaggccaaaccaaagacatccacaagccagcaatttgcagcttctaggatatgactgggaaacgaggatggagactccaggcactagaaattttcttacttcttacccagggatcggaagggcaaaaacactgaaaataaagctgacctccgggaaggcggtggtggcagcagccagggcagctgctgcccaggagtgaaagcaaacctctctgaaagccaagaatgagccggggccttcagaatcacagccccacatctgtgacctaagttagtcaacaaatgctcactgagggccgactatgtgcttggcactgttccaggctctgaaaaagcagcagtgtasaaatccaatgaaattcctgctctgcactttgggaggccaaggtgggcagatcacctgaggtcaggagttcgagagcagcctggccaacctggtgaaacactgtttytactaaaaaatacaaaaattagctgggtatggtggtaggtgactataatcccagctactcaggaggctgasgtaggagaattgtttgaacccaggaggcggaggttgcagtgagctgacatcgcgccactgcactccagcttggacaacagagtgagactcctgtctcaaaaaaaaaaaaaaaaaaaaaaatccttccctagaggaatgcacttatgtgtcgcayttccgggcaaaatgaaaaataagacagttttcagtggttttagcaaaggctgtgatagagggtcatcctcttcagctatagtgccactcccttcttggaaactcaaagacgacaaaaacgtgtaagtgaaacgggctccatgggcccagtgctccggcattccagaaatgaagagaatggggttttcctgcttgtttttggatgtatccccaacacctagaatggtgcctgcacgtgctaacatctgctgaatgaatgtgacaattgagggctaagagatattcccaagagcccggtgcrgggggcggagaaataatatcactgaagttggtattggtttttcccacatgaaaagcatttctctttgcttccaaatgtctatgtgatcatagataggtagaatcaggtcttaaggtaaataataataatcatgataattggtctttccctktgttagcaagcttgggtattcagaaacaagcagaggcaaaatctaatagcccactacaaaaaggaagtccaaatggagcaatgtggacttctcacaatcatccttccacattttcatctctgcttctcacttagsacaatcccttttctttttattttattgcaatgtgttttaaartaagtttgccggctgggctcggtggctcacgccttaatccctgcactttgggaggctgaggtgggtgaatcacctgaggtcaagagttcaagaccagcctgaccaatatggcaaaacctcatctctattkaaaatasaaaamttagccgggcttggtggtgggcacctgtaatcccagttacttgggaggctgaggtgcgasaattgcttgaacccgggggcgggggtagtttgcagtgagccgagatcatgccacttcactccaggctgggcaaaaaagcgaaagtccatctcgaaaaataaaaataaaataaataaaaaatgtgtttgccggtctcagggaaaacaaatacaaagcagtgttgtgcaaaatcacacaccggtacgtttggttgaactctgtcctaaacacagacagcagtcgtggtgggcacggcaactcaccgcacgccggtccagctgcgattgatttcaagacccatttccattgtagatactttataattgtactctaattgtagttaagatggcactcaagataaatgaatcatctcagatatgggaacagggtgctccatcatacaaattccctgaccgttccccgtgctctgagaccagaagaactctgctcctctcaagtcccagttggtgataaaattccctttgccttccttgaaccagatcctgacagccagcaagccaagcgttcccaatcgccgactgtctccatgtctctgtgttggattttttctttttttttttttttagaggaggagggaaagtaccctgtttatttccaaactcccttgcatctgatgcacgataggctggcatttgctgttaaagcagaaaattataaggagggcctaattgaccctcttgcgtctttgaaaaagcctgtctgtggtctctaattgaccctctaggtacctatggaacaatgaatgaatcttcaggaaataatggagggcgatgattaatagcccgggcctggctggacctccatctctcacagttcttctccctgttacttcccttcctcccctccatgacactcgattccttgcatttcataagcagcgatttattattatcacagaataataaataccctgcagtagacacttttaagaatcggagacatcacgattctgcagagattgtgataacatttatttaagctggcattctcatttttcttattggcatggctcagaagagtcctcctctggcatttgtgggcaaagtcaaacaagaggcttcttttgcrctccttgtgaaatcattccaaatgtggagtcatttggaactgcaggggcttcttacttccagtccaaagggtgaacattgtcccttttgccttgctcataagaggactaaagcccttcagacgtacagcaacaacaacaacaataatgcaagtagtaaaaaaaaaaaaaaaaagtggcactcctttagtggggaatgtggtactggcctgcatatattaccttgatgaatactcacagaagccccgagacatcgatgttgctactgtccccattagtcagaagaatacactgaggtgcaaagagaataagtaatttacctaaagccacaaagtccaaagctgcagctctgtatgctatacacatcgccttccaagtattcaacaataactgtgccaaatgtacaatattaaggatatgttttgggaaatgtgagtattagaataaaaaagagtacctttccctttcagtttggttgaaaaatgcttcctttccccggacagtataggagaatacatttaaatttagaaatatacacatgcctccaatgaggattctgagaaactagaatttttttttttttttttttttttacaaaatcatagcattaactatgagagaaagagaaaaagacagagagaaagagagatagagacaaagaggaaaaaatccgtccttccaaacccaccctggcccccaccaatgtctccacattcctcgggaccttaaatggcaagggagccagaagttgtctgccaggccctgctggtttatccgggccccttttcttcttactcagtgctttgtgggagaacaggccgyctatgcagcaaaattaatgcttgggtaaggcttacagtctttgtgaaaggaatggattgtctccagcaccaggtcccacctctgtcttcagaaagcactgggccaccattcagagtcaggggctctgggtgggcagtgggcttctgacagataggtgcagcccacgtgactcagaaatagagaagaagggagctgaggaaccaaatctgcgtgccctgaatggaaggctgccttaggccacctctacggtcctattcaactgcagyattttaaaagccaaatgagactgtcctggggattttttyttgtccaaaggcacatatatatttgtgtgtacctgtgtgtgtacacccacgtatatgcatggatatgtatcatacaatatatgtacatatatcaaggtctttacctatatctattactgtgcatatatgtgtatrtatgtatctatatctatcmyttctaccaacccatcagccagaactgttttcatatgctargttttactgtatggagcttaaaacccatttatgcctcaggttgcaattttttgaattttcacgatcagaccttggtgatggctttgagcggtaggatataaataattcccacatacttagtgttccaataatggaacactaggcatattactacggggcttataccactgatagtgaaaatcttgacagttcttctcttccctttccatcatgtccacatgcatctggccascaagtcctccccatccctgctctagtgctactgccttarggcaggccaccttcagcacttttctgcatggtagcaagaagctgataagagggaaggggtgccacatggtttagcctgttacccattaccaacttgtactgcactcaaagtatctgtggaacractcagatttgttgcctccctgcttgacggcgtgtttgatgccctcagaaaaacacttccactcctcagtagagcatcacagccctctgctgtatgacacccgacctttctacacttttctctctgcaccaagctgtkggagtttgctctcttaaactcccacgttccaacctcagccaagctctccgggcagccacacttccctttgccagctgtgaccaccaatactgccaccaggggggtctgcaggacctgcagggccacactcattggcacctcggtgacttcacttactctggtcaccctgctgtctctcccaggcctcctccctcacagaccttctagggaaarsttctctatcatggtcaactttgagccgtgtatattggccacaggcatccctccttctattagggcgccatactgctcacttattattgcctaaaacctgctcccttgtaggctttctttacagggctctagcggattcttagagatagtagacagctcactggtaaccacagttcaaatgcaaaccaaccaattcacagccacaccctcaccactggctttattgggctcgaactccaggccacacccacctaccctaatcaccccatagccatgggtcagacacctaaagacaacccctgtgtcccagagcccatggaaatgacccaagccagccaatcctaagcctgcttaccctgcctggccccttctttcctgtgaaaatcacaataaaaacattttttaaaaaaatttaagttccagggtacatgtgcaggatgtgcaggtttgttacataggtaaayctgtgccatggtggtttgctgcacctatcaacccatcgcctaggtattaagcccaacatccattagctattcttcctgatgctctccctcccccaaccccactcctcacaagccccagtgtgtgttgtttccctccctgtgtccatgtgttctcattgttcagctcccacttacaagtgacaccatgcggtatttggttttctgttcctgtgttagtttgctgaggataatagcttccagctcaaaactcttgacagttctccccctctccctctgcctcctgcccaaccctggggctttcccaggtaactccctgtggcatgtggagtccccatggatctgtgagtaacaaaccatctttgcaatagcagtcatttcctcatcttggccttaccataccacaataagaataaaacctgttaaaacagagagaacagagggagaaaggaaggagaaaaggaaaatgaatgaagaaggaataaagaatgagtaattaaatgaacaaatgataagttacttaaaatctgctttttcttaggaggagaaagaactaacagagatgcagaagtcctcttctactcgggctggggatatgcrtgagaaagacacgcgtggatgccgtatgagctctcgttctgaatgcggaaatctgacctcccaccggatactcagttcagggggctcctggaccctccagctgctcctctactcatcgctccctcactcagaaaaccagcagagaagtgaacttcctcaaatgactgacggtaaatatccagcatggagctggattacaaaactgtataaactgtaaatagcatcacgctattcccttttaaagaagtgtcagtgcttttattcattaagattcagatgctatggagggggcagatgcgccttctcccctcctggatcccaaataaaacaccccgtatggaagcagatggctttgtgtaaatcagatgacagtttacggagtgagacggcctcatcggaacggcattacaagtatcatcttttgaggggaaatggggttaatcaagtccagctttaattggaggtcacatttgcwtgtgaaattctgggtccctgtaaggactgcctgggtccctgggtcatcaggccagtaacctctccaccattttctttccagagggagccccaggtaatgcatgagaaaggaagtgttataagaagccaagaatgggtgccccccaccccccaaccaagagccagttctgttaacacagcagagagccctccccaggtctcaaagtctccctgcctttgctgccacagktaagagggggtggttttgctcactgcaaaccacataacagaaacaacacctgcttgggcacttaaccctggaacgggaaagctgaaagtggtttctgtttattttgatctcgagcgtaaaatgaagagcaatcatgtccctggagtctcggcagaggacaaacaaagctgatggaggaagacaaagtctgctttttcaggatgcttcatgggaggctggggtgttaagcrctcctcagcctgcctgtgtgatctgagaaacggggcgggggcaggtggggcgggggcagtggcatcaggtgcctgcctcccgccgagggtattcaccattcaaagcacaggcgcgaagagcaamcagctaccagacagaatcctttaggtctaggctattcctttcctttgaaccagagacaggaacagaacaccttagcccagcctccctgcaacattccaacacttgaattgtaggatgggagtcccaatttcccagacatcagggcaatattctcccatttccttacaacactgggtcaatgtaaaggttaaaaatttaaataaatataaataaataggagatcaacatcctcctttcttgggaaaattcagacaatgctacacaaaagtttggaagacgagatatctaaagatcacccagaaaaaagatataggagcatgctgttttcattaggtttcttcaaaaatcastggtatgatttcacagtattttgtttcatggaatatattcacgatatttgtttcatggaataaattcatgatatttgtttcatggaatatactggatatctgtttcatggaatatattcacgatatttgtttcacacaatatattcatgatatttgtttcatggaatatattcacgatacttgtttcatggaatatattaggtatttgtttcactgaatatattgactgttactcagaatcctaacatgcaatgtctttcttcaaaagacagtgtcatgcattccttacagtggatttatcaattaatgctgagtccccagccaagtgataagtcataccatctctcttactccttttttcttaatccttaaaaaaaaaattaggtccgccctcagcctttatattccaattcttcattccacactcctgactttttcccaagttattcaaggrtggaaaagcgtatcatctccaagctagctctttccygccttyccatccaaccamcccactctgctgccatccccagcacagcccaggagtaagatatttgacaagawttgtcagggttaacaagaactcccaaagcaagcactttgagttatgtcagacaaaaatgaaaattcaaaagaggagcattcatccatagtagaaaatatcatgttctaaaaccatgaaaatcaaaaaagaaaatgatttttgaaattatgtctcccagacaaacaagtgctcttgaccagaggccagcaaactacaacccacaagctaaatccagtctaccacctgtttttctaaataaagttttattgtcacacaaccatgcccattggyttatagattatctatgtgctttcactaatgcatgatagcttagtagttgtgataggtaccttgtaggccacaaagcagaaaatatttatcatgtgaacctttgcaaagtttgcagatgctgttctagactcaaaattcatttcagtgtctctcaaataattgggtttgctttgttmytctgagtataaatggaatgatccagtgagaacttttaatgmcaatagtaaggaattattaatttgggtttagtgaagaagagaatgttaaagaaccaaagaaatttttaaagattcacagccactctttttgaaataaagattaaatccctaccaggtaacttcattcaaccatgaacatttattgaatgtgtattgcgtgttttcaacctaggcatttcccttcattgttgcgggggtgggatgggaattttcagtcctcctctcctgacttttcttttttttctttcttttttctcagtcaactctgtccttgtttattttatctggctaaataaaaaatcctttaaagattccccaattctgatggggttcctgccctacatacaccatacaaatgtttgttacaggtatttggatatctcagatcatctaagacgttcatcttacccttaggsttcatatctaaactgtaggattaagccgttcagaatgtacttgattcctataatatgtagtgattttgctaatgttgttcagttttgtttccttgcccagaatgatttccattagctcgcttgcagattagcagcctaatctcctaacaagagctyttcgatcaawtggtctggagtggccacatgtcttgctgctgccaagtgactgatttaagagatggacaaaaaggagacacacagaagtcgagatagcatgattaatggtcgatccaactttctytgaaccgcatatcatgactgaatgggaaaccctgaagagattaaaggggggaattacattaccatgaataatataaaaaagtgatattctgtctaaaaaccttttgagtgcaagtgactcraacaaatatattaacagagcttacagcagattcaatcaggttgaacgctccccagaatttattttgaaataagctttatatatytgagacgtgaagaatgaatctattcgtggctggcaggaaagctattaacatgcagattttaattctgcctttgattctacagaggttctattgtccctcctttacgaccggcaatctctcccaattacggatgtagtacacctccacaaatctcaataccacagtgacactctagagagctgagatttattttcctcactttattctaacttctaaaaataagttcaaatatttattatcaaggcaccgataaaagtatgatgtttaaaagcatgaattatattacaccaacccatccatctgttggaaatgccagtttggggctatatttggggggcaaaacttggcagttaagatagaaaccttctttacaaaaactaggtgcacattaacttacaattaagccttgatgttaatgaggttacagcatgtgaccagttaacgggctgcagccaaaaggcaaatattgaaatgaaggcgtttattttcaaaccaacaaacctgaactaaaccattacactaagtcccattagcattctagttattgggcaaaataatttcatctccaaaattaattaaataaattggaatgacctggaatcacttctgtggcaggcggatggaacaatactgcatgaaaggcaaaatcatttagagtcaaccggcccatcagttccttgagagatgatgtttaaattgatgggaagtgaaagttaaaaatatgattcatccaatgaggcagtgatgtactgttaaaatgtttgcaaaacaattttaaaaataaaccttacttaaaaaaatgtctccccctaaattcagggataggatgtctttagattaaaataatatgttaacatgttcatcacttagaaaattcggattctgctctgcgtgagtcacatttattttctaagcaatctggatttttttttttctttaggaacaaaaattaataaaatacatgmctgttgaatgcaattaatgggatccaagggctactgccaagtttttgaagagaatcaacagcagagtcttagctcaaatcatatccacatcagtactacggattaaatgtttgcgtcctcgcaaaattsgtawgttgaatttttttttttttttttttttttttgagacagtcttgctctgtcacccaggctggagtgcagtggtgtgatctcagctcactgcaacctccacctcctgggttcaagtgattctcctgcctcagcctctggagtacctgagattacaggcattcaccaccacacccggctaatttttaaaatgtttttagaaaagacggggtttcaccacattggccaggctggtctcgaactcctgacctcaagtgatctgcccatctcagcctcccaaagtgctgggattacaggtgtgagccaccacgcccagccatatgttgaaatttaatcaccaatataatatattaggaggtagggcctttgggaggtgattaggtcattgaggcaaagccttcatgaatgggttaagggcttaaaagaggccaratagagagaccctttgcccctcccmcgatatgaggacatarcaaggaggtgaacatctaggaaccagaaagtgggccgttgccaaacactcaatctgccagcagcttgatcttggacttcccagcctcaagaactatgagaaatagatttcaggtgtttataagccacctagtttatgatattttgttatagtagccaggacagactaaagcacaaggctttctggatggcctaatgaatgagaagtagaatcacttgtaactaatacagtgtctagagcacagtcaacactaggcaaatgccagcaatcacacttcaccacagggtcattgaaacctggcatttgggtgcatgctgtgtcgtttgtgagctatgtgaccttagatacacatctaacctctctgtccctcatttttttcatctgtaaattggggatactaatagtgycccctctagtagaattgtattaatttgaaagagctgatgtacrcaaagcatttgttatagtgtctccratgtaaaggctcaatcaatgttcatctcaccctatccccgtgggttgaaactggcagacattccaacaggcctggtagttgtttttttttttttttttctgagacaaggtctcacactctcccaggctggagtgcagtggcatgatcttggctcactgcagctttgacctcccaggctcaagcaaccctcgaacctcagcctcccaagtagctgggaccacaggcatgcactaccatgcccagctaattttttctattttttgtagaggtagggtttcaccatgttgcccagactgatctgaaacccctgggctcaagtgatccacccgcctcagcctcccaaagtgctaagattacgggcatgagccaccgggcctggcccaggtctggtagttcttaacaactactgttgtgcccaggttttctaggctctctctggtaacacacgtcagtaacttatctctttagatggagctttctcaaagtgtggttcatggacaatcagtaccagaagaacctgatgcacttcttaaacacactgattcctagaccccatcctgaatgtactaactcagaatctttagggagtgggactaggaatttatattttaaaaataagttcctagctgagtctcaggtatccagaagttttgagaattaattatttcaacaaacaatataaacaatggaatcgtaaataatcttttcttgggcaaggtaattgcaatcccacaatatgagatgtaattaacaaagtgatgaaactctgggtccagtattcttttgaacaatctcttgccctcactttctagttac

SEQ ID NO: 13433 - DNA, 12418 bp, Homo sapiens
gcctcccaagtaggtgggattacaggcgccaccaccaagcctggctaatttttgtatttttaatagagatggggtttcaccatgttggccagactggtctcaaactcctgacctcaggtgatccacccgccttggcctcccaaagtgctaggattacaggcgtgagccaccactcccagccagccaagtaagttttaacttggaaacaatgagcagacactcgcagtacattctctacttagtatatttctttttcagagtcatctcaaaaatctctaggccaagtgttcttaactatggaccttgatgaatggaccctgagtatcttagaatcttctgaaataatatgcagcattatattccatttgtacctgggaagagggtacttgtctttcatcagagagtcaycaatggaccactggtcyctgctgatttagtgtcacagctcaaaaccatcagtagtcctcgtgatctttcggcattgtggctccctttgtgagaagggcctaagagtgaatctcccaaccataagmtgtattcaggcaggcacgaagtctcttatttactcagtgtttctggagcccagcatagtgcctcgcacacagcaagtgcycagtgggtatctgttgaaccggcaaaacaaacaaatgaataaattaatgggtggtcactgtactagttttctattgcttcataaacaaactatcacaggcatagtgagttggaatgatggctctcaaaaaactatgtccacatcctataaatgctrttgtacaatatatggtcttttgtgattggcctcctccacttagcrtcgtgtttttgaggttcagccacagttgtagcatgtccatctctctttgtgtggctgaatatcattgcattgtatggatataccaaatatttttctcctttcatctgttgatgggcatttgtgttgtttttaccctttgactattgcaaataaagctgctctgaacatttctgtgtaagtttttgttggaacacctatttccagttcttagggatatgtatttatatcaagccaaactacctacctaaccacctacctgggagtggaattacggggtcatacagtaaatctatggttaattcatcaggaattattttataaatttttgatgttggatatctgaagataatacagaatggagcccttttttactttacagattttttttttttttgagasagaatcttgctctgttgcccaggctggagtgcagtggtgcagtcatggttcactgcagcctcgatctcctggggctcaagccatcctcccacctcagcctcctgagtagatgggaccacaggcrcatgccaccacacccagctaagttttgtatttttttgtagaggcaaggtttctccatgttgccaaggctgatcttacactcctgggatcaggagatccgcctgccttggcctcccaaaatgctgggattataggcatgagccactgcacccagccctggatttggctttttgaaacagggctgcacataacctccatgatgtgattctggctgtgtctgttgaggtcccattgggcccagctctgagattccctgttagcacagggtctgacacatcacagatgaacaatggatctttggtaattaaaaacaggctgtgtggctatttttctccaactcctttttttttttttttttttttttgagacagtctcactctattgcccaggctggagtgcagtggtgtgaactcggctcactgcaacatccacctcccgggttcaagcgattctcctgcttcagccccccgagtagctgggaccacaggcgtgcaccaccacacctggctaatttttgtatttttagtagagttggggttttaccatgttggccaggctggtcttgaactcctgacctcaagtgatccacccatcttggcctcccaaagtgctgkgattacaggcgtgagccaccgcgcctggctttcaaattccattttttaaagttartgctttaatatgttaaacacccttattaacatattacatatgttaatatgtaaaataaaytccgtacattttaaagtgctaaaggttgtatgtttgtgcgatggatatgtttaagagaatgatttaggatgcgatcagttttttttccttgacttactctcttcctttatttttttcccttcttcactttctctgttattccttgccaatctcataaataatgtaagacaacttgcaagacttattaaatgactgatttccttaaaagaagtacgtcaggtgaagggcagatagaggtcaacaccatagataaatctttacactccagtggactttgattcacatcatggctcyttctcttccttgctgaggcttttgacaatttcaaatgctccctgaacctcagtttcctttgccacaaartagcaatacaaatttataattccttagattgctgtgagaatgaattgaggcaaggtaggtaaagtgcaaggaattktgtgtggccggccaggtgcagtgtggctcaagcctgtaatcccagcactttgggaggctgaggtgggtggatcacctgaggtcaggagttcgacaccagcctggccaacatggtgaaaccccatctctactaaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaaraataaacaagaattgtgtctggcctttgtgatagttactcaacaaatcatatctgtgattgttttgrttttaacaataatggtttttaaaaaccgtaggtgatcacatactacgcagaaagggaagcagttacagyattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagtttcatgaatgcctcgctgtgccaccaggattttcttggagggagccacggtcagatttcaagtggtcatttcactctttctccctctgggggmctgagacatgattaacttgcaataattgtgactccctcattaaaggagagctgtagcaagggaagaaatcattgagactgatcaagacatcccgtgctattttttttttcttgcatatcagctgtgtgggtacctcttgttcctctgtccttcaggttagtaaaacgaagaacagttgctgaagctatgagctatcgataaaagctaatgtaccacacgaaattggaaggggaacaaaatcacttaagtgttcagggccaccaaggcactggtgcatcccctgtgagcctrtttggctcctggcggtgtttttgttgccctggcttgcaacgtagcctgattgttctaagtaaatggcagagcacgcaaatcaaggacattggcaataaaccaggaatgcactgtttccagccacgggctatccagggaattggggacagtctgtaatgtatcttgagctaggaccatatccaaattactggcctttccagtttttcttwaaatagtagggtcagtaggtgaccacactcagaagccaagcctgcagcatcagggctgaggagcaaactctttctttggtctgaagcttcaaatatgaacccttgccaccagctgcataaatatgatagccaaagggtttcaaatttgtgatttgtcataaacgctcctattgcaggctgrgtctagtccttcttgactttgtggaaggagaaggcttgaggaagtattcacaattggagaagggcgccttctgttatgttcttagctcactaaaagtggttaatgatgagaaggggtgggtcaatgacaagaaaagtggagaagatgagacagacaaaactgcaactcatcttcatggcacactggtgagtgggggagtgcaagaagtttaggtgcaaaggamaatggagtgaacatcttggcttggttaacagaagaaaagaataccaacgccgtctattttcatatccctttctattttatgtacatatttatcaatatactttttgttccagaaataaatgggaacttaggcacaatcttttacacatcttacctcaactggtgactcttcataatctagagctattatagtttccaattgacagatggggaatctgagactcagagaagttaaatgattttgtgtgtgtgtgtgtgtgtgtgtgtatgtgtgtgtgttttgtttttttgtgtgtgtgtttttgtttttttttaagacggagctttgctctttcacccaggctggagtgccttggtgcaatctcagttcactgcaactacaacatcccaggttcaagagagtctcccacctcagcctcacgagtagctgggatttcaggtgcctgccaccatgcctggctaattaagtsagtttcttaaagtcctacaactggtgagctgtgagctgtaaattgyggaactaatttttatactgccaatctgaggccttttctgacctcatcgctgccactgtaaaatgarttctagccccagaccatgacatgcctactagcttagctctaaccaraaagatttattatcccaagagttgtgaaaatgtggaagaactagaactgtcattcactgctggtgggaatgtaaaatggtacaatgaatttggaaacagttgtccagtgccttaaaaagttaaacacacacatatgtggctcagcagttcccttcctaagaacctactggaaagaaaataaatgcttatacaaagtcttgttcatgaatgttcatagcagcatcatccatgatagccaaacgccggaaatacccaaatgtccattagctggggaatggagaaacaaatgtagtctatcgacacaatggaatactactcagcaatgaaaaggaactaactctggatacctttaataacatagatgaacttcaaaaacattacgctaagtgaaggaagccggtcataaaagaccacatagtatatgatgacatttatatgaaatttctagaaaagatgaaactctatagacagcaaacagaatgatggttgcctggggctgggagtgagtggaggggattacctggaaagggtggggcaattttggggggtcaagaraatgttctaggacaagactgtggtgatggctgcacaactggataaatatactaactawcatcaaactgtatatttacaatggttaaatcatatggtatgtgaatttcacattaataaagtcataaaaaatgaattccaggaccattaaatcaggtgactgagccaatagttacaggaacatagaaagattttcacccattctgtataattagacaaattctgttactatctgtccaacagtttagcaagagtcactctgagattgaagagaggaagggaaygttggaaccaatgctgatgagccattcataggctctggctcactatatatgtctaaaattcacatgcccctaaccctcarataatgaccattaataatctggcaggagaggaaagacctgcagctcttctagtccttatgctatctcattgtctcatggatttttaatatgtctttgcatcccttagaaatttgcacttttcccccctttttccattaaaacacacctgcgtgcaaacgtccatacacacccatgtacacacagacacacacacacatgcatgcgatctgtaaaaagtcacaaaggccaaagttttaaaggaagaaaataaaaatcacctgtagtcctatcattcagagataaccactgtatgtttatttacattagttttgattacattagtttagaatgaaattttaaatacactagtatatgtaattaaaattgtatatacgttttagtcaaccatcagctgacttattcatgttctgtggactctrtggtgggtggggtccaagcctccctgaagcagatctctatcctgtcaccctgctggaaatgaaacacttaggggttagaaggggatcaaggaaagtccgagagttggttstgattatcttcagtcagaaagtgcctacttttccaagcatccagactgcaacctgtytttcctactcaaaatggtttttatggattctattcttatttggcaattgcctggactacagtcaccaacacaagtttatacgcaagaagtgcacacagccctccctcccagctcatccggtaacaatttagatgaaggatgtaaaataggattcatttcatgacccaagtctggtcaattgaaacagccgattgaagtgctgtgttgaaaaggattttgacactgcgcatgggctcgttgggaaagggtgtcatgatgggttactgattctgcggtatttttgtggacgtggggagtggtggcctacttacagtgcatcgcccactctgatttagatgagcaagagctgctgagttgtagatttctagtttctaaacaacaataagtcttgcycscagatagcctcttagcagagycaaaagccagcagagagaagactcagcatttgctttggagtaagtttgtgtgtgtatgtttatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagsgggaaattgctttccrtctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctargaatcataagtttttcaaactttagaatcacaaggtccattaaaggacatctcccctgaccttcccattttgtagatgggaagactaaggtccaagcttgaatgacctgccatcatggggataaccggaattgatacaatgtcttgattcaagattcagagctcattttttctgtgtcagattaaaaaaaaaacaaaaaaccctyactgatcttttaaatatgtaattcttcctcctcttctccccttgtctctcttctcacccctaccaatgtaatcagttctttttttcttttttggagacggaatctcactctgttgcccaggctggagtgcggtggtgcgatcttgcctcacggcaacctctgcctcctgggttcaagcaattctcctgcctcagtctcccaagtagctgggattacaggtgcatgccaccatgcccagctaaatttttgtattttagtagagacgggttttcaccgtgttgcccagggttgtctcgaactcctgagcttaggcagtctgcccacctcagcttcccaaagtgctaggattrtaggcatgagccaccatgcccggcctaatctaatcarttcctttaaatctgaaactgtcygcctgattctggtttaccacaaccaccagagtcttaagtgtcccaatagccagggtctcatagactctgcttatggttaattcttctggggaaattaatttctcgaggtaaaacaagtttttaaattatcccctatagctcatagaagcaattcagtaaatacttgttgaatatcaaatgaatgaacaaatggcattctacattgaatatagtaattcccaactttcgtgaaggttgttttttttttttttttaatgaggcaatcaggggtaaaaacccccgctgctgtcctaagacagaaagaggggggatttttccccccatggcttcgtccttattcttataacctgtatgcactgctgaacctgctgaataaccatgtcacagtggcaggagagggactgggtgaacttgagyctcgatgcctggattaaagccttgtaatgatgtttgcaaagcaccagggtgataactgaatggttggcacaggcttcgatgaagcttgtgtccaccacagtttccagtgcttctgcacctgggtggtcagaaatgagtcctgtgagacacaggtgacaagatctccaaggarscagttcacgcttggatgactctggagctgtggtgacaatctaaatcctaaattgaggcttactaggaaatgcactaggtracaggctctagagaaatggctattaccaggttgctcaggctggagtgcagtagtgcaatytcagctcactgcaacctctgccttctgggttcaagcaattctcctgcctcagccttccaagcagctgggactacaggcaggcaccaccatacccacctaattttttgtatcttttttagtagagaggggtttcaccatattggccaggctggtctcaaactcctggcctcaagtgatccgcccaccttggcctcccaaagcgctgggattacaggtgtgagcccccaggccctaccctgggcccctcctttctggcccctcaacctrttttcttccagccatgccctagggagagcttggctgtggccttgcagaccctctcagatgccactcaacaagggccaactggagagaaatctctagtctagggcacaaaatttctgtcaacccttctaaccagtgtttgaagtacgtaagacgttcatttccacttctaatgaggaattagaggaacggawttataaaggaattctggttataattgcadgtacttttagagacgatgtctaacagtgcaacccatagaaccaggctgcctggattcaaatcccagctctgctattactgagatctctatgagagctcagaaaagtttacttaatttctccaagtctcagttttctcataagaaagatgggcataaggaaataatgtagggaaaacacttgttgcagactgaggactcaacaaagttataattaaagctattactaacgtcattattatgaaaatagccatctttttttaaagaagggagttaaaggaaagaaatgccaggctgagagatgagacagtgaattacagtgggggataaaggggctgtggtgtcacacaggcctggcatctgtggccttgaacaagtgcattaatcactctaagcctcaatttctttgttttaaaaataattaactaaaataccttagggcacatggtaggaattcagtaaatgctcactgtctttctcatccttttgcttacctcacatttgcttgcagccagtgctcaaaaccatagacaggcagtgtccccaaccactccctgcgtttctctttctttgccttccgaagctgccatcttrgtggtttttgaagcatcaacacttacttcacatgcagaggccccttttatttatttatttttaatttttttgagacagggtctcgctctcttgctcaggctggagtgtagtggtgtgatctcagctcagtgcaggcttggcctccagggctcaagcagtcctcccatgttgacctcctttgtatctgggaccacaggtatatttcmccatgcctggctaatctttgtgtttctgtaaagatgaggtcttgctatgctgcccaggctggtctggagctcctggcctcaagcagtcctcctgctttggcctcctgaagtactgagattacgggtgtaagtcaccacacscagcccagaggccttctttaaatgctagtcctttttctcttcctccatctgggtcttggttccatgcgtattcagtttgtgaaaaatttgagtcgtgcacttattatgtatgtgcttttctgcatgtaattatgcttgataaaaaaagtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatgtaagttgttcagccatttacagcttagtctttgggagatatccattcattttaaatacttggagggccaggcacagtggcttataccttgtaatcccagcacttttggaggctgaggtgggaggattaattggggctaggagttggaggctagcctggggaacatactgacacctcatctctataaaatattttttaaaactcagctgggcatgatgttgcatgcctgtcatcccagctacttgggagactgaggaggacgattgcttgaggccggaagttcaaggctgcagagagctgttattgtaccactgtactccagcctgggcaacagagagaccctgcctcaaaaagtaaataaaatagtaaaataaaacgagatatttggaaggctatgtttttttgccaggccatgtgcttagtccctgggagtatagcgaggggcaatcacaggtcaggtcctagtgtctctgaagacttcattctagtggccattgaaaatgtgtaactacccacagtaatcaagttaaagaaaggttctggctgagcacggtggctcatgcctgtaatcccagcactttgggaggccggggtgggcggatcacaaggtcaggagtttgaaaccagcctgaccaaccctgtctctactaaaattatttaaaaaaaaaatagctgggyatggtggcacacgtctgtaatcccagctactcgagtggctgaggcaggagaatcgcttgaacccaggaggtgaaggttgcagtgagctgagatggcgccgctgcactctagcatgggcgacagagcgagactctgtctcaaaaaaaaaaaaaaaagcttccatttgagccgccaggaaaggaggccctgagttggggagttgaatagagagctgcatcctgaacagacatgatcttgggtgagtgagaggctaggagcggagggaaagcagacgcagttgctaaagctgtcaagtcccgctcccttggaatgcagtcctggttctgctacctccaactgggtcgatttcaaaaaattatggacttgtctgagcctgatgtggtgcctggccagggctcactgcagcgcctggtatacaggaagaacttgatgttattcatggcaaaagatgtctggatggtctccactacagattctgatggcaagtgacttaaagacatgttggcaatgggtagtggacaaaaattgaaacaccttcaactgtgtctgtgaccagaagawttttttctttttttttttttttttttktttggctgactgtcatgacttagtaaggccatcacaggttgccagaacatctactcaactgttccaagcataacctcctacacaggcctkctacataggagtatatttggccaagactcaccactagaagtgatttccactggactttcctacagcaagtggtaaatgatccctcagataggcccaagagctccccttcaagcatagagacacaaccctgtgaaaacatgcattggaaccaggaaggcctgcccccatgacttcacgttgcatacatgcctttgaggacttggcctcttaaaggaatctttcaatatcctatgcttctgagaaagttactatttcatttgcagcaggacaactcaacaagctagctcttcctgcccagcagactcggtggattctgaagagggtctcgggctgactctctacttcatgggtttgaattcaggaatgttgcaagattgcatgagattaagccgctgaaacctttctgaggaagagccagctcaaatttcagtgttggatgttcaccgcttctttagggttctaccactcccagtaaatcaagtaataggtttctgttaaaaaccccagtgtgcygatctcagtggcrgccatcttgctttgtaagccttctctagctttatgatgctcccagtatataagacatttccagtgtctagtccaaattagtatttctctaattctcgagtgtctgatctgcctggctagaatgattaaaacaaaaaaatagcaaatcagtttgacagtccacttcattaagtggagga

SEQ ID NO: 13434 - DNA, 12756 bp, Homo sapiens
tgcagtgtgtagaatttgactcagtttagagttgagttttaatcacatccacgtacagggatggggatggaattttttttttttttttttgagacagagttttgctctgttgcccaggctggagtgcagtagcaccatcttggcttgctgcaacctctgcctcccaagttcaagcaattctcccacctcagcatcctgagtagctgggattacaggtgctcgccaccacaccaggctaatttttgtatatttagtagagacggggtgtcaccatgttggccaggcaggtcttgaagtcctgaccttaagtgatccaccctcctcggcctcccaaagtgctcrgattacaggcatgaaccactgcgcctgactgtacttttttttttttwaagtatacccatacccattgtacacatttggtattttttctttaaaaaaaaaaagcatttactttttgcctcatgaatctctgagtacattttgtgcattctgtattctactktatttactcaatattaattatatgagaaataaatcctaaatgtaattttgaatggtggcttcacaaaagaacatttcctcttcttttggacatttgctcccaattttaaataacacatcattgaacatctctgtacaaaattccgtatctgatcttcagagaagttttaagatagatgtctagaatttcatctcacatctaaactgttttaagacacttggtacacattgatatgtattgtccaattgctttccagaaactatataaaatattmcaaagaaaaacatatatatatatatawatgtaaaatatatatatgaagggagaaataaatgtaaatgaaaagaaaaacatatagagaaagaatatgtctaaaagaaactgcagaggcagctataattaaagcacaaggaaaggctatgaaattctggttccacctgcaacagctgtatggtaaaaagcttattcagagtccttccttcttggaaagctttgttagagtcttatgggattgtgatgcacagatacaggggcaaggctactttttcctcgaactagttcaccaaagcttctatcctatgaaagtgaatataaaattcttaaagtttatagggtctgctgggtttaaggaggagaaatttgagttttcrtattgtcagtctcaaascttttctgaaattggaagtgatgaagtgacagtctggctatatgtgtgtgtgtgtgkkgtgtgtgtgtgtgtgtgtgtgtgtgtgtgtgtgtgtgtgtgtgtgtgtgtgtgtgtatacctagtctagggctaggtttgggaactrttttctcccgtaagttaaactgaactagactgtatgtcaaaraagagtctcaatgtcaacttaatccattgtcatgactgtaaaatgctatttcattataccagcaattcccctgtggatttctcctgactctctatgcagcccaactctattttaatctgttgtagcttttctttcccctctctcccaactccccacgttttggaattattcagtgcattcgcttccaaggcacctgtttgatatttacacaaattatgaaagtaaggtgggaaggcaatgaaggcaacaaagtatataaaacacacacacacacacacacacacacacacacacacacacacacacacayaagaaatgactacagacacctcaacacccttccaaaacacttgaatcattttcttcgggagttgaacaagtggctgaaaatgccaaaatccatcagccaatgtgtaagtacaaaagggtcagataagatatatgtggattccataaaatagtgcatttgaattcccccaggtcttttaaagatagtggttttccagatgtgacaaaacaaaagaagatttccaaatcaaaattcccatttgcctttcgggatgttgaattttctccacatttgtgcaattaagagttttgctgagtgagcttaggactctgtctctttaagtgtttaacagtaattggttcatgtcctggtgttcattgaaaatcctagacatttcatgtaaaatcttcttaatgaggggatgaatttttcattcacattagaaagctcactctgacaaacaatttctaaataaaactttggcgacatgacatcccacattggacttgtcagagaggacaggtgcattagaatataactgtatggcgatccttcaagctgtcagccatgaatattttatttcttaatgaatcatctttgtgaaatcaactttcttgttgtagtgtcagtgccatttacaacaaaaagctggctccttttaaaaggtgagctccttaaagatgctgattcctgcataaaatgtttaaccctacccaaggtgttgggcaactgggggctttgtgctttgcttctcccttctgaaagtgacttgagaacccactttgggctagtgtgattacagtgaggagaaagctttccttgatttgttgtttccttctcagaactgaaatcccaggtacctgcccagaggcagctcccttggcccttgggtccctgttgttccaggtgttactcctattctttttgtagttgtctagggatttagtttctcacatcctgaggtccactaggtgctattagctggtgctaactgacagctctaggcagaaagcctttctcaggatcccagcttccctgtcttccagaactcaaagacggcttttgtttgttagttttgaggatggagacagctrtcattctaatgaggacttaaatgtgtccctgctgaccgagccagaacttatttttatgttgccactaggagtcttctgagatgctcttgtggctggatgtagaatcsctttgctcatctctagacacagactagacaacgaaatacattcccctaaaatagcccagggttagttctatgacctttgtcactgttggtacagttctaagaggatattgattttttttttctttttaattcatagtctcaactatgtctcaagactgcccagcagtatttctgtttactcgatctaatttctcttccattcctcacagtggcaatttcaagcttctcctttttccccaagccccataatctccccctgatgcccttagaaagcttccctggtcagtcctcctcaccacctccagctccccctagaaactgaccatttatcccatcccggctgacttcttcccttttacaagaagatgtctctctttgaattcaactcagaggtcagcttcactgcctgccctgtggagtcgactctgtgtcccacccttcaggaatacggcttaatartaagatgataaggattcgtrccagggattggcaaatgacagtcattttctgtttccttaagtaaaattttattaaaatacagctccactcattcatttatatattgttcatatctaattattttcacactgcaatggtgcatagtcaaatgctttctwtctggctttttaagaagatctttgtccctcccccaccccccgccccgatttatactatggatcagcagcctaaaccctgcaaactgggtcccccatctaagagtctgcartgaaacgcgagccgacttgatgtgtctcagagtgatsattcttgcccttggcggttgatgctagactgttgcagcttcaaatataatgtattttagtgctatacgacagccataagtattggcctgtgtccactggtctccactaggagaaaaccgagccaagcttgaaagtactaagcgtgcccaggggaaatggaataagctagaaatttgttgtttccttttcactaggtttaagtgagaatatttgtgagcaaactctcagtgtgggcaggtgacaatttctgcaggtattttccccccattttaacttgtgcgatayagttccctattttgttttgttccrcctcgatcacaacagctgccacccgaggtttaaagatactgttgtcctcatcttcagaacaagggttacgtttgctgtatctggagaaagtccatagtttatgatgaattttctattaatgtaaactcccactgtttataagtcacccaaattgttkgtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacrtatacacactgacacatagattttgtaaatgaggcacatctattcttgaaatgyaattgcttaaaaatggaagttctgaaaataaataaaaagaaacatcaataaataaaagccccattttcatattcttatttgacctcttgcctctccatcattcttaaatttgacctccatcatkcttaaatttgacctccatcattcttaaatttgacctccatcattcttaatcctcatgttcttaatggacatccctcccaccctatctkggccttctgagactgttcccccagccccagtcaggagggcttgtccacaagttgctgtctgaactgggcaagcctcctggcttccctgaaatggtgctgatgtcttcacttcctgccaccttggcaacctttgtagttsctctctttttgccaggggaacaaattaagagagagaagagtgatagtgtctrcatgtggtctgctcactcagccagtattttccacagccagtctttccctagaccagcatctgagcgtgccttgtctatgggccacctatactattatttactgatgacttcctcattcactttctgttttttatctaaatgccagccttagccttgttcaaggtaacagtatacaggaaatcatgggtttcgagcatgttttgtcaatatttagtaaaatgcgttcatagctattattataaagactttaggtacattcctgcaccacttaataactgaatcaatctcctttcatcagggggaacaaacctgtctttggctcacactgtttgaggatataaaaggaagcatacagtgggcctcattctgacaaatttttagtaaatcacaggttgcctttcctaaatccctcaatatgatggctagtctgtttcatwgtgaataaaaagtgatcctggatgaatgaataaagtgaaattcagataatttttctcaaaactgaaattgtttamatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccytccctcctttctgtaaggactctaaacgattgcgcttcattaagttatttttataatgagttcctgttaccagggaatacagagttaaaaaggtgatctcactaaaagtaattagcataagacctgctggacctgtagaagtgactggatggtaatcaatagcaatatgattacacccatgcrgcaattataaattatttaaaacactacccctaggttactgactagttgcctttaaattaaattctctgtcgataattgatgcaaagaattaatgtgagaacaccttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttcyggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtgaatgtcttctgtttctckctaaacattgtcacttgccaaascatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgctaaaataaaaaaaaatgaaccacatgctaaaatcaaatggcttctgcacctgtgtgcgttcctggactctggggtcacaggatggctgatgwgatgccttcgagaaattaatactctaatgagggaaacatcctttcatgttggtgcaagagacgttctaggcctggttctacctctagttggaacggtggtcatggacaggtcacccccgctgtccagaacacatgtcaagaagtgggagctggacgacaacattcttgttcagagcgttcttcctccacattttatccaaagcagctccacttttacctgtgttatctactgagattctgcgtgtgtgaaacacaaggtcacctgccaaaagcaaaacaattaggccagcattgggctaggtgaggatccattgtcttttgggcaggtgattgtgatacwataggagccggtgtcctgttgatggcatcccacaactttctaacctctgttgtagagttttgttagccacgatttggaccaacctgcagttaggccaagggctgctgatccarttggattaaggaactctgctgtttgagcatgttggcttcattcattggtatctcctacgccaagtcctaggcttggttacaaagggcaatgaagggtcttttctgtccttaagcactcacaggtagcttaacagtaatgccttggattccttccttcaagagygayagcaggaagcccagcttctctggtagcagagcasgggtcctcaaagcagaccgtgaggtcagaggagcactggagtcaggagtttccatctccaccctgctgagtaaactgtagttacccacacagaaaaggaggctctccaggctgacagggtcacaaagacacacgactatgagatggaatgactatagctagaaaaaaaaaaaagtggggatgcccctcttgaccatcttatgcctgaaataagggaagacattcttcttttttatctgccaacctcccagtgccacagtaagcacagagtcaggcctcgaaaaatascagtcctttcgcctgtcccctctcacrtggtttgaatccaagaggctgtcataccaggctcccccattcagtatattttctttatgtttaaatagtttggattgacttctcttttcttttatttttctgttgctacttaggaaaccatctccaggctagaacaagtgcctgaaatagagaagggtgaggtcactgcctaagacacttcctcctccacccactcctctctcagactcagctccttccacttctgcccacatggctgccattttaatttttgcttaaatgttgcagccaatatttcatgtattgttgttttcttccttgcctgggagactcttttgtctgaggttccctggtattttccaggggcccttctagcacttctgtgaactcattagcttccccttgttccagaaaatgtctgtcatacattacgtgcctttctctgtctttccctgcccctctcaccttcatcgatcacacttttgcttcacagaggtaagaggaaatcacactcacacagtatcttttgttttctagcaagctagaacacaagattttctagatgcatcttttgagttgatatgcaatattttccttgacagatttgttaccagctgagcagatattgtgtctgtgatgtatttgagtaccaggtatccctgattaccatagagtaatgtcttttattgaggcttttattattattattattattattattatwatattttgagacagggtcttgctttcttgcccaggaaggagtgcaatagtgtagtcatggctcactgcagccttgacctyctgggctcaagcaatcctcccacctcagcctcctgaatagctggagctacaggcaagtgtactgtggcaattgttaatgttcacttttatttccatagttagccttgatcgtttagttttaaagagttatacaacacatacacacacatctaattgttgtgttattgggttaatgggaatattttagactcaagcctggttctttgcttctctccagcacagcaaaggatacacctccaagtataatattgaacttcaaagttagtaatgttcagtgatgcttaagcatgtagatcataaagtcctagactattttttgtctaaattattgtttgtagtcagcctctctactggttggaaacacaggcttgagtttggctttctgctctacctagttcattgctgcagctgtaatccagcctgattctaattttcaactggagatggttgtcttcttttttattccatgaaacaaattgattaatgtgtcgagggagcaaggtggtacttatacctacccagcctgcttktgtgkgtckcaagktggagagaggctgtggaaacaatagagagaatagcatggaaggccacgttgcaattaaacaagattgggaaagaagacgggactaaaatcatgccttgaagatgyttatcatatgaagttgaccttgagaccccaagaccggcttcagttttccacaatgcggctattatgagaaaaacagtgactaactgagcactgtgcataactcagttctcggaattttcaatcagaaattatctgatgacgggactaattcttattacgatagttccaatggatccacccaggatccacctccacaastaggtgtacagaagctggagatcccatcatgccgccgggcaccggtttacgagaactctatgtcttatcttggtagtacgattaggaaaacaaacacaatggtttctgccttcaatgtttccatggtgagggcagttattaggcatatgctaaagtgtaatatccgctttttcaaaccacatttcaaagttgatagcatcaacggctttaaaatcacttttaaagaatctgggcttacccagttaacagaaatagaacctgcctgtttatcagtgggtttgcctcacttttctgtgggtttcttttcttttcytaattatgcattaagaaaataacttaagtttctgtgcatacaacatcttcctttctcattcccagtaccctagaaacacagccgttcactgaagaggatttgagtgttgtctcctctgtggggtcamaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatcyattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggtcaaattgattgaggaacgcaagacttaaatgtaatatggctctggcaaattctgagatgctaacaaaaacaagttttcttaagaacaatgtcaactgactcacagtatccgactatataaagtcgagtgctctcatgccaggaagctgatacagttcatgaaacctcagtcattctttcgtattactcctgtcttctctttggaaaacaatctcatgaatttggtcttgacgctgacttaacatcccaggaaacagatactcaattccactgtcttttttgagaaatgaacagttctcaaactttgtttaaatttccttttcacagatgagtaataaccaaagatatttctgaaagggctctgaaaacatgcaggcaattgatctttaaaaataagatagaaatagtaggttttataaaagaaggaaatagaaatacttcagaagaaataaagtgtgctgaatcatgttttaaacataattatatccggaatgcacttacccatttgaaaaaaaaaaaaagtcaccaagttgtttccaattgtttttgtarrtttgcttagtcattttcagagacaaaaatttgggaaaaggattgtagaatsactggcttcccaaaaccacttggtgtttacaaagttatcaaaaacgggctgggacyactgatggtaataacaaaacctggggccctgaatcgtgtattctacatccgttagcacactgaagccacaccgcaaacttgtgaggccagcgttgcttcccctaccccttccgtcaaaaaccgtctgaggctgatcattaacttgcataaggtcacatagctaatgagaagcaaacgcatcataatgacctgggacatatgacactgaagcctactctctttccacaaagcttgatgtactcagatagtaattagtamacattttcataaataatcttaaccttttcaagcatttttgtcgattggattgtagcactcaaaagtaaggtctgttttactaatataaaattgggcctgtggaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatggatccmccmccccagttaagatatagaacattccagggccaggttcagtggatcatgcttgtaatcgcagcatgttgggaggctgaggagggtggaccacttgaggccaggagtttgagatcagtytgggcaacagggtgaaaccccgcctccactaaaaatacaaaaaaaagaaaaaaaaaaagaaaaaaatagctggccattgtgacatatrcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaaaaccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatrgaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaaccccycgctagaagtgtgtaagagtttatgttgcttcacakcctcatcagcactttgtaatttcagtctttttaattatagcctttttgtgggtgagaaacgctatctcttgctagttttattttgcattttcctagtgactaatgcmtctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtrtcttttgaaaagcagaagttataaatactgatagtgtccaatttatctttttcatttgtktagtgctttcttgttctaagaacctttaccaatcaccaggtcacaaaaatattttcctatgttttcttctagacastccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttrtactccattgatctaattttttttcttatacttactgctcgattgcctggaagctaggtaataataaggattcaaactttgttctttatttcaagattgtttgggttagtttagatactttcct

SEQ ID NO: 13435 - DNA, 12797 bp, Homo sapiens
ggctggggaggtggcggcaagaatcagccaggcaggaaagactaacaggctgcccagaggccgggagccggtgcatgggtggtagtggttgggggcattgctgagtgcagaggctccgggggaaaagccaggggttaagggatgccaggcaggcatctgacctgggactgaatcctctggcagcaacctagaagcagctcagcaaggtgagggagatttgaggcatcagaggcaaattatgtcctcttagagcccctgcggatctgccaagactgagggcttctctgtctcttttctgcatcctgtgcttggctgaagatgagaaccttgctttcccactgagaggcagtgggccacagcactgcgggagccacgrcatctgcagacgcatttgatttccccattaatagcaaagctcccactccaaggatcttccagcagacaaagggcattttaaccttcctctcagtcccagttgcttggagtggctcatgtggcctctctgaaggagggaggaggcttcagacagccccatgcatgttcagaggcaacagaaatttgcaggaagggccaggcgcagcggctcacacctgtaatcccagcactttgggaggctgaggcaggtggatcatctgaggtcaggagtttgagaccagcctggccaacatggtgaaaccccctctctactaaaaatacaaaaaacagccaggtgtggtggcacgtgcctgtaatcccagctactcgggaggctgaggcaggggaacctcttgaacccaggaagcgggagttgcagtgagccaagatcatcccattgcattctggcttgggcgacagagcgagactccgtctaaaaaaaaaaaaaagtgagagagagagagcaggaaggaaggaaggaaggctcycatgcagaaggctccggccttggctgagcatccagtttgctgggtacctgggccaggcccttctctcttgggcaatgagactcccaatgacagctgcctcgcagggctgctctgagagtcagaagacctgttcctgagttttagggatgctcagttgagcaggacctggccctgttctctggagctcatggtctgggggacaccccctcacctgcctctggactctctggcgtccatcyagccacttcagtgcgacgtgtgactgctgcttgtgcccttccccaggagtggctgtgttccgctcatcatggaggcctggtgcccggcacagtgcgcagcacttcaaggcctcagagcatgtttccttaaagccacatcatctgtgaaaggagcggagcattcaagcctgctggctcttcccaggcagagggagacctggaggagaagcccagggacccacgcatccccctccttctatgggagccactctgcctgccccacccagatgccatattcagaggatgggaggcagaaaaacaggtggcttccgccccagagggcgagcatttgcttctgtgtgatcggagggcagcacaggggctggctgggccctgggatsatcgtgacaggctttagtggtctgggtggatgggccgtggtcagagccgatgtgaccaaattggctttcaggggagcccaggccaccttctgagtggaacccaagcaccagcataggtcctggaggggccaaaggaaaagggaggttcagactcactcaggtgtgaatgctgcccctgcccaggtagggacatggcacccccaccctcttctgtgatgcaggcctagaggtggcagttctggaaagttcctcctcaccttgcaggggaaactgttgaggtggagggcacttgtccagggcagcacactgtgacaggtgggagccgaggctckggaggtgggccgggctgagctgtgacaggtgctggtgagcatctcctccgcttccccgtgctctggcygtagcagaaagtgtcccactgctgtctccaggcagctctggctcttccctaattcggccccatccctccgtgtcgcccttcttcttgggggtgggtacagtgctctgcagagctccatggcttcccagctgggtgacatggacaagccatgtcctcactctgggctccagtttcctcctctgttaaatgggcatagtgggagtacctgcttgtaggatcatcgtgagaatccagtgagttggtccctctgcagggtttagagctgtgcccattagtgctcaygcatgtgtgtgtggtcactctggtgcccatccgcatccccagtggaggccgtgcatggccttgaatgagtagctatgtgctccctttcacttctgtgctgtgggacctttaaaaaaatctgctggccgggcgcgatggctcgtgcctgtaatcctagcactttgggaggccgaggtgggtggatcacctgaagtcaggagtttgagatcagcctgaccaacatggtgaaaccctgtctctactaaaaatacaaaaattagccaggagtggtggcgggcacctgtaatcccagctactcgggaggctgaggcaggagaactgcttgaagccrggaggcagaggttgtagtgagccaagatcytgtcactacactccagcctgggagacagagcgagacactctgtctcaaaaaattaaaaataaaaataataaaaatttwaaaaatctgctgaattcactctggccgtcactgatgaaaccttgcagggaagcggctccgttgcctcagcctgtgccgctcgcagctcacgtttgctggcttaaaagcagccagagcagggaggcaagctgcccacgctgttggcygcgcactctgcctyccgaacacgttcctgtactgcttgccgtgcacggagggccacgttcatgcctttggggccacgacagctctctctagagtaggacatgggaggggggctgtgaacatctggggcagcatcttctcttcatggattgtcaggaactgcacccttgtttaccgagggacagaggccagcctcccactgccttgtggytgaggggagggggccgggtctctaacgctgtcttctttgtwctgaaaaccaaacaccttctctgcacaaggtatgtctgtgagagaaacagacaagaggacagaacggagcaggtgctgaaagggttgctgttggctgcaggatcccggctaccaggccccgagcctggcctctgctggccttcacagccagttcctgctcacgggccaggtctcaggtccagtgcctcctcccgcagaagcctccagaccctcctgcccagaggagccccccaccccacccctggctgggtgtgctctgggtgggagggctgtgactgccgggcagcgggsagggarggcgagtggttcccccaagtgcggctcctctcctgtcgtggcagggacatggcagctttcaggacaggcagaggacatagtagggaactgaggagagttgtccagagaagtttctagatttggctcagctttccacgtagggtacagacctggaagggaccgtctggccacatctgactgccaagtgctgccggggagaacctgctgaaggtgctggacgtggctgtcctgcgagaaggccacgcgtgggagctgawctgagcagggggtgctgggtcaggttagtgctggccattgggtggacgcgggcccatcgtgggcttgtgagccactgtgggcttaaaaagtgcagagttggggggatccagagtgaggggctggagcacaatttcatgtgaggggtcattctgggacagtggcaccacaagcagacccgggtggccgctggtaagggcctgtgtgtgtggttgcctaygctctttccatctcttgtcggcttctcacagcctccacagaagacagggatagttacagggaggacagggaaagtccgaagtgtgcaggcgccctgcatcccygcagccaagttctgggcggacactgccctgagccaggayggtgaggtgggacgccttccccacccagctgccagatcacccctcctggagggtggggtggggccctgacaccttgttctttgtccctgccccaaactttggggcctgaatagaggaaggcagtgacattaacttcttcctggccatggatacaggtccctgaggacaccgtgtgtggggacagcaaagccttcctaatcccccagccggccaggcaccttcacacctaaatggaaacctgcatgctggtttccatgaagaaaaggttgcgattggggtttctgggaggccagtgaggggttgggactctacaraggagagtggactcacggggcgctgggccgccctccagccaaggctcctggcctgggggaaagggggcaagggatgagggatgcagggagcagtgtgttcagaaaaggttgttycctgagcacagatttgacacctcttcactgtcagckctgagacacgcccctgccctggggagctcagaaagtcaggtgcgggatccagtggcctaattttagatcttgggtctccatgtcgaaacgacagcagagtgattaaaaaagaaaacgacagcatggccttgcccccttgttaattatggatcaagcacatttccatgagaggggcatctccacgcagggccaccgtggccgcatttctgcagcctgcaggtctccgtggcacccacaccccccaaccgggaatgggggtggactccccaccgccctgatggggcttgggtgcgccgcgggtgaggagcagcgtctcacccacagaggtgtctcctcacggggatcagcaccgggtcagggatgggagggacggtggtggccgtttcaggcaaggcccttattagacatgagaatcccaaatggcagatgaaatacccatttacccaggaccctcgggaggaacccattttgcatcagagaattctccagtattcagtgaaacttttttttttttgagtcagagtctccctctgtcgcccaggctggagtgcagtggtgagatctcggctcactgccacctccgcctcctgggttcaagcaattctcctgcctcagcctccctagtagctgggattacaggtatgcgctaccatgcccggctaatttttgtattttttgtagagacaacctccacctcccaggttcaagtgattctcctgcctcagcctaccaagtagctgggattacaggcacgcaccaccgtgcctgactaatttttgtatttttagtagagacggggtttcgccatgttggccaggctggtctcgaacccctgacctaggtgatctgcccgcctcggcctcccaaagtgcaaggattacaggcatgagccaatgcgcccagccttcagtggaactttaaatgcctgaagtttttttgtatcrtctytttaaaaaattaaccgtccgtctcagtctcaggtaggttccctgccctcctccatccaaccgtgtcatggtgacgaggggtcgctgaccagcagctcaccagagctgggacacacggccctcatgccctgcgctggtggccgagggtgctacactttttcaggactctccttgttcagtgtttctggcccctccttccagtgtcacattgctgcttatggtgcctggtgcctgtcccgtgcccctcctgttttgctgctgcttatctgctgttcggggcatcctgtgacaggccagttggaatcctacrtagagtgaaagcatctcagccccagacaggcccgaccactcccacgccagcttgtcttctcatcagggactgggctgggctgctgtggaggcctgcaagcccgcgccagcttctccaccctgctgggcctcagaggcgcctgtcagctccagctcaccaccrtgtgtggccctctgccccttgcctctgggacaggtttagtctgcagttattatgttcaaaattttaaaattttaagcagttaacactgatgcrtgatgaaaattccaacagcacaaaaaggcagatagtgacaatgtgccccttgaatccctttcccctgaacccctttccggtgtcttgggtcccttcctgagatgttctctgcagccttctgcatggcgttcaacatcatttccttcatcaacagtcgaggattacggtcccataataacaacagtaattaacgtttattagcatttcccaggtgctgacctttgcacccgttctcccactgatggtcatttggtttatttccaacttttcctactatgcacagtgctaaattaaaccacctgataccaccaatctgcacacgtgggcaggtacatgcaagatctgcagcagggtctggaataacgtcctttagttacaacgttgatgataaaaagttgattcccttctgcacccactgcctgtgtggagtttgtgtgctctcacgactccgtgggctttctctgtactctgctttctttcacatctccgagatgtgcacattcagtgaactgsacatctaagtggtcccagtctgaccaggtgtgggtgcgagtgtgtcctgtgatggaacggcgtcctgtccaggctttgtgccctgggagaggctctagccacctgcgaccttgaactagaataagcgggctggaaaatgaatgaatacaagtaattgtcaactaaaaactgttgaagtctacaacaatcacacaaatgcatgacaataaatgatgggatccgaatgcagcctgagcccgacacttctgttcttgtttggttttgaactgtgtggtggtaggaggtgctgtggcataccctcgatagctgcggggagtggggggaaggggggtcctgaagcagaccgttcaggtgtggcttgtgcacacaccccttgacacccaagtgccacaggggaccccaaattccgtcccagctgtgcatctgcaaagctcaaatggactcttgtttcaaattcgacctaatcggtggcacagaaaagctgtgaagatcgtccccagagaaaccgagcggcagcaggccctggaacaggcagagattgtgctgttctgtcctgtccctccctttgggtgacagagaaccacgaacgtctgtgtcctcagagggtcacgggacacrttccagaggkgggtggtggggagcacagtgagcacagaacatggtattttcaatccaggctgtactggcgaggagagagagtctctgtgcccagccctgctgatcccccccgctatcagggaggaactgttttcagggacagtctcaccaccctgtgaagaaggatccatttccgtcagcaccctgcctttcatgctcctccctgctgttgagcagcgtgtgctccctccctgcgcccacgctgcccaccccctgttggcatggcctctggaagctgcggacttgcagggactgaatgtgtgtgcaggtacagagtggcccagacgaggacgtgcctcccgtctgctgggctgaaaagctgtggcagccccagacccgcctgaaaagcactgcttttgcccaagaggatggacagattgtcacagctatrgttatcataagtggcctgtggctttgtgaggtattagcctcagggagctgagtggagacacacaggcctgccctgtgctgtttttgcaactttcctgaaaatctaaaagtgttctaaaataaaaggtaaaaaatgccacggttggctgggcacagtggcccatgactgtaatcccagcattttgtgaggttgagtgaggcaggtggattgcttgggcacaggagtttggaagcagcctgggcaacatagcaagaccccatctctacaaaaaaatataaaagtcacacctgtgatcccagcactttgggaggctgaggcgggtggatcacgaggtcaggagtttgagaccagtctggccaatatggtgaaaccccatctctactaaaaatacaaaaattagccaggtgtggtggcatgtgcctgtagtcccagctactcaggaggctgaggcagaagaatcacgtgaacccgggaggcggaggttgcagtgagccaagattgtgccactgcactccagcctgggcgacagagtgagactccgtctcaaaaataaayaaataaataaataaaaattttgttaaaaagggcatggtggcacatgcctgtagtcccagctatttgggagtctgaggtgggaggatcatctgagcccagggaggtcaaggctgcagtgagctgtgattgtgccactgtactccaatctgggttaccttgtctcaaaaaaaaaaagaattccatggctgcttgtcactgcagagggttggtctcacagcctggtcagggtcctgctgaggagatgtggcctggtcactgtgccttctggacacacaccacctagtgtggacacttgccaccctccacacactgcccagacaggctctacctcctgtccttcaagacctgtactcggccggactcggcggctcacgcctgtaatcccagcactttgggaggccgaggcgggcggatcacctgaggtcaggagttcaagaccagcctcaacatggagaaaccccatctctactaaaaatgcaaacttagccaggcgtggtggtgcatgcctgtaatcccagctactcaggaggctgaggcaggagaattgcttgaacctgggaggcagaggttgcggtgagccgagatcgtgccattgcactccagcctgggcaacaagagcgaaactgcgtctcaaaaaaaaaagacctgtgctcaccgtgaagccgtcacagactctggtatgaatttagccacagacttgatgttctgatgcctcgaggagcttctgggtccctcaagggcccaggtgacatgatctccagtgcagcctagagctttggaatccctcttcctcccccagacccctggtctccagaagacccctaggagcccagggaccattctagaatggcatgttgtatacacgctgtccctccccactggatggtcagccctcaggggcagcacggcttggcccagcctacccagcccagggcattcaagctttggcctcacctagagccaggctggacgccagcagggctgtgtgcagcttggccagctttggagctcccatctgtggactgccgccatgacaatagctacctcaaagtgttcttgaggaccaaaggaagtcattccttcccctcgagggaggctggaacctaatgggtatcccgggaggtggggggaggttcggatagaacatcccgctgctgtgcgtgcagcagagtggctgccatcagatttctttggggtggcctgcgcactggctctgatttgatgacgttctctgtgttttccaattttcttcttgctctttagctccttccttctggcttctccatcttcacatttcccacagaattcagttgtgatttagattttccatgcccctcactagcgtgttctggctcctgtcatgcagacaccttacacttaaataccaagtccgagataaacctgctttcagttcacgggcgcttggaggtcctgggagttctgtccttgagcatgaggaaggagatgcacagggtagggccctgtggctgtgccccagacaggaggaggaggacgaggaggatgaggaggaggaggaggaggaagaggagggaggctttccagacacacaggcagggctgggggagccatgcaggagataagccaggctgaacttgggacttttgcacacaatgcttctctgcctggaaggcccttctttctgtgttctgtgtggtgtctgcttttcatcctgcacgccacagtgtgaaggtcacctccctgactgccctcgctccaggttattctttctcccagcaccctgttctttggcgagcgcatctctggcatcatcacacagagtccatgcggcacagacaggaggcccccttgggcagaggccctgaacgcctcgcctgcttgccctagtgccccagggcctggcacttggcagccctccatagctacctgaagaacagatctgtgtgtggagaggggtcgggagctctgcactttgggaggactatggctggcatttgcttgcagttggggctggtttgcaaatatttctctctgcctcagcaggtgagaaatagcacctcggagctccttgcctgttcaattatttcygattgaattaattatcctgcagtaacagcggagctgctaatagggaacattgggtgccccccaggcggagcatgtgsctcgagagcacgcctggagctggagaccagtgggcagcccagctcttcgggggcgcaggccccctggagctcttctgacgatgggcagcttcatcctgcagtcaccagtgcatgcagaggtccagccacggccacctctttcttttctgtcctttaaatggagagggtcagcacgtagcaaatgaaccaactttgctttgactgcagctgtgaagataatgaggcagccttggttgtcatctaaactcagcaatggtcgagagctatttgggatttcctggcctgcttccaaattgcaagccctgttgggctactaatgccccaccttgtcccagcctctctttggccataggctaggccagccccagggtggacagggaggctccccagggtcggacgaaggcaggcgcctgtgagcagaggcctgggggctggatgggtggcaggtggmcaggccactcttcctagcccagctgatgccatcccgttatcttgtaattttcttcccggggccttatcagccttattagcaaatgtcagaaacaatgagagtcacttaaacctgatcatgcccactgcaccccccaccagcctggcaccagtttgaaccaagcctgcttctgaaaatgtggtggagaaagccctgctgctcctgggaggggctcaggccatttgattctgcctggtgggttcagggctgcctggctagccaccaagacacgggagagcaaagcccggccaaacccaggggcagtggtgtccagcaggcatcaggacatgccgtggcccacacatgcccttctccacaggtgccatcatctcctttcttctcctgttagtgatggcttcattggcctcaggtgacaccgccttctagcccaggccactggatccagccagagcgtctgtgcatcgccccagggaggtgtggggaggctcggccccacctggcaagtttataggctgcttgaggacataagatgggtacagaagaggcttcagggctcagcagatgctgtgctgggagtgagcccaggcaaggtggcccagggacagaagatggaaggtcagtcgtggcctccttccagaaggaaagagattttagcaggaagagacaggcaaggaaaggaattggtttttcaggcagagcggtacttttttaaattgacaaattttaagcatacagaaaagtagagaggacgaacctccaaacatcagcccttagattccagtmcatcctgccttggtagctgacgtcacgaacgctgtgacctgtccctctgcactccatcatagcatctctaaaacggaggacatttcctacctcagcacaacttcattatcacaaaagagaacattttgagcaaaagtttggaagcaggcaaaagtagggtttgttctggaatggcatgaatgaatgagtcatgggctggacccggccccgcagaaagagcagaggaggccgtctctggtgtaggagttgaagccaagactcagcatgcaggacaaggagcccagcctggtggcatgggctgtggcttctccagtgggcccataggaatggccctggggctgggacttgtggggacggcggccacaagaggaggatcttcagcatggcctgamagcacctgtaatgtaggcaggcaatgggctcctccaggtggcaggaacacygtgaggagcatgcaacgtgctggagaccatggggcatgtgacctccgggcacaccctggacagacctgggtgagaggtggkctgggacgccaggacrgtgargggcttcaaggtgtgtttgtcctttgtccttatacaggtgacctgcatgggcgggtgaggtccatcagaatgctctagaacaggacaactgaggtcccggctgccccgctcaacacrccatgattcctagactgccctgagaggtcaggttttaaatagggtgtggcccggcaaggaccctgagggatgtgaggccagacagctccttggtggccgcctgcacgggaagctgagtggccctttggaacaggaagtgccttgtccaagttaacccgggcccgggcccaccttggactccctctggagagaacggctggcctgttcgcctcctttctccttccttccaaaataacatgtccaggtcccttggtaagaatgctgcagctggggtcagtctccaaactggagtttggtggctaaaatgcccgcctttctgcccccaatttcacacatggatgatggtcctggttcagcagggaagattctcttggacccgtgtctgctggttgggaagtggagaaagccgccctgttctgcctccattttgaaacgtcttttctgttcggaggactaaaggaagccagagctggttcagatgttcatgagcacctgtgccagcccctgcccgtcacacttgaggacaccaaggctgtggtctgtgcagtgaatcggggcagtggggggacttcatggttagaaacacaagctggaggccggatgcggtggctcmtgcctgtaatccctgcactttgggatgcctgaggtcaggagttcaagaccagcctggccaacatggtgaaaccctgtctctactacaaatacgaaaatta

SEQ ID NO: 13436 - DNA, 24446 bp, Homo sapiens
  misc_feature (1)...(24446): n = A,T,C or G, or insertion/deletion polymorphism (see Tables 1-2)
tgacctcaggtgatctgcccgcctcggcctcccaaagtgctgggattacaggcgtgagccaccacgcctggctgatctttctttctttcttttttttttttttttaattttkgagatggcatctcactctattgcacaggctggagtggagtgatctcatctcactgcaacctctgcctcccgagttcaagcgattcttgtgcctcagcctcctgagtagctgggattacaggcgtgcaccatcatgcccagctaatttttgtattttttggggagatggcatttcaccatgttggccaggctggtctcgaactgctgacctcagatgatccgcccgcctcagcctcccaaagtgctgggattacaggcgtgagccactgcccccagcccaacacagatcttttttccctcccagagctcacagtggggcatggtaattataaataacatttcaagtacaaattcagtaagtgccctgagggggaagtacagctaggtatgtccgtgtaacaggaattcctgatccactggggaaacctgaaggcttccgggaaaaagaggaattcatggaatgaataaaaactcttactccaggcaagaaaagggggcaggggaaagggagacccaggtagagggaacagcatgtgccataaccccggagtcagagggatgcctgggtcttaatctccacttgwcctacctcctaccccacagcctgsagggacctccctcctacaagccaccraccccaaaagcgaagctggaggcacaggagatggtgagcactttccctggagcccaagctatccccacctccacacccaccccagggctgggaggggcctggcagggagaagctggctgggtggtgggggcagttcctgacctccccgcccctctcccactacagccctcccagctcttcactctgggggcctcggagcacagcccactcaagaccccctactttgatgctggcgcctcatgcactgagcaggtaggagctcatgggaagacaaaggtgggttgggggtctgggttgaagggccaggggtcaggcctggcaaaagaggtcaaagactaaaggtcataactcaaggtcaagggtgtgtccccrgttggtgcttaatgcattgagatgtgttcaggattccatgggggaggtcaggggtgaaaaggcccaaggtcacaaggttagaatttaaagtcacttgggggctgggcacggtggctcacgcctataatcccagcactttgggaggccaaggcaggaggatcacttggggtcaggagttcgagaccagcctgtgcaacatggtgaaaccccgtctctactcaaaacacaaaaaattagttgggtgtggtggtgcsagcctgtaatcttagctacccggggcgctgaggaggaagaatcgcctgaacccaggaggccgaggttacagtgagctaagatcacaccactgcactccagcctgggcaacagagcaagattccgtctcaaaaaaataaataaaaccaaataaataaaatcacctgggccgggcatggtggctctggtctataatcccagtactttgggaggccaaggtagctggaccccttgagcctaggagctcgagaccagcgtgggcaacatgggctacccagcaacattttgcgtctacaaaaatactgaatttacctggatgtggtggcaaatgcctgtaggctgaggtgggcggattgcttaagcccaggtggttggggctgtgccactacactccagcctgggcatcagggtgagaccctatctcaaaaaaaaaaaaaaagaggaaaagtcattaggtcaatgaaaattgattatctggtcaggcrtggtggctcacacctgtaatcccagcactttgggaggctgagacgggcagatcacctgacgtcaggagttccagaccaccctggctaacaaggtgaaaccccttctctactaaaaacaaaaataagccaggcatgggtgacatgctcctgtaatcccagctattcaggaggctgaagcaggagaatcgcttggacccaggaggcagaagttgcaatgagctgagaccacgccactgcactccagcctaggcaacagagcaagactccgtctcaaaaaagaaaaaggccgggtgcggttgctcacgcctgtaatcccagcactttgggaggccaaggcaggtggatcacctgaggtcaggagttccaagaccagcctggccaacatggtgaaaccctgtctctactaaaaattacaaaaattagctgggcgtggtggcgggcgcctgtaatcccagctacttgggaggctgaggcaggagaatcgcttggacccgggaggcagaggttgcagtgagcccagattgcaccattgcacaacagcctgggagacaagagcaaaactccgtctcaacaacaaaaaaaaacagaatgaaagaaaattgattatctacatttgctggatactgtgcctgaagctgggacaagacaaatcaagtcactcccctcagtggtctactggaggtcaggggtcagacactgaggttgcgctcaaggttcaaaggactgtttagagcccaaggttaagtatttgaggtcaagactgaggtgaaaggttcatggggaaagatttgcagagatcgagtgtcaaaagtgagtcccaggattaacagggtgagttgcacgagctgggctttgggttaaggaagggctgaatgaatgtcccagtgcaatatggcctcaggggacaaggagtgaggtggcatcttgttggcatggggagagagcggtcaggattttggggtcaagagcagattggtaatctgtgtcgtgcgtaggaagtgatcttgagttcctgtcctctctctacctccaggaaatgcctcgataccatgagctgcccaccttggaagaacggtcaggacccttgcaccctggagccacaagcctggggtcccccatcccggtgcctccagggccacctgctgtggaagacgtttccctggatctagagratgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcrtctcacatctcacctgttgatcccttagctttcttgccaaggatctagtgccccctgacctctggccaggccactgtcagttaacacatatgcattmcatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatytgaattgggggyagcaattgatactgttttgtaaactacatttcctacaaaatatgaatttatactttgaccaggtcttgccttttctgtgggatgtgaaggggatggggtgagacatgaaggggaatgaggaaggagtctaagggcttgagagaatcagtgaactggggtcaagagagttaaagacaaaaacaaagggaccaaagatacaaaataagaattgagagagtaatgagcaaaaatgtatcaatcaaaaacaaaattttttttttttttgaggcggagtctcgctctgtcgcccaggctggagtgcagtggcatgatctcggctcactgcaagctccaccttctgagttaacgccattcctctgcctcagcctcccgagtagctgggactacaggcgcccaccaccacgcccggcttattttttgtatttttagtagagacggggtttcaccgcgttagccaagatggtctcgatctcctgacctcgtgatccacccgtctcggcctcccaaagtgctgggattacaggcgtgagccactgcgcccagccctaaaaacagaatgttgagtaatggaatggggaggggtccagggcatgctgtttaatgaacattcataattgcaacagcagtatgatgaatgggacaaagataaaaatagcaattggccagatgcagtggctcattcctgtaattccagcacttcgggaaactgaggcgggaagctcgactgagtccaggagttaagagaccagcctgggaaacacagtgagaccccgcctctacgaaagttagccgggcgtggtggcacgcacctgtagttcagctactctggaggctgaggtaggaggatcgattgaggccagaagttcaaggctgcagtaagctatgatggcgccactgcactccagcctgagtgacagagtccaaccttgtctttaaaaaaataaaaattaaaaaagcagtaacgaaagtataagaggctcaagtttaatgaataaacggcaagtaaaagtagactaaaggcaaaatcatgaataatgttgtaataggagcccaaggcatgacggataataaacctgaatgaatgggccagaggcagagtgatgaataatggaaaaatagggaccgggggcaagggaggtaacggacaggagttcatggatccaaaacatgatggctaattagagaagggccggaagaacgacgaaagtgagcaggcaggctggagctaaaagtagtctgggcaatgaagctcaaatgaatggggcagaggcatgatgggtaatgggagaggaatgaatgggccaaagatagaagccgcartgacgcgaggaacaagaggcatgatgggtaacgaaaggggtgggtctaaggcaactgtttcgctaagaggtgatgagggcattgtgggtaacgaggagcagcgcagggttcgcagaacagattagaattctcccgaggcactctgggaagggccagcacttccggttttaggtcggctactccgaaccagaggtggggtgggggcccggctgccgcggtgcctggtgggacgcgaggcctgaccttgctgcctagccgcctctgccgcgcaacccacctttacctgtccttcgaccctggaacgttagccaatgagagtaccaagctgatacgccaccaaggtcgaccccgtacacgctggagccaatcaaaatgctgcaagggtcaaagccgaccaattatcacagcaacctcgccgcggggcggaatcaaaagagggcctcctccaggagagaggcggggcgatgcctcagcgggcgtggcaaaatgctcagcacagaccaatggcgggttagcaccggaacccgcggcgacgcgagccaataggcgcaggcgctgcgagccaatgggaagggtgggaggggcgccgtggctaccctgcgagtgagaaccaatacaaaaggacatttcagggaaagtgggcgggactttatgcacaagtccaatgggaagaccgagtcttgacgctggtgggcgggcctcagggcacactaaaccaatgggctaggtggggcggggcgacggtggtggcggcggcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaagggtgaggggcgaggggcccccgckgggctgcgatggcctggatctcgggggaagggggaggacactggggactctgggatttggcgcgcaccattggaattatttaacagcactaggaggtgatgttgggatcgaatggtggaacgttggacttggggcttagaatgatggaatcaaatgctggaaacgggatggaatgtcatagcagtagagaaaagcctttagggacctgaggagccccgggatcagccaagccagacttctcttgtgatcgggaaggcaactgaggcccaaggtcacggtgtcagcaaggtgtcagcraggttccttgggtatgggacccaaagcctccggatcccagcctggagcaattagagtagtagtrgtggtggagatttatggagttctgttctggtgttcattatacgttaactcattagatccttgggacaattctgtgtggtgagggtcccatctttcagatgatgagtttgacctaaagttgctcagcttggtggcagtgagatttgagcaagcaaaggccctggccctgtctaactaggctgtactgcctctttacaggtggaatcctttgtgagatgttctgctgtgggtctctggagagagctgggggtggtagggaaggaagagatgagagttggtgtggggttggrgtggagtgtgacagcgtttctcttctccagagctgttwcccattcagatggagggtgtcaagctcacagtcaacaaagggttgagtaaccatttycaggtgagccttcctggtgtccttacccaccagagatcgtccccgccgtccccctccctgcatstgcacactcggcccaattactcctccctcaagagctgggctccctgatacttgaaaagactcggaratatagtgccagactgactactcagtttggggacctagaatccagaggtactgtctccccatagsagctaggctggagtgaaggaacaggtctgtgggcctaccggcagcacctcctttctctgagtctcttagtcaggccgtgcctcccagtcttcatcccctgcccagcccagagaccttgtccttgccctcttcagtgggcaagcctatctgtccagtatcgtcacagctctcgctttccttccaggtcaaccacacagtagccctcagcacaatcggggagtccaactaccacttyggggtcacatatgtggggacaaagcagctgagtcccacagaggtgagcttcctttttcatccattcattgtatcyttctaataacaaatttgtagccaaatgtcaagctaagacggcctcatcaggaaaagrtcacagctaccgagagcctggagatggggattgcatctctccgaggtgcactgggacacaaataattccttcatccagcaaacatccgccaaacccctgctctctgcctggccccatgctgagcagtgctggggatgtggccacagccaccctgtcaccagacagcgatgacccagggtggaaagggctggactgtagatcatgcagaactttgaatgccagactaggctttggactttctctagggggttgtggagagtcatggcatggtttggtcaagggaaagacgtggtccacaggttcccgctgtagaaatctctggggcatctctggggtggccatgtgggggctagttattaggaagggcaaaactggaggcccagacagggttgggggkactgaatgaggtctctgcttctgtcatttcccttcagcaaatgtgtttattctgcaaaccttcattgcacaacacattctgtgcccagccctgtgctggcacacatgactgaaacagcatgggactcacccgtggggcaggggacagactgttcccagagagtaacaagccaggatgggcaaggctgacatgggggaacccaaaggtcggggagcctaactcagcytaggtggtcagagagcacttcgtggaggaggggacccccatccgaggctttctgaccctaggcttctcaccccggcccatctcacatacttgcacagtgcaccacctctgaccccttccgttctctctgcctcacaggcgttccctgtactggtgggtgacatggacaacagtggcagtctcaacgctcaggtcattcaccagctgggccccggtctcaggtccaagatggccatccaggtgagtggggcacggaggctgctgctcccctcggccaccgtgagcagggagccgccctcacaccccctcctctccacagacccagcagtcraagtttgtgaactggcaggtggacggggagtatcggggctctgacttcacagcagccgtcaccctggggaacccagacgtcctcgtgggttcaggtaagaggcggagggcttggagggtggtcacaaaactgcagttctggctttgccagcaaatccaccccatttgtgaacctccttttctgccactggagaagtggctcagcaggagtgattttgaaacatcaggcaacatactacagtgggtgagacggtcacccactgaccatgagtgggtgagtcagmgcagtcttttttttttttttttttgagatggagtcttgctttatcacccaggttggagtgccgtggcacgatcttggctcactgcaacctccatctcctgggttcatgcaattctcctgcctcagcctcccgagtagctgggattacaggcatgcgctaccacgcctggctaatttttgtatttttagtagagacagggtttcaccacattggtcaggctggtcttgaactcctgacctcaagggatccacccacctcagcctcccaaagtgctgggattacaggtgtgagccaccacgcccagccagtcagcgcaattttaactgagattttcttttgtattaaaaaatgttttaagatggggtcttgctgtattggccaggctggtcttggaactcctggcttcaagcartcctcccaccttgaccttccaaagtgctgggatgacaggcgtgagccacctcgcctggccagggaaacagcttttcagcctgcaagtagtgcagtcgggactcgtgaaaggaacttgagggaggatggtcccctggttgcataaggctttgcagagccttggccttcgctctgagtgagtctggggctttcggaaaccaaggcatagcttctcacaggaccctgcagctggcgtagagagcagactccaaagggggtaccactgggagggagtggacggggrgaggaggttggattctggatgttgtttgaaggcagagctgccaggatttgttgagacyggatggaggcgatgactctgtagtttttggctggaactggaaggatggagtttcrgattgccagctttgtgtctttgtgcagccatccactgtgtcgtggagagcaggctcttgagcgctgagtcctgagtgaatgactcgtgcaggcggggaggggagctagggttggccttggacccctgggagtgcctagggagagtcaccacttctcgctgcaggagcccagggagactcaaaagtgttgacttttgagctgccagaggaggagaaggggctaccccggctgggggacaggagcaagaagattccaggcagggagaagcaggaacaggggtgagggaagggaagggccatggcagaaaacccagsagacagggaagctggaggtgcagcaggtgcagagaggcctcctaggtgaggctgatctgtaggggccccatgaggaagaaacmtttcctgtccccaactcacctggtgacatcaccccatcttctcatacactacagttgaaccacatgagccttttttgttggtttgtttttgtttttgagayggagtcttgctctgttgcccaggctggagtgctgtggtgcaatctcggctcactgcaacctctgcctccctggttcaagcgattctcctgcctcaggctccctagtatccctagtagctgggactacaggcgcgcgccaccatgcctggctaatttttgtatttttagtagagacaggttttcgccatgtcggccaggctgatctcgaacttcttacctcaagtgatccacccgccccggcctcccaaagtgctgggattacaggtgtgagccaccgcgcccggccgaccatgcaagcttttctgacggttcctgaaaccaccgagttggttctaccccaggaccgacgcacactctgtccctgctgcatggaattcttccctctggtcttgacatgactgggaaggcttgcgtgcgcatgtcgccctctgtcgtccaccattgtccccatcttgcaaggccaagaggaggttctccactaagggcacatggccagtgggactccagtgtccctgctcttcacggcgccagcaaccccgttccctgtgccgcctcgctcgcctggtcctttcgtgctccccagcactggcctcctggagcccagggccaccagtgacgctttggtctctagtcctttccagtgcctcttccttcccccagacaccagtgagaacagggcctgccgtgtgccggtcagggctgagctctcgagtctcttgccaccaacagctccgacttgacccagggtgtctctacctccaggcggctctgtgacctccggcaagtggttccagcccttctgggcttcagtctcctcatctgtcacttgggcacaatagaagcaactacctcccagtgaaggagtccatgagagggcccgacttctcggcctcagcactgggccacatgcacagtcaccacttgctccactctggcatctccatggggacaatgcccgcaggcacccccatttcacagataaggaaagcgaggcccaggggtgaaatcagttgcccagggtgacacagccaggaagcagaggagctgggatttgaatggaagcttaattcaggagcccgtgagcctccccagcccctcccaatggtgacagctccttttctgcttcactctgagcacctcatgtgtgcccagccctgggctgggacacagcagtgaccgagacagcccattcctgccctcatgggggtcccaggtcaggcacagtggctcacacctgtaatcccagcactttgggaggctgaggtgggcggatcgcttgagatcgggagttcaagatcagcctgggcaacatagcaataccctgtctctacaaaaaaaattagaaattaggcatatggtggtacatgcctgtagtcccaactactggggacgctgagctggcagggcacatgcctatagtcccagctacttgggagcctgggaagggggagtggttctattctgaagctgaggccaagccatccaaggccttgcaggtgtgctgaggaacccatatcttctcagggcacgagggagccatggcaggttctgggcagggggtcaacagggtcaggtttgtgctttaacatgatccctctgtctgctgtctgtgaggtcacttgaagttggggcatgagactagagaggaggctgtgggtagagaaactgggggggtggcccaggagatgggaaggatggttagaaagatacttgagggtctcatggcctcagttccaacagtccctggaactcagaggccagagattctaagtcactcactctagatggctgcttttccctctgggcttcagtctcccccttgattgaatgaggggataacactgaccagagtggtaatggtagtgattttttttttcttttcttcccctgccccacctcacatacctctgccctgagacgcagtctctgttgcccaggccagagtgcagtggcacagkgtcagctcacctcaacctccaccttctgggttcaagtgattctcctgtctcagcctcccaagtagctgggattacaggcacgcactgccacacccggctaatttttgtatttttgcgtcgtggcacatgcgtgtaatcccaggtactcgggaggctgaggcaggagagtcgcttgaacccgggaggcagaggttgcagtgagccgagatgacgcctttgcactccagcctgggcaacaagagcaaaacgccccatctcaaaaaaaaaaaaaaaagagagagagagggagagatgggggtctcgccatgttgccccagctggtctcagactcctgggctcaaacaaccctcctgcctcagcctcccaaagtgccaggattacaggcgtgagctactgtgccccgcccgtgtgatggtgattcaacaaccagtggggggttcggggattcatttgcttcatctcctctgggaaggagagtcacacagtcgcttgcccgagcccatggggaccagctgcagcctacttctgatctcagcctccccagaagatgccaccagggcactggccatgaactcacggcctctctcacacccaccaggctcatcttgggggttgccgcctaacactcagcccctctgagagctccacccagccatgcctgcaggtatgaaaggcccctattcctgcagctccagagagctggctccaggctggctccatgctagcaggccagcctgctcccactgtggggcccctagtctgcccctctggtcatcttggtctgggaagcatcttcgcacctgctttgctctgtgctgtctcagcttctctgtgtgccctcagtctcgtggcccccaacctcccttcccttctccacgtgtcttcctctccrgggctgcaccctaggagattgctcgatcgtggtggatttctcaactgtgaatcttcagtccctcttcccccttcatttctgtctctgcagatgtgttgtttctttttttttttttcttttttttttttttttgkctttttgagatgaagtcttgcactgtctcccaggctggagtgcagtggcacaatcacaatctcagcttactgcaacttccgcctcccgggttcaagcgatyctcctgcctcagcctcctgagtagctgggactacaggtgtgcaccaccacactcagctaatgtttgtatttttagtagagacagggtttcaccatgttggccaggctggtctcgaacctccgacctcagacgatccacccacctcagcctcccaaagtgctggaattacaggtgtgagccaccgtgcccagcctctttttttctttaaaaattttttaggccgggcgcggtggctcatgcttgtaatcccagcactttgggaggccgaggcaggcggatcacgaggtcaggagatcgagaccacggtgaaaccccttctctactaaaaatacaaaaaattagccaggcatggtggcgggctcctgtagtcccagctactcggagaggctgaggcaggagaatggcgtgaacccgggaggtggagcttgcagtgagccgagatagtgccactgcactccagcctgggygacagagcgagactccatctcaaaaaaaaaaaaaaaaaattaaatttcttattttttgaaacaggatctctgttgcccacgttggagtgcagtggcgtgatyatagctyagtgtaaccttgaccttctgagctcaagtgatcctcctgcctcagcctcccaagtagctgggactataagcatgtgccatcatgcctggctacgtttttaaatttatttatttgttgtttgtttgcttattgggacagattctcactctgtcactcaggctggagtgcagtggcactatcatggctcactgcagcctccacctcctgggcttaagcaatcctcccacgtccacccccttastacctgggactacaggtgtgcaccacctcacccaactaatttttgtattcgctatgtttcccaagctggtttcgaattcctgggctcaaatgaacccactttggcctcccaaactgctgggattacaacaagcatgagccactgtgcctggccttgatttttttttttttttatgataatctgtagttagatgaagtttttaaattttttgtagagatggggtctcactatgtcacctaggcttgtctccaactgctgacctcaagctgtcctcttgccccagccctccaaagcattgggattactggcatgagccattgcatctggctttttttttttttttgagatggggtctcaccatgttgcccgggctggcttygaatgcctaggctcaagcaatcctcccttctcagcctcccaaatagctgggattacaggcacgtgccaccacgccaggcttgttttctttccctgtccctccctctctatttcccactctcttcctccccaattcttctggccctataaaatcacatttgtggcctgtaccctgctaggctcgaaagacaccaaagtgaatccatctccatcctgaggcttgaaaaggcagcccaaaggtggcagttctcttgttcagcaagcactccctacggtggagggacacaggaacgyagacttggacctcagtgcagcaagtcccagccacagctgagcactcgattcctcacaaccccaagaggcagttaggttcacagagagatgatgccagcgtccatggtcaccagccagcctgtggcagggctgggattcgaacccaggctgtgcatatttacccactctacccaatggcctctcagcagcagagtggctcagagcctgggtttgggaggtgtggaggcttggattctgcccttgacacattttgtgagcatgagtgagtgacttaccctgtaagcttctataagtggtggtgaccccctctgtaagtgggggtggataaatgctgaccacatgggcttgtgtcgaccagatgaggtccttcaggtaatgcagtcatagcagggcctgggacgctgacctcagcggtagggaacccctgggcgatgggttaggagaarggagcccttgagggaggcctgagagcaagcccaagcctccagccggggtgagcctagagggcttcytggaggtggagtctagcctggcactcagggtgggtggaaactgatcgtcattttgcccacaggaatcctcgtagcycactacctccagagcatcacgccttgcctggccctgggtggagagctggtctaccaccggcggcctggagaggagggcactgtcatgtctctagctgggaaatacacatgtgagcctggcrcctgggtccgagggtggaggggctgggcccctggactcctcctgggtctgagggaggacgggctagggccctggacactcaggtctgagggaggaggcctgggttcccagatgcccaaatccccttggtaatgagaccccgcctccaccccactctctgacagtgaacaactggttggcaacggtaacgttgggccaggcgggcatgcacgcaacatactaccacaaagccagtgaccaggtgagtgggtgcagggactagctggtgctgccaggggctgctgggcctggaagtccaggtggggccactngctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctckgttcccctacgcgggaaacaggcaggaggtgactcaactctgagtggatgtgtgggccaccacaggtgctggaggacagtgtgctgccaccctgtgggcctccacattaccrgggaacacttgttaaaaggtaggtggggccgggtgcggtggctcacgcctgtaatcccagcactttgggaggccaaggcgggccgaggtaaggagattgagaccatcctggctaacacggtgaaactccgtctctactaaaaatacaaaaacaaaattagccgggtgtggttgcgggtgcctatagtcccaactactgaggctgaggcgggaaaatggtatgaacccaggaggcggagcttgcggtgagccgagatcgtgccaccgcactccagcctgggygacagagcaagactccatctcaaaaaaaaaaaagtaggtggacaaccctctactatgttttatgcttggaaaaaaaaagtaggtagagcrgccaggcgtggtgactcacgcctgtaatcccagcattttgggaggccaagccaggtagaatacttgaggccaggagttggagaccagcctggccaacgtggtgaaatcccctctctactaaaagtacaaaaattagccaggtgtggtagcgtgctgcaactgtagtccccgctacttaggaggctgaggcacaagaatcacttgaacctgggaggcggaggttgcagggagttgagactgcaccactgcactccagcctgggtgacagagtgagactccatctccaaaaaaaataaaatgaaataaataaataaatgttaaaaaaaatctggtggagcatctgatgggtgtttgggccaagctggagctttgtccatcccctcttatttttctgcacttgactctcttatttttctgagactggtctccctctgtcgcccaggctagagtgcagcagtscaactgcggctcactgcagcctccacctcccgggctcaagcagccttcccacctcagcctcctgagtagctaggaccacaggtgtatgccaccaggcccagctaatttttttgatagttttgggagacatgggggtttcaccatgttgcccaggctggtctcgaactcctggactcaagccttggcctcccaaagtgctgggattataggtgtgagccaccacacccagccagggtagaaggcactttggaagcctcgagcctgccccattcatcttacgttagtggaaactgaggcttccagaggtttcaaggtcacaactaaatccagaacctcatctcaggcacactggtcgtagtcccaatgtccagtcttaagtcttcttggatatctgtggctcacagattttrggtgtttgagcctcctgctgagcactgctggggccacagcggtgaccagccctgtcttcacgggactcagtgagaggaacagattcatccgcagagtgggcaggactaggttgggggaacccaggggtctagagggcttttcagagggcaggggtcactgagcggagagcagaggaggagtgagccatttgctccagcgtgaagttgttggtgtgatggggtttcagggtggcaggmgcwgtgtggttaaaggyctggaagctgtcggcatgtggctggtatccaaggtggccaggaactctgcatggatatggtgggaagctggcacgcctctcacctcagctcttccctgcaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccrcctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccrgaattgaggggcacrcaggattytgagcaccaggggcagaggcggccagacracctcagggaggagtgtcctggcgtccccatcctccaaagggcctgggmccgccccgagggggcagcgagagsagcttmcccatccccrgtcagtccaccctgcccygtccactttcccatctcctcggtataaatcatgtttataagttatggaagaaccgggacattttacagaaaaaaaacaaaaaacaacaaaaaatatacgtgggaaaaaaaacgatgggaggcctccgttttctcaagtgtgtctggcctgttttgagcatttcatccggagtctggccgccctgaccttcccccagccgcctgcagggggcgccagagggccggagcacggaaagcagcggatccttgatgctgccttaagtccggctcagaggggcgcagcgtgrcctggggtcgctatcttcccatccggaacatctgccctgctgggggacactacgggccttcccttgcctgagggtagggtctcaaggtcacttgcccccagcttgacctggccggagtggctatagaggactttgtccctgcagactgcagcagcagagatgacactgtctctgagtgcagagatgggggcagggagctgggagagggttcaagctactggaacagcttcagaacaactagggtactaggaactgctgtgtcagggagaaggggctcaaggactcgcaggcctgggaggaggggcctaggccagccatkggagttgggtcacctgtgtctgaggacttggtgctgtctggattttgccaacctagggctggggtcagctgatgcccaccacgactcccgagcctccaggaactgaaaccctgtctgcccccagggtctggggaaggaggctgctgagtagaaccaaccccaggttaccaaccccacctcagccaccccttgccagccaaagcaaacaggcccggccyggcactgggggttccttctcgaaccaggagttcagcctcccctgacccgcagaatcttctgatcscacccgctccaggagccaggaatgagtcccagtctctcccagttctcactgtgtggttttgccattcrtcttgctgctgaaccacgggtttctcctctgaaacatctgggatttataacagggcttaggaaagtgacagcgtctgagcgttcactgtggcctgtccattgctagccctaacataggaccgctgtgtgccagggctgtcctccatgctcaatacacgttagcttgtcaccaaacatacccgtgccgctgctttcccagtctgatgagcaaaggaacttgatgctcagagaggacaagtcatttgcccaaggtcacacagctggcaactggcagagccaggattcacgycctggcaatttgactccagaatcctaaccttaacccagaagcacggcttcaagcccctggaaaccacaatacctgtggcagccagggggaggtgctggaatctcatttcacatgtggggagggggctcccctgtgctcaaggtcacaaccaaagaggaagctgtgattaaaacccaggtcccatttgcaaagcctcgacttttagcaggtgcatcatactgttcccacccctccyatcccacttctgtccagccgcctagccccactttcttttttttctttttttgagacagtctccctcttgctgaggctggagtgcagtggcgagatctcggctcactgtaacctccgcctcccgggttcaagcgattctcctgcctcagcctcccaagtagctrggattacaggcgcccgccaccacgcctggctaacttttgtatttttagtagagatggggtttcaccatgttggccaggctggtctcaawctcctgaccttaagtgattcgcccactgtggcctyccaaagtgctgggattacaggcgtgagcyaccgcccccagcccctcccatcccacttctgtccagccccctagccctactttctttctgggatccaggagtccagatccccagccccctctccagattacattcatccaggcacaggaaaggacagggtcaggaaaggaggactctgggcggcagcctccacattccccttccacgcttggcccccagaatggaggagggtgtctgkattactgggcgaggtgtcctcccttcctggggactgtggggggtggtcaaaagacctctatgccccacctccttcctccctctgccctgctgtgcctggggcagggggagaacagcccacctcgtgactgggggctggcccagcccgccctatccctgggggagggggcgggacagggggagccctataattggacaagtctgggatccttgagtcctactcagccccagcggaggtgaaggacgtccttccccaggagccggtgagaagcgcagtygggggcacggggatgagctcaggggcctctagaaagagctgggaccctgggaasccctggcctccaggtagtctcaggagagctactcggggtcgggcttggggagaggaggagcgggggtgaggcaagcagcaggggactggacctgggaagggctgggcagcagagamgacccgacccgctagaaggtggggtggggagagcagctggactgggatgtaagccatagcaggactccacgagttgtcactatcatttatcgagcacctactgggtgtccccagtgtcctcagatctccataactggggagccaggggcagcgacacggtagctagccgtcgattggagaactttaaaatgaggactgaattagctcataaatggaacacggcgcttaactgtgaggttggarcttagaatgtgaagggagaatgaggaatgcgagactgggacwgagatggaacyggcggtggggagggggtggggggatggaatttgaaccccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcgttgctggtcacattcctggcaggtatgggggcggggcttgctcggttccccccgctcctccccctctcatcctcacctcaacctcctggccccattcagrcagaccctgggccccctcttctgaggcttctgtgctgcttcctggctctgaacagcgatttgacgctctctgggcctcggtttcccccatccttgagataggagttagaagttgttttgwtgktgttgtttgttgttgttgttttgtttttttgagatgaagtctcgctctgtcgcccaggctggagtgcagtggcgggatctcggctcactgcaagctccgcctcccaggtccacgccattctcctgcctcagcctcccaagtagctgggactacaggcacatgccaccacacccgactaacttttttgtattttcagtagagacggggtttcaccatgttggccaggctggtctggaactcctgacctcaggtgatctgcccgtttcgatctcccaaagtgctgggattacaggcgtgagccaccgcacctggctgggarttagaggtttctaatgcattgcaggcagatagtgaataccagacacggggcagctgtgatctttattctccatcacccccacacagccctgcctggggcacacaaggacactcaatacatgcttttccgctgggcgcggtggctcacccctgtaatcccagcactttgggaggccaaggtgggaggatcacttgagcccaggagttcaacaccagcctgggcaacatagtgagaccctgtctctactaaaaatacaaaaattagccaggcatggtgccacacacctgtgctctcagctactcaggaggctgaggcaggaggatcgcttgagcccagaaggtcaaggttgcagtgaaccatgttcaggccgctgcactccagcctgggtgacagagcaagaccctgtttataaatacataatgctttccaagtgattaaaccgactcccccctcaccctgcccaccakggctccaaagaagcatttgtggagcaccttctgtgtgcccctaggtactagatgcctggacggggtcagaaggaccctgacccaccttgaacttgttccacacaggatgccaggccaaggtggagcaagcggtggagacagagccggagcccragctgcgccagcagaccgagtgrcagagcggccagygctgggaacyggcactgggtcgcttttgggattacctgcgctgggtgcagacactgtctgagcaggtgcaggaggagctgctcagctcccaggtcacccaggaactgaggtgagtgtccccatcctggcccttgaccctcctggtgggcggctataccyccccaggtccaggtttcattctgcccctgtcgctaagtcttggggggcctgggtctctgctggttctagcttcctcttcccatttctgactcctggctttagctctctggaattctctctctcagctttgtctctctctcttcccttctgactcagtctctcacactcgtcctggctctgtctctgtccttccctagctcttttatatagagacagagagatggggtctcactgtgttgcccaggctggtcttgaacttctgggctcaagcgatcctcccgcctcggcctcccaaagtgctgggattagaggcatgagccaccttgcccggcctcctagctccttcttcgtctctgcctctgccctctgcatctgctctctgcatctgtctctgtctccttctctcggcctctgcccsgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgygcggccgcctggtgcagtaccgcggcgaggtgcaggccatgctcgrccagagcaccgaggagctgcgggtghrcctcgcctcccacctgykcaagctgystvagcggctcctccgcgatgccgatgacctgcagaagygcctggcagtgtaccaggccggggcccgcgagggcgccgagcgcggcctcagcgccatccgcgagygcctggggcccctggtggaasagggccgcgtgcgggccgccactgtgggctccctggccggccagccgctacaggagcgggcccaggcctrgggcgagcggctgcgcgcgcggatggaggagatgggcagccggacccgcgacygcctggacgaggtgaaggagcaggtggcggaggtgcgcgccaagctgraggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttag

SEQ ID NO: 13437 - DNA, 14863 bp, Homo sapiens
ttacacaaaagtaaagataatagaataataaattcctatatatttgttacttagattcaatacttattgatattttcatgttttattcctttttatcttgtatacatagtatatcaacaaagctagtttacttaaacaaaactacactgtgttcatatactgtatatacaagatttattttccagatgtaataggaaaaaaaaaaaaaactaaattatttgcccaagaaatgcccacctattcaatatagttcataygtatatatatctaggcttaatttacaaatgaaaacttgtttgctactataaatcagagtgttaaaattagacttatttatatacctcactgaatctcaattaactaagttcacaggtcagtttcaaaatcatcatttgtttaagatacattcattcattcccccattatgaagttgggactgtgcacagaataggtaaggcatattttatatacacatataaattaaatgtcattaagtggaaaaatctaaaatcaaattttaagacaataattttatgaacatcatagagataaattctttagctgttaaactgcaattcacaaaatttgcataacaatacccttcccagccttaactgatccctttattgtatattcactcaggagattctaggaaattcagtggaaagcaaccgctggaaactgaacaaggtgagaagagttttcaggtgctaccaaccataaagtaaagagaattcagactttaagttaactacattagaaatgtttgatgaatacctggagttttccactaatctgycctaacaaagtatgaaagtaaactttcatgacttcatggtgatcactcagcaagtttattactaattagaaccaattcaaactcttcagaggaacataacagaaaccagtgtctgcattgtattctccgaaatgtcctgtagagatgataaattacagtagtcctcacctcatctgtagttttgctgtctgaggtttcagttatcatggttaaccacagttcgaaaatattaaatggaaaactccagaaataaataattgaaaagttttaatttgcatgtcattttgaatagtgtggtgaaatctcgggccatcttgctctgtcgcaccagggatatgaatcatccccttgtccagcatatctatgctgtatagacactaccctcctgttagtcacttagtcccatcacaggtatcagatagaaaaaacatagtatatataggtttggtactatctgtgatttcaggtatcaactggggttcctggaacatatcctctgtgaataaaggaggactactgtattagatatacaggaaagaaacaggaaaatgttgaccttattaaaaaargaagttgataaaagcagatcctgaggtgacccagatattgaaattagcatacaaggaagtcaacgtaagttctgtaaatatgtccgagaatataaaggaaacaatgtttataatgagtgaaggtatggagtatttcagagaaatggaagctgtaaggaacataagaactccagaaagctgaaaagtaaaatacctcaatttaataattcactggatatgcttaacatcaggtagagatgataggaggaagagtagtcaacctaatgactacttttgtagtcatctggccataggccaggatttggtctacaggccaaagttttctcaaacatgatactattgttaaaagtaaatataatgagaatttatttatttatttatttgtatttatttttgagatagggtctcgctctcttgcccaggctgaagtgcactggtgcaagcttgacccactgcaacctcacttcctgggttcaagctattctcctgcctcagtctcctgagtaggtgatattacaggtgcctgccaccatgcctggctaaattttgtatttttaatagagacagggtttcaccatgttggccaggttggtcttaaactcctgaccgcaagygacttgccygcttcggccttccaaagtactgggattcctggggtgaaccactgtgcccggcctaatgagaatattttaaaatcagctagtaaattaaagatacattatatgtagaccaaagtataatgacagatgaatggaaatgatccaatctaaagaacggagaaagaaaaaaaattacttagcactgcctcagatacaatgaacgccctagcacacatgcagytggagtcctagaaagagaaggaaaaacactggtcaaaaaacaggttttaaacaaaagcctaaaaaaaataagtaaaaataaaaaaaatagcctaaaatttcctaawtgtggaataaaatctcaatttatagttcctagaagctttgtgaatcaagcaaggtaagcttgaaagccaaacatagacacatcatagtttatttaactctgaggttggaaaacttttctgtaaagggccagatagtaaaataagccatataaagactctcttcattcttcctcctcttcttcccccccctcctagttctcttcattctccccttcttctacttctccttttaacaaacctttacaaatgtaaaaacatcctttgcttacagatcatacaaatataggccatgagtcagatttggtctacgggccaaagttttatcatacatggtataagtgtcaaaaggcagatataaaaaaatttttgaaatcatctagtgaattaaagatatatatatatagaacaaagaaacaaataatggctatgttgtcataaggatgaatgaaatccagaaaataatggtgccacatctttaaagtgctaaacaaagaagaaaacacacacctctgtaactatgtggaaaatatccttcaataatgaaagtagattaaagacattttcagataaagggaagttgagaaaatttgtcaccagcagctctgcactaccaaaaaaaaaatgttaaaggaaatttttcaagcaggagggcaatatatataagctagaaccacagagtatggaaaatgggaaaggtatggttaatgtaaatttttttccttcttttcatttctttaagattgttttcatagttttgtgacttcaaacaaaaatgacaacattgtattgctggcttacaaattatgtgcaatatatgaaaacaatagtccaaaagataggactatatcactatatcatgagcttaaaatactaccatctcacactggtcagaacggctattactgaaagtcaaaaataacagatactggtgaggttgcagagaaagggaacacttatacactgctggtgggaaagtaaattagttcagacactgtgggaagccgttgggagatttctcaaaaaacttaaaacagaactagcactcaactcagcaatcccattactgcgtatatgcccaaaggaatatatatcattctatcataaagccacatgcatgcctatgttcattgcagccctattcacaataacaaagacatggaatcaacctaggtaccatcattggtggactgaataaagaaaatgtagtacatatacaccatggaatactacacagccataaaaaagaataaaatcatgtcctttgaagcaacatggatggagcagaaggccattatcctaagtgaattaatgcaagaatagaaaaccagatactgcatgttctctcttatgagtggagctaaacattgagtacacatggacacaaagaaggcaacaatagacaccagggcctgcttgaaaagggtgggaggggggtgaagattgaaaattttattatgcttattatctgggtgacaaaataatctgtacaccaaatcccatgacacataatttacccatgtactacctgaacctaaaataaaagttggaatggaaaattatacaaagaggtactgctaaaaagataataaaggaaataaaatggaatactgaaaaatatttgtttaacataaaagtagacagaaaaggaagaatgggaacaaaaattttgtgacacaaatgggaaacwaatagcaaaacccaatcatattattaactatattaaatttagggactaaacacacagtaattgtcaggataaaaaatccatctattttactctttataagaaatcttttaaatgaaaataaagataggttgaaagttaaacaaaatcagaaaaaacataccatacagagtaagcatatgaaaactgctgtggcaatgttaataaaaaataaagtagactttaggacaaaaagtgatatctgagattaagtggagatcttcacagttatcaaaatattaatttataagatataaaaatctaaagattcaaaatattctaaatatgtatgtgcctcataacagtgcttcaaagaacaggaagaaatactgaaaaaaatgaaagaaaggtaggaatccataatcgcagattggaaaaatccacatttatttgtttgccaagagagaccatgcactgagccataagttaaatttcaataaacttctaaagtttgacatcttagagagtatgttctcagatcataaacatccagtgtagaaatcaaaaatataatatttaataaagctcaaatatttggaaattaacaaaaaataaatcacaagagaaattagaarttatgttaaataaatgacaatgaacataaagcattcctgaattcatgagaaacagctaaagaactgctagaaggaaatctatatttaaaagtttatatgataaaagaagaaaggtgtaaaatcataatttaactttccaaattgataggtagaaaaagaaaatgaaatttaaaaccaaaacaggtcaaatgaataatataataaatagaacagaatcaataaaaacacaaaaaataaaaaggcagaagtttttttggaaaagattaggaaaattgataaacccctaacataagtgatcaataaaaggagaaaagcacaacttaatcattttaaaaattacacaggggatatctatatagatgctatagacttcaagaagataataaggcaatttttaaaactgccaattgccaatgatttgacaatttagatgaattgaacaaattacttgaaaaatacaatatatcaaaaattgaccctccctaaagatattaatacaaaacctatctaaccctatgtctaataaaaaatagccaatacaatgcacgaagaaaactagagactcagatagtttcactaggaaattttatcaagcattttaaagagaattaattttaatctgaagttactttagaaaacagaagaggaagtgcatttccccgatcatttgttgatgccagtataccccaataaaaaacctgacaaaaacattataagaaaataaaattatagaccaatatattttatgagaggatgtcaaaattcttaaccaaacattagtcaattgaatcatccaatatataaaaatgataatatatcataaccaaatggagattaattcacaaatgcaaagctgccttcatattttaaaattcaatttgcataaattgtccccgttaacagaataaaggagaaaatccttatgttcatttcagtaggtttcgaaaagcatatgacaaaatgcaaaaccattttgttataaaaactctctgcaacttaggaatagtaggggacctactgaatctgataaagggtgtccataaaaaaatatgcagttcacatcatactccatagtgaaatattaggtttccctttaaaattcagaacaaagtgaagatgtcagctctcgccatttttagttaaccttggcataaagattgcaaaggaagaagtaagcctgaatgtacttgcaggtaaaatgattgtttatgtgtacgtttctaaagcatgtagtttaaaactactagaattaataaagaaattaagcatggtgggtgctcccgaatcgatgaggaaagccgctctccccggcagatcctcccggccggggcgcctccatcaccctgcctgcgcctcggcacgctggcaaggagcccgggaagagacgccgggagcgacttatgaaaatatgcatcagtttaatactgtcttggaattcatgagatggaagcataggtcaaagctgtttggagaaaatcrgaagtacagttttatctagccacatcttggaggagtcgtaagaaagcagtgggagttgaagtcattgtcaagtgcttgcgatcttttacaagaaaatctcactgaatgacagtcatttaaattggtgaagtagcaagaccaattactaaaggtgacagtacacaggaaacattacaattgaacaatgactcagctatacatttacatcagattattgggagcctatttgttcatcatttctcgtgttcaaggacagaatctggatagtatgctccacggcactgggatgaaatcagactccgaccagaaaaagtcagaaaatggagtaaccttagcaccagaggataccttgccttttttcaagtgctattgctgagggcactgcccagatgatgctattaataacacatgcataactaatggacgttgctttgccatcatagaakaagatgaccagggagaaaccacattagcttcagggtgtatgaaatatgaaggatctgattttcagtgcaaagattctccaaaagccyagctacgccggacaatagaaygttgtcggaccaatttatgtaaccagtatttgcaacccacatgccccctgttgtcataggtccrttttttgatggcagcattcsatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggaaaatcactaaaagaccttattgaccagtcacaaagttctggtagtgggtctggactacctttattggttcagcgaactattgccaaacagattcagatggtccggcaagttggtaaaggccgatatggagaagtacggatgggcaaatggcatggcgaaagagtggcggtgaaagtattctttaccactgaagaagccagctggtttcgagaaacagaaatctaccaaactgtgctaatgcgccatgaaaacatacttggtttcatagcggcagatattaaaggtacaggttcctggactcagctctatttgattactgattaccatgaaaatggatctctctatgacttcctgaaatgtgctacgctggacaccagagccctgcttaaattggcttattcagctgcctgtggtctgtgccacctgcacacagaaayktatggcacccaaggaaagcccgcaattgctcatcgagacctaaagagcaaaaacatcctcatcaagaaaaatgggagttgctgcattgctgayctgggccttgctgttaaattcaacagtgacacaaatgaagttgatgtgcccttgaataccagggtgggcaccaaacgctacctggctccagaagtgctggacgaaagcctgaacaaaaaccacttccagccctacatcatggctgatatctacagcttcggcctaatcatttgggagatggctcgtcgttgtatcacaggagggatcgtggaagactaccaattgccatattataacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcccccagactcacagcgttgagaattaagaagacgcttgccaagatggttgaatcccaagatgtaaaaatctgacggttaaaccatcggaggagaaactctagactgcaagaactgtttttacccatggcatgggtggaattagagtggaataaggatgttaacttggttctcagactctctcttcactacgtgttcacaggctgctaatattaaacctttcagtactcttattaggatacaagctgggaacttctaaacacttcattctttatatatggacaactttattttaaatgtggtttttgatgcctttttttaaatgggtttttatgaactgcatcaagacttcaatcctgattagtgtctccagtcaagctctgggtactgaattgcctgttcataaaacggtgctttctgtgaaagccttaagaagataaatgagtgcagcagagttggagaaatagactttgccttttacctgagacattcagttcgtttgtattccacctttgtaaaacagcctatagatgatgatgtgtttgggatactgcttagtttatgatagtttgtcctgtctccttagtgatgtgtgtgtgtctccatgcacatgcacgccaggattcctctgttgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgttgttattatttttgtcacggaaaacatcctctcctaagttggagcttctattgccatgaaccatgcttacagagaaagcacttcttattgaagtgaattcctgcatttgatagcaatgtaagtgcctataaccatgttctgtattctttattctcagtaacttttaaaagggaagttatttaaaaaaaaaaaaagaaattaaggatggctatagggcataaagtcaatattcaaaattctttaacaattacattaaataattggaaaattatttaaaaattttttttacagtcatgcaaagcaaaattctaaagattaatttaacaaaagacatgcaagatctctgtactggaacactgacatgaataaagaagatagaaataaatggagagatatgctatgttcattggttaaatgattcaatattattatgatgttattttcctcaatacttgtttgcttttaaagtttaatttcctttttgacaaaattgtatatatttatcatgtgtgacatgatattttgaatatcattgtatatatatattatatatatacaaattgtgaaatggttatatcaagctaattaacatattacctaacataattatcaatttttttggtgagaacacttaaaatctactctcagcattttttaagagtaaatacattgttattaactacagtcaccatgctgtacaataaatatcttcaatgtattcctactatctaactgaaattttatattctttgaccaacatctcctcaagmtccattttccatatttgtatatagagtctaagcaataatcctaatattttctgtaattgacaagttgattctaaaattgtatagaaacacacacaaaaaagcccctactatagacaatcttgaaaataaaaaataaagttggtacattatattacctaaattctagacttactaaagcaatgaagatagtatggtattagcacgcagagggaaaaatagatgctaggaaaaatagataactgaggttctagaaattgatccatgtaatatgatcaattgatttttcaacaaatggtgctagaacttcaggttaaccatataaatctggttacttattcacaccacacacaaacatttacttgatatgggtaatagctctataagttaaaattttggtttttaggataaaaaaatatttagactttgaacatctacttcataagagaagatacaggaatggtcaataagcccttacgattaaaattaaatccataatcagatgccatttcacacccactagatgactaaaatccaaaaagatagtcaacatcaaatattagagatgatatagaatgactgaaactcatataactttttggtgaacattttatacattattactaatttggcaaaatgttgacggtttcttataaagttaagcatctacctatcctatgaaaaaagctttctattcctaagtatttacacaaggtaaataaaaatatgactataaaataactagtataaaattatttgtaggagctaagctaaaactggaaatgatcctaatttctatcaacaggagaatggatttaaaattttgatatgttcgtgcagagaaatactactcagcaatttctttcaaaagaaaaagaactactgatgcacaaacaacatggataaatcttaacatattatgtcgagtgaaaaaagactcactagtatgtactgtatgatttcatttttatgaaattctctaagaggcacaactaatttacgttctaaaaatcagaacagagtttgcctaggggtccactccttgactggaaggagccatgataaaactttctggagtgatggaaaagttttatcttacatcctcaaagatttaggtcagtttcaactacgaaatgttcctacttaccttttaatttgaagttcaactgtttacagaagctttcaaaattmttatttttttgtataaaacatttttgtatgaaaaagcaaaaaaataactctttatgaaagaaaaagcatactttacccctttgggtctgaagaagccatcagtacatgtctcgcagtttataccagcagtgttttgggtacaattaatgcagacaccccctccaatgtactttccacgtatattcaaactcagatttcttctggcaacattttcatcataatagcattcttcagcttttccatgacaattgcatgctgcattaaggaaaaataaattaataaacatcaatttgatttcagatacatttaaaaatcatttctgttatacataatagattttttttttgagacagagtctcactctgtcgcccaggctggagtgcagagtggcacgatctcggctcactgcaacctctgccttccaggttcaagcaatcctcctgtctcagcctcccgagtagctggggacaacaggcatgcaccaccacacccagctaatttctgtatttttagtagagatggggcttcaccatgttggccaggctggtcttgaactcttgacccatgatccacccgcctcagcctctcaaagtgctggaattacaggcgtgagccactgcccccggcctagacttttataccatacgggaaattacatttagcgtacacacacacaaacatatccagaaagtatctggatgtattggaggtattaataaattcacacattttaatagaatttgaaatgattaaaacatataaattaagctcaatcatatgcaattgccaatatttggttttgactaacgtgcaattttatatggttcaacttacaatttcctattataacaaataataaattattcaatgatggcactgaatgattaacagctaggtaatctgtaatgaattactaccatatggaaatttctgtattagagcctgtgggtaaagaaaartatgtataatataattcctttcttttaatactaataacaactaaaacataggttttctcaatgccagacactgttctaaatgctccatatttgttgctactgattttaatcctcaaaaatgcttttaggaattaggtattattattattaacctatttttgtatactagaaacctgagtccagagaagtgaaataacgtgtaaaagatattctaatcagtattggaaaccaacctctgaagccagactccagagtctgcactgctaaagactgccagaatctcttcacatcctacccggtgaatgaaataagatacatggcaggtgccaaggaattaagacaaaccgagagctagtttactggtggctaagatcatgctattttgcaaccaactgtcttggatgtgggtgtgctctcctctacttagcagtcatatgacattggaaacttcttaatttcacgaaggctcagtttccatataatacatggagtggtcaatagtaattactagattgggatatttaaaagcacaagtgagataatgcatgtgaaatcattagcgtaatgtcttataaagaagttagcaattgatttttcttcttttcttcctccttgtctttttcatgttacattagaagaattccaagaagtgaaaaatcactttctccagaaaggattgggtaagactcttctaaatatgaagaatttatattaggatagaaccagggaaatatatcgatgcagtctccttcctacctgacatgttgagtttcttaggagtacttacatttatttccacgtgtgtgtgtgtgtgtgtaggtgtgcttgtatgcatacagctcaatctttttatttattctacaaaagggaaggggcatttgtatactgtttagaaccggttctttttactaacagtaaatcatggagccctttccatattagcatgtgtatcccctaagggtacacagggtactacttgaatgaaggtatttatcaggtccctattaatgaacagttacacagtttccatgtttctccctttacaaataacaccacacacatactgggaggacaaggatgccgggtggagggaggcgctctaatgttagaaaagtttcctatttgccagttgagtgactttgaggcaaaaactcgagtcctagcatcactttagtacttgtctcatacatgttttgagaatgcttagcagaatgcctgaaacatactaaatactgagctcaataaatgttagtagcagtagtggtagcacttgtataataatgacgaggatcatgataatatgcctgtacatctatatgaatatatctatagggtaaattcctggaagcataatttctagtcaaaggatatgtaaaatttaaattttaatcgcttaaaaaattcccctccaggaacgctatgacaaatgacttttcctctagtagatatgataaaacactttctccatagccaccaaccttgtgtgttatcaacccttgaatacaattcctggacataataagcattcaaatatttgttgagtagaagaataaacactttgataggtgaaaaataatatgtcattgttttaattgatacttccttcattatgagtgtcattatctttttacaaagttatatgtcatttctgaggaatacctgttttgatctttctaacaggttaacttttttcttattgatatgtaagatctcttaatatagaaaggttattatccccttgtcatgtttgttgtaaatacctttcccaacctgctgacatttgatttagaatatagtagttttgctatgttaatggagagtttcaaactttagggaacacatagtaatcaatacaaatcactaggcaytgtaagcagttttatatctttagggcaacatacaagaattccttttttttcttcwgaaagacagtgatatggtttggctctgtgtccccacccaaatctcatttgaaattgtaatctccacgtatggagggagggaggagactggatcaagggggcagctcccccatgctgtcctcatgatagtgagtgagttcktacaagatctgatggttttataaggggctcttccccattcactttctcctctctctcctgtaccatgtaagatgtgcctgctccctcttcccctttgatcataagtttcctgaggcctcctagccatgcavaagggtgagtcaactaaacctctttcctttataaattacccagtctcgggtagtatctttacagcagtgtgaaaacggagtgatacasacagggtctcactatgtggcccaggctggcctcaaactcctgggctcaagagatcctcccaccatagcttctttccagtagctgggattataggagcatgccactggacctggctatgaattcttaaaagctttgttgtaatagtgtatttcaaaaaacagtcaaaacttctgctgccagtataagcagaggaaaacataaagtaacatagacttattctcacactatttagaattcgtgttgtcaagagtgtttagaactatgagctactatatgtaaaaccctgatgccaaataaacggtccatcacacactctgtgcagccaggaccctacacctacagccccactttctgtctgyaggctgcagcctaccccgctctgtctgtaaccttcaagaatayggctagtaactgatcacaaagccatgttttttctctatcatcagcaacttactatttcacagaatgtccaagatatatcatatgaaactgttgtttagtaaaggctcagcaactgaatgaatattctatgctttttagagatattatcttgccttatgtaagctagattgatgaaaatccaaattaaactcaaatgaattagaatgtgattattcattttatggagggatttgtcatgtcatggaaggatttttctaaatattaaggtgattggaatatgattcaacttggaaaagaaaatttttacttaagctttcaggaatgtactcattgctgaaagtgtgatttttatgtatggctttatggctaagatccccatcttgaatttctgcgtttttaaaatgtttgtttttcagtttggaaatacgacctcccctcttccctacagggaaagaaaaaaagtgtttcacaattccactattttaaaaatgtgtacagtagcagtttgaaatgtcttgccttgcttagtctacctctattgctaacaagttgctcgattgtttttgttttgtatttaaacgtag

SEQ ID NO: 13438 - DNA, 21254 bp, Homo sapiens
ccaaggcgggcagattaccttaggtcgggagttcaagaccagcctgaccaacatggagaaaccccgtctgtactaaaaatacaaaattagtcggacgtggtggtgcatgcctgtaatcccagctactcgggaggctgaggcaggagaatcacttgaacccaggaggcggaggttgcggtgagccgaaatcatgccattgcactccagcctgggcaagaagagygaaaaactccatcaaaaaaaaaaaatgcagatcctcagcccccatacactagacattctgattcatcaggtctagagtagggcctggtctctgtggctttaacaggcttcctaaaaattctacgcacaccacttttacaaaccactgggataagatatttgggaagacttacgtgtaccttttagagctgtggaatgcttaacatggacatagaagaagaaaatatttaaaaacacagaaaaccctaatcctttcctcccctggatcctcagttacacagggagccgctctgcctccaacatggcgatcgttgatgtgaagatggtctctggcttcattcccctgaagccaacagtgaaaatggtaggtttatcataaccccagactgccctattttatttaatgatgtatgtatccccagcataagacaatactaatatcaaaatactattaaagtcaatctctatcaaagccttatcctttttccagctcagaaatayaatcacatgtgtttgtatgaatgctgaccatgtgcagagcactgygctaggacccatgactacaagaaaaagattgtcagcaggttcctgcttttcaatttcttcttagcttagaattttgctaagaagataaaagatatgaacacgaaccagtgaaaaatatgaaaatgactgattggcataaactataagtattacagaagttaaaagaaaaatagagcaagcaaaacaggaaaaaaactccttatgaagaaatagaaactgaattgaactttgaaatatgagtaactaccaagtttaggatacttagctgtcttttcttcagataaataactttacacattagtcgtgtgttatactaatagtaaaccctttatgcctttcatttttaattgtattacattatatatttccttacaaaaagcatttgaagaattctaccctcagggttattttggcaatacaaagattttttctctggatcccccaggggtttcatctatttattaacatttgtggtatttcaattttcttcagcttgaaagatctaaccatgtgagccggacagaagtcagcagcaaccatgtcttgatttaccttgataaggtaagagaacttccagtctatttgcaaaaaaacgtagataataatcctctaaggraacatctgggaaggtaaatgcattttagaaacatcacttccatgctagaaatttgagaattctaatgttaactctaaaagaatgttcttctctcctttatttatatttcaccagggattacaggtagaaatggcttattatgatcttgggatatgaatattcctaaaatcccataagcaagaratcttsacaaaatgtgtttattatgttgacaagttttttggatacccagtaatayaaggaagtagcccttgtgattagtcaattattagttaattatcaacatactcaacaacaatatgaaagggaaaaaaaactgtcagtctccacaaggacttgaaccataaaataataagaccagttcaccagtaaaccaatctgattttatagatatgtgtggtaggagagtttgttcatgcataagttgatgggaattatagtttacaaattttatgaaacttaagcctgggaagatcaaccttttagahcctctttgagtctacgcaagtattcctgcaagacagagaagtcaaactataccaaatctctggatattaaaaaatgaacacagttagtcrtccaataaaaagtatatatcatttacccccatgaacagagctatgtattggcattgacagaggtatatgcrttatgttagttatttaagaaataatctggagaatttatcatcccctctgagagatttctgcacaatttaattaaggaccctatagtgtgctgtaggataataaagcttttcccccaaaaaacaggtgaatacttaaactaattcaaagagagaagaaagcttcctgaaaggtcatttaattgacttttgctttccaggtgtcaaatcagacactgagcttgttcytcacggttctgcaagatgtcccagtaagagatctgaaaccagccatagtgaaagtctatgattactacgagacgggtgagtgagagtgattttcacgtagaaatatttaattcctgatcacagaaattcaggtttaggagatgtgttggggttatttattacattaagtaattacattatcacttcattttgtctccatcaagtctgatgcycctctttttgtctcttatacatacattatagaaacaacctacattataaatttatcaactactaatacaaaacacctgtgggatatttagttcccttttcatcagataaatggactgtatgacaatatgagatttaagtaagtagaacatctgaagagtccttcaggagtttgggataaaagaatatataaaacactatatttgaaaggagaatataaggtagcaagcaacacatcagatgaatgatgcttatgtttctggtacaatactgttcttcccacaacaaactccttccttggcctgtatcccacagatgtttgctttctttctcacttcatgtaatgatttctggttttttgttggttttttttttttcagatgagtttgcaattgctgagtacaatgctccttgcagcaaaggtaagccactcacactcctccaaaaggcagtcagagctccttcagcttgycccccaaaccttctccttcataaaacgctgggtaaatatttgtcaaaaacatcaaattactcacactgcacattattatagaaaaacacatttattggagagggccgctgactctgtcaaacctcagagagtccataggattgcttatgggtaatgatttggaatagatttggtttcccwctgtactgattaggtttccttgggcactatgctacccagaactaaggsaaagaatactctctgctcatggagacccaaatctgtcttaattttttttctttccaatgtcacagatcttggaaatgcttgaagaccacaaggctgaaaagtgctttgctggagtcctgttytcwgagctccmcagaagacacgtgtttttgtatctttaaagacttgatgaataaacactttttctggtcaatgtctttccctgtttcctgttcattcaataaatatcattgtacatttccatatgattcccaatagaataccaagattaaacttaaaggaatcaagtgctgaaggacttcagaatacaaaaaaatgatacagtgatgtcggtctgagtaggcttcatgtaaggactgtggggaaagaagaaagtattgggttatgtactaggaaagtgyaaagtgtgtttggttatgggaataccctatgaaaaacccaaagggtgaatttttatgagaaaataaaagactgacttcaccagaaaagactttttacattaaaatgaagtagaatgaaatacaacattgaacakgtcatattgagaggcaagataattgggacttgacctgaattgggagtgatgtgtcctatgttacamcaaaatctgccactgatgagagtgatcagtcagttaacctggggtttcagattcaataatagatgagctgaaaataatgaagggaggattcatgcagaagcacgttttctcagaagaaggaatgtgtatgactcaaagtccaaataggagtattatattggatcatctttyttctggaactttgagccaggattaaaggatagctgtaaagtcaaggagatattctgatgcagaaatcagttctcacaacatctgattgatgtctgatgtctcacaacatctctttagtctatttttaaaatatataattttctttgcagtaagtattgcgacatatatttccattctatagaaggggaagcaaaacttcaggagtttttgaagtaggaaaggttaaagcaggaggattgagccaagagagtctgaggacaatcgtaggagtcctactcttcatttggcacaaaaatgacaatgcttagttaggcagaaggtgagtatggattgtataaactaagaactggaaaagactttgcagttcaaggaatccttagctctgtctccaggctagacaaaataagaaataaaagctatcacttctgtgtggtgcttatagaatagaattaacatatcagcattatgggatctttagggtgtcgctttcctggccagtctagtggcacctttgcctgagttttgctctgggcccactgggctgcttctgcccactcgcacttgctaccaacctggatcccggatccaagggagattgagacgggtggagcagaggggtgtgctaggggtgtgtgagcaagcgtggccactgtgcagtcacacacacaagctgctgcccaggttgggcagctccaggtgccagcacaggctctccatgaggtggctggaccaggcacacaacaaacagcttccccctggaccaggcgcatcacaagcagcttccaacagtggcactggcgaatgcagtgacgccaaccagggmcccaaagagggagtcacagcccgggctcaaggagctcccaggtctgggcttctccgagggccagagctcttctctccctgtggggagcaaggggcatgttgcagccctgtttgtgttacagctcttttaaccttgctgtgcagctcctcagctcctgcatcaagcagacaagtggagaatgagmcagatgaagaggagcattactgagcaatggaacagaaggataaggaagatgaagaggaaggagacctgcagttagtagctcatttccacagtaaggatgtyctttccacagcaagkgtgtcccaacgagtgttcagcttctagcagaamggagaccctggagtggctggctcctctctgcaaacaggtcttcccattgagtgttcagctttcagcagagaggaggttctggaatgggtagtttctctccacaggtaggtcatccattgtcttcccatcctctcttccaatctagctgagtctgggggattttatgagcctcagagggaggaaatgcatgctgattggtccatgggcagccatgagtgggcccagggagcagcaccacaagttacctctctggtctgcaggcttcaagccctcaccagcttsagggtgggacttcactggggacccatccccttccacccaggaacctgtctgcctcctgctcccaggctgttcatgccaaggagcgcctgmaagtcagtgtccagctgtcttcagacccctctcagcctccctcccacgcttgttggtgcccaagttccaaagggggccgagacggcagggggctggcgtatcagcactgtcctgagcgtgtgcacgctcggccaggctgtgacagtacccaggctcggcccgaccttgctctgagttcagagtgggtgctaacagtggagrgaagccaggcagccggagtaggcaccctggagcctgcagtgggcaggggactttgctgggcctctgagagcacagaaaatgtccacagccgcggcaaggtggctgcagctgcaccctgggagctcctgctccaccagttcggaaggggcggggctcctgcttgtccctggctcacctgctcctgagtgtgcaggtccggtggcgcctccttgcaggctgggctgatgggcgggggcgggggsgsgggggaggaagggaatgttccaggtcctccctgggcccgggactgtgtccggggcagggatgacgtcgctgcaagttcttcccgtggccccggggctcaggggcagcccaggactctccctcgcccggctcacggccctgcctggggggcgcctccgggagcagatcacgagccctggggctcagccctcaggcgcgtctagctcggcggtcaccccagtgccgggaggaccctgaagacgcgccccaggcggccctactcagagcctcctcccaaggcccaggaatgcggcgctgtcggaggtgtgcgcggtggccacaccgctgtccgggtccccaaagcgggccccgctcccacttctcgccttggccccgaaccctgggtccagccccagcgctttgtgtgcgaacaccgctccgccccggacccagctccgccttggggcccctctctgcctgcccctccgtgcccgactacactgcttcccctccggcgggcgactcagcccggtccatcgtggcggcttccagggcggcaggctccgggagtactcccggggccggctccaaggactgttcccctcctccccactcccactccgcggcggcggcgggcgagagcggcgacatagggccagggtccggagcggtggaggctcctggccggggagcacgtcgccccacccggcaacgcgaggatggtggcggcgcagtcggctgctttggggtctcaaggcacaggggacgcgaggcacagatgtcccacagcagccactgcggctcccgcagctgctccgccgccgctgcccgcccctccctgctgcagctggcgtgatggcagcggcagctctggacgccccactgctgccaccatcagccttgtgaaataggtactaccttaacaaatgaaattgaagcagagacatgtaatttgcccaaagttactaagttagtgacaaagctagaattcaagaccaagaagtctagcttccatgctcttaacttccaaccatggtgacacctcaaacaacttcagacaaaaaggccaggagaaagtatatttcagagcttaataaacattataattagctgtcaaattaagtatcaagccagggcacagaacataaaagaaatcagagtatggctatgggaacaagacaacaggattataattttacctcttggttctagtttttttctttgttcatatggaaatcgttactgaaaaggtactttaaggatatgcttgttgcaaatcattagctgtatcactgaccaagagtgtttattcctgaaatactaactgattgcctactatctgccaggcacaatatcccatgctataatacaaaattaaacaaaataggattcctcccttagaaaaactcaccgcagagtaaaagaaaaagatacacatctgggtcattataatgatcaggtgctcaagctattcattgccccagtggactggagatacaatggccttctcaagttttggggtattacactcaaattcatatgtaatactggagaaaaggcctaattacaactwaaactggatttcccaccagcctggtggcatgggaatcttggaattaaaattacgtagaatttttaaaagtgatgtatcttctacatctgattttgtgaactgaagtttattctttccaggaaagcatatagatacacgacaggaaatgaaatggatacttgttggggtcagttttatgtatagtttgtattttattttgaaatatgatacactgctattctcttgcattttcttatatgtgactcaccactaaccctatattcccccatttcaggccagttggtcataagcatccatttgcctcagagaatactgggttgttatgacaagaatataaagttggaaagaaatagaatatttgagtctaccctgtaagaataaaaagaataaaaggggtttaaatttatttagaccctattgtttaatcaagaattctggccaggagcagtggttcatgcctataatcccaatgctttaggaggccaaggcaggaggatcatttgaggccaagagtttgagaccagcctgggcaaattattgctcgggaaaaaaaggtcttatttagtattttagtctttacaatgtttttttctattatgcaatattctctcaaatactttatgtccatccacgttgtctgagacatgccactttaacattctagttaygctgtagctgtcattttaccctaagccgttagtagtactgatccacataaaattgggctgtttaggtgtttaactgtttaaatgtataatatatctgatatatttatatattgtataaaaaatcacctaacacaatagatatttactatgtctgctataaatatatatcatataacatataacaatatattataaatgataatatactataatataaaatataataaatatattataaatgtacaatatatccgatataaatatataaatatgtcaactatattatacatataaatgtatatgtataatatatacatatatgtataatacaatgtatttattatgtatatatataaatgtatatgtataatatataaatgtataatatatctgatataaacatatcagatatattatccatctattgtgtcaggtgattctttatacaatatataaatatatcagatatattatccatctattgtgtcaggtgattttttatacaatatataaatatatcagatacattatccatctattgtgtcaggtgattttttatacaatatataaatatatcagatatattatccatctattgtgtcaggtgattttttatacaatatataaatatatcagatatattacayatctattgtgtcaggtgatttcttatacgatatataaatatatcagatatattatccatctattgtgtcaggtgattttttatacactatataaatatatcagatatactatacagttcagcccatcaaagcaccatattttggggggttggtttccgtgtcccaacactagctacgaaaatattagctattagctacctataactcttcagtagtaaattcaagaaacgtaaagtaattctcttcattaagttcttgccttgtctactaaaaaaatggtcatcaccgatgtggacaatgaagacctgtggggttaaaagctctaactagtatgcctccaagattctttgattgcctgccatcatgatcgaagaataaataacttctttttcatcttatttatttattttttgtagagatagggtctcgctatgctgcccaggctggtctcaaactcctgggctcaagagatccttctacytaagcctctcaaagtgctggaattacaggggtgagtcaccacgactgaccattaataatttctttcaatgacactttaacataggctcattcatctttacctctaaagaaaagtctttctggtctttttaaaattatattttttggccaggcacaatggccaggtgcggtggctgacacctgtaatcctagcactttgggaggccaaggtaggaagattgcttgaggccaggagtgcaagaccaacctggcaaacatctggaaaacatagcaaggccccatctctattaaaaaaaaattaattctatttttctaagagaaaaaagattcccaattcaacaacacttttcaaaaactttatctggcagctactcaggagattgagatgggaggatcatatgaagcccaggaattcaaaaccagtgtgggcaacatagtgagatcctatctcataaaaaaataaaaaataaaaaaagctttacttggaatacaacccatgactctggttataaatacaaaattcttcaaattcatttaaaggaatttaatcctagcttctcggatgaaaaaaggaaataatattcacaatttgatccatcatcagtagacaagttaaatgtgtttcacaaaagcaagacatattaattaagcaaaatcatattcgagtaaccacaggaaatataaatatactgtctcttacctagagaaatcttatagtctaattgtgaagatagtcttcacgtgacgaaaaagatcatcattaatccaaaacatataagttataaagaagcgacatataccagcaattctaaaatctggttagcatcctttgtagaatttattttaaaatgcagatatccaggtctcatcaataaagatttaattaattatttttggggatgtgctcagacatctgcgttttttgttttttgttttcgtttttttgttttttgagatggagtctcactctgttgcccaggctggagtgcaatggcgcaatctcagctcactgcaacctctgctcccaggttcaagcaattcttctgcctcagcctccctaggagctggaactataggcgcccaccaccacgttgggctaacaggcatctatgtttttaatgaactctgtaggtggttctatcatgcagttagttttcagaaccattcacactgacagtaaaggctatttattcccagcagttgaaagaccactaaggacacaggaatrgttagcaaagctacttaaagatgccagggctggggccgggtgcgatggctcacgcctgtaatcccagcactttgggaggccaaggtgggcagatcatgaggtcaggagatcgagaccatcctggctaacacaatgaagccccgtctctacaaacaaacaaacaaacaaacaaaatacaaaaaattagccggatgtggtggcrggcacctgtagtcccaactactcgggaggctgaggcagcagaatggcktgaacccaggaggcggagcttgcagtgagccgagatcacgccactgcactccagcctgggcgacagagcgaaactccatctcaaaaaaaaaaaaaaaaaaaaaaaaaaagatgccagggctggctgggcacagtggctcacacctgtaaccccaacactttggtttgggaggccaaggcggatggattgcttgagttcaggggttcaagaccagcccaggaaacatggcaaaacctcatctctaccaaaaacacaaaaattagccgggcatagtggcatgcacctgtggtcccagctactcaggaggctgaggtgggaggatagctggagcctgggaagctgcagtgatcagtgatcatgtcaccacactccagcctcggtgacagagcaagaacctgtctcaacatacatacatgcatatataaaattaaacataaaaacaaaaataaataaagatgtcagggcttatgttgaaccttaactgagagcaagattcaaaagacactgaggcttatttttctttcttatatctatagttacacagggagctgtctartcttggatgtatccaagttgatatctggttttatccattgaaacccacagtgaaaatggtaaataggtgctaggtgtttggatttttttaatccaatgtaagaataaaacaatggtatcctaataatgtcaaagcaacattggtcataatctaaggaaattgaattcatatagtaccaaatatatatttagcattgtgctaggtgctgatacattctagataaaaatattacacatgggtaaccaaaactgtcaaatgacatttcagggcaagatataattaagtaccaaaatcattggcatagtctttaagtactgtgaaatgtagagaaagctgagatgaatggcagtgtagagacagatggctttgcaaatcatctcagatgactagctatccaatgtgaggacacttctccctcaccttcaaacaaatgctaaagacgcctgttacttaatcatatgaatattcaatcttgtatctaatgtggtggtattcataatactctgtatatgttttcatcttactggacaagtgtcttcgaactcatttaaatgaatttaaccccagctttgtttatgtatagacttcttcaatctcatagtctatttgtctctttgtaccccacaggctttctttattcagtaacactggtgatttctcttattttccttagcttgaaagatctagccacgtgagcaggacagaagtgcacaacaaccatatcttgatttctgtggaccaggtggggcccctgccagccttgctagacagacccaggtgaacagtccttctaggggatctcatcaccaggcaagcacgtggtacgagaagagcagtcattaggaaggccatttggaaaagcacatcctctctgttcacgtgagatattttacatcctcattcctcatcgcaagcttcctgggatttggagtgtcacagacaagagggttgggggaggccagtaggtatggatttgtttatattaaaatgagcatatgaatatttatatgtttatattaaaacatatatgtttgtttatattacaatgagcatatgaatatttatatgtttatattaaaacatatatgtttgtttatattaaaatgagcatatgaatatttctgtatacttcagataaacattcttttccataaataagcttcatcatccagaagccatgttgaaagttggtaatcaaggataggaagtgtttccaagggttgtcagtgattaaatcaaccttaccttagcatacatgtatgagagaagttagataaattatacatagagagatagctagatagataatagataaataaggtagatgacagattagatacagatgataaacagatatgctatcagtctagatctattactcacagtcagtygtatcacagtgtaattccatcaacttcatttgcagcaaaagaacagcccctgatgtacgcctgtttcctgaatatttggaaatattaatattaatatagatagagtcagcttgccagtataaagaatctatctctcactataggcagagccatgtgttggatattatggaggaatatgtattattttaatcgtttaaaagactaataaacttctaatctacttttgggagcctctgctcaagttcctgaggttcctactctaaaatccacatcaccctccaactgctccctatgtgagccattagggagcacaatgaattagagaatgaatcctattagcccactaaaaaattatctttcaaaggatgaagactgatgctaaggaaaaagagatgaggcctccctggttccgcattattactccttcctttcttgggttacggattgaacactgaccttttctttcactcttctgcaagacaaccccataagaaagctgaaacctgcttttgtgaaagcctatgattactataagacaggtgagcaaaacagaatmctagataaactcagttctttccagtgtggtgtctttgatggaaaaataaaataaaagccaatgtgtttggggtttttttcttttttactttatatagatttagggggtacaagtatggttttgttacatggctacattgcacagtggtgaagtctgggctttgagtgtagccatcacccaattagagtacattgtacccattaagtgatttcccatccctcttgccctgtcaccctcccacccttctgagtctccagtatctgttatcccactctctatgtccatgtgtacaaattatttagctcccacttataagtgagaatgtgaagtatttgacctcctgtttctgagttatttcacttgagatagtagcaacawgggtggaagtggaggccaaacctcaattcttaaagsaataaaagtgtggtaaacccttgtacatcttgttttcagtttaayctgtctccataacttattttttcttccttggcctacaaaactactgccaaaactacctgtaatatacatgtatattgatatgtaagcctatcagtcgtgcaaaataatccaaagtaccaagagttttacgtagaagtgcttataaataaaggcatacataaatcttaaaaagataatatagcaatgcaaagaaataaagaagagcctaagaactatacaaataattatagtaggaactaagagaggggtgagaactatagcgttgagtggtctttaaacagcaaatgaagaggctgggcacagtggcttatgcctataatcccagcagtttgggaggccatggcagaatgatctcttaaagctagaagtttgagaccagcctgggcaactaagtgagagcccatctctacaaaaaattgaaaaataaaatcagccagcatgctggtacacacctgtagtagtcccagctactcaggaggctgaggcaggacgatcattggaacccaggagtttgaggctgcagtgagtgaaagagtgagaccccatccctaaaatacacacacacacacacacacacacmccccaagtaaaatttcagctggaatataaatcgtgggtattatactgatttatggagagaaktatgctaagtctttcagatgaggaaaacatataagaaatatcatgcaagaaaaaagaagcaaatatggaacaagaactgaaagaacacatacccgcgtgatcccccctagtactttgcttgaacactgtagcatgagcaggctttgattttccaccagagtaacggattatactaatggtatcaagagtggaaattccttgaccatgtctatatatttccccagtgagctgacatttttgtgatcacgcaggccctgattcagtatggtttgcagtccttaaataggtcaaagcctctccacatagccctgtccygttgaagctcccattctcaagcttttctcccattgtgtgtttcagatgaagcaaatttgctgaatacagtgtcccctgcagccgataggcagtttgctctacatatcccaagccttcattttgctctcaaaagcagtyctcctaaatacaaaatcatctacatcttttattagttgatatcagatttatcatactgcaaggtaacgcagaactatacagctttggagaggaacactaacttcctggaaggtttcctgattttcttatcagaagagtgtaaatgaaattaccctgtgattagggtagatatctgatggattccattctcagccataaccagtttggtctcctttagcaaagccctgctgctgtccatatccaattagaattaaattcactccttggcaagcccgaagtcatcctgttcgctttcctcttctctccacaggcacagagcaagaaaatgtttgaggcttgtgtctataaacaagacttggctggaatccccagacccacgactttttaaaaggatattttgtccctgcaatacagatactgaatgaggttggcaaataaatatgtatttctagagactctataattgattccttcttcatttaatgcaaatttactccatgcgcacttactgcttttyattgtaccctgtatttgcaataaacaaataatggcatccaaattgaggtaagagcacctagcataaatttaggaacaattcacaacagcctcactactgcagaacctcagaatatgcaaagcaatgtaatggcaatctgggaaagtttcactccaagaaaaaacttctaaactgaagattagtgacaagagtgtagagtatatctgagtggaaacattttttgcaaaagcagaagaaatggtttattttagcaccaggtaaaatgactggcctgtctagatagaagctccgtattgcagaaaggtgaaaatttatcaatcaatcaattaattaataagttwtgtttaggtgggagtcataatattacgacaatttcatggaattagaaatgcttaacttctggtccaaaatctgccactgaccatttgtatgactttgggttgaaaaacatctggatatcagttttatgtgtgtgacagaatcacgtgttattggagaagtataaataagtacaggtggcgtatcccttatccaaaatacttgggaccagaagtgttttgaattttgaattttttagatttgaaatatttgaagtatgcttaccagttgagtatccctaatccaaaaactggaaacccagaatgttccagtgagtatttcctcctagcatcacttcagcacttgaaaagtttcagattttggaacactttggatgtcagatttttggattagagatgctcaacctgtatagtagatcctctcttaacaccattgataggttcttagaaactgcaactttaaatgacatgacatagaacaaaaccaattttaccctaggctaatcaatataaccaaggaataagatctagtgttcagtagcaaaatagagcaactatagtaaacagtaatttactctccatttaaaaataactagaatagtagaattgtgttaggaaagctcctaacacaaataaataataaacgtttaatgtgatgaatatcccaattataagtgatcattacacgttgtatgcttgtataaaaatacatgtaccctataaatacatgcaactattatgtatccataaaaattaaagattaaagaagtccatgaactattatttttcataaagagtcataggaaaatttgcctttttaaaattttgcacataaccttggtaataaaaattatatttaaattttaaaaataaaatgagctgtttctacagcatatatctgatcacagaaacatcaccaaacttctaaatgaagacccaaaacatttctaatattgaacattgaaataaacatgataaataaataaaaacaaggcgactccccaatttatggtgaatcactgagtgacagcattcatagtgttacatgaccaacagattcgtatgaccagtgcacaataacagaccagttacactgagacagcagggtttgtagcagagaaagggtttaacgttcacagagcaccaagtgaggagatgtgaggggaccctcaaattcacctccctgaagagttctgggctggggcttttaaggggatcatggagggtgaggagctggagaattgggaccattgattggctggggtaaggagaatgaattcatcaggacatggaaactgcattctttggtgagtcagctcctatggggtccttcagaccagttgatgtcagtagtttcattagtatgcagcacctgaaaggatatctcaaatggaaaactttgcattttataatgttcaagttgttatctgtagagcagttaaggggaactacgatctagggtctgtgtgattctagggcaacaggcagcaaacaactaggaggaagcaggtccgagcacaggctgacctagtgcttaatgctgagtgtgctgcaagctgggtttattttcatttctccccctcccttcttccctgattaattttataaagtttatagggatggtttccktagtggtgatgggttaaatcaaggaagaaatgtttacaaaccaaagttttggtaggaagtagcacctcctaccagcatgcagttcaacaacaaatgagaacaaatgtggtggggtcgcgagcattttcatcmtgcatcatttattgccatgtatctgtatgattatcatctacttcacagggtagacatctgatggatcccattcttagccattaatttcacaaattattgtgaaattatgtattcattctttgtttctttttccaagctgtgtattctagttcagggtcacaggtggtcacagcctttcctggtagctcagggccaaggtgggaacaaccctgcacaggacaccccgtcgcaggcacactcacacccacactcacactcagactaggaccatttagatgtgccaacgaacctaatgtgcatatctctgggatttgcaaggaacccgaagtgcccagaggaaacccacacagacatggggagaatacgcaaactccacacagacaggtggccctggccattgtctcatcaacattataacaaaacgaggttgaacaggaacaatcttattggaggacctgctgtacaggaacaagttttctaaggagattwaaaaaatgtagaagcacaaaagagatagaagggttaattttttaaaaggcaatactgagtatctaccatctgcctggcactgctttaagcatttttctggtattaggtaattttatcctcacaatcacattatgatgtagatactattattaatcccatttttaaatgaaaaacagaagtttggagaagttcagaaactttcccaagctccaagtgaaaaatgaggcaagattttaacctaagcattccagctccagagtccatacccttaactacttctcagtgctactcagctgtgaggaaggagacggctgtctcttcttttgagatatcagatgatggtgggaggctgaatgcagaaggacrgatgtgttcaaaagaagagaaagtatgtaaaagcaaagcagaaaaaagaaaaatggggcaaagaaaacaggaaaggcatctgtgagacccttgggtgagttcatgtctgagacctgttggcatcagcatggcgtgattgtccgyttcttgtgtgaggcatgtggcactggtagactgtgaccagtgctgctcacgatttgaatttgcccttcccaaagtcagactatgctgagggaggagaaaaggtaacacctacaaaacttctkgcttagagtctctttatttaaagattatgtggccctaccttctttcttcccagagtagagaaagaaaagagcctctcagtgtcctcgaaagagccaatagacttataattggataatacaatggagtccaagattatgaataatccactatcctgtatttaataaaagggtcagagaatctccatcctcagaattggatccagccatgcctgcagacgctcttayataaggcacatgagattcctgttgtaaatctcaatcacaagagagctgcatcagctggggcccagatttgcagggctccccaacaaatggacacaatagagaatgccaccttcgtgcatagtgctgtatttggtgggaaacgaaggaacagagaacatcctgttgattggtctctgactcttaatactctgatatttttgtckaattgcaatgaaaagatctaagtaaggcttaggacagaaaacagagcagttctcaattggggcctatgctaaaagagttagacatggtttaatgttgaaaagtcaggacagtgttgatggcagtgataaaaagtgaggctagagaaatcagttgagactcatttatcaagcgtgttaacagaagttttcatgtkattttataagtaatggtcttaggggatttttgggggtgttgattttcccgtatgcagacaagtgaagggtgaacaagacaaagatgagctatactaagcgttagaacagctcagaggagacctgcagtggctagctctctgtagacaggttgtcctgacgtctgccatcaacagacaggaagcgtggagaggattgctcctctccgcagctggcctcctggaaagggttgctcgcctctgcaggtctctgaatctctcagcagagagggtagttcctctctgcagctggtcttcccattgtgtcatctctgtagacaggtcatcctgacatctgctgtcagcagagaggaagccctggagggggctgctcctctctgcagctggcctcttggaaagagttactcctctctgcagctggtaatcccgtctctggaagtctctgaagctctgagcagagagggtggttcctttctgcagctggtcttcccattgagtcctctctccgttctctccatcctatcttgttctggctgagcccagggcttttatggacctcggaggggaggaagtgtgtgccgattggtccatgggcaccatgggtgggcaggaagaggcactacaagtccccactccagttggtgggactggcagcctggcccccagccttcaggcccttcctgatctgaaggtggggccttactgggggcccgcccccttcctcccaggactctgcctcctgccaccattcatggctcccaagtcctcattccaagatccaagccagtgccaggagcagagagaggccaggcagtggaagcagacacccctgagcttgcgaacaggagtgtgggagggaccttcctgggcccatgagggtgcacactgcagagatgcccaggtcctgcgccaggggagctcccacctcgscaacttgaaaggggggaggttcccacgtgtccctggctcctgcctgctccgtggagcgcgaggcccaggtctgcagctgaggattgggcagctgcagctgcacccaaaagagcagatcctgcctactcccggccccctccgggagcacagggaggctcatatccacaagcgcatttgggcggctgtagccccacccaggaggacggggctcctgcctgcttcatagagcaggaagcctgggtctgcagctgaggtttggaggactgaggtttgcagggctgcagcagcacctkggggagcccccaccccaactcagaagaggcgaagctcccactggctgcatggggcatgatagcaagcagccactgccattaataggaagctaatgaaatcttttagagacaacacagcggcaagatcagattttgtttaggatgataacaagtggcagagctagtgtgagagagacaggtggcaaggagattattacagtcatccttatttctcatggaaaattttcctgaaaaatgggctataaggatattccacttcttaaaactgtatttcttaccgcttagggagagccaaaatgctttgcaccaatgygacacgttttagaccaactgaaagtctacaaagagctctattttaataattaagtctactgtagatttcaggttcagcttcctacgaagattttttttctgaagtttattaaaatcaataattgacactaggtggcaagtcaggatcaacaattactgtgttcccagcgtagttatgcatcttgatttgaagtgaggaatgggggagtactrtgataaggttagacacagactaatagcattctgaaagacatatactgatacataagacacgtatagcatatatcagattcatgccccagataccgagcagtattattttcaaatacgttttttatatgcttcccctacacttacttgttcctgtttggatggcttagcagaagctccaagatgcccctttcatatacagtaataaaagatagccacagggtggcagcaaaggttaaaaaagttgagtgctgctacttcattaaaaatctcgtaaaaaataaaaataaaaataaacttaggcaatgggaacagagaagagaggagtaaaataaccatagaaacctgaaatgagaaga

SEQ ID NO: 13439 - DNA, 25740 bp, Homo sapiens
gatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatawamcactacaaagtgagagttactgccactctgttcttactgacaccgtccagctgggagtttaggtggtagaggatccagggggaatgttgaaatgggaggagtgggaatgacrtctggagacaaaccccagaatgagatgaggattgaaaaattatctttattatcttgagtgggagctggagctggaagtctccagcttctccctccaacaactcagctcccattgtacccatctggggacttagatgaagttacaggtcagttattggacagctcacaggcctctgtgatggggggagggaaaaagaaggacagaagggaagtccagggagaaaagcaaagttgatagtaatggggtgggggagaacgtgttctttcattccctgtgtcaaaggggagtctctaaggctcttttccctccacgtatgaccctctgccccctttatccagtgcaaactcagaaacctctcttttgagtagcccagaacccatcctgcctccctcaggtgacatcacagctcttagccacatccctctggtgacatcacacgagcctctttcaccctgtaacaccagaagacttkgtgagtcctaatcctgttttatgagattttaacmccttaccttgattcctaggagtcaataagaaggctttggagtccaggcaggaagtcagggacttgaattcctccacacacttttcgggaggatgtggtgagcgatctggaagggcaaggtggggtcaggccagtcaaaacccctggaagcacctagctcttcctgggagggtrtcataggacccagagtgagkagttctcctgccctcccttgtttccctccaacccttcctgccttgtatccctactcactgtagaggagaaagcgctggtaaccctggcctgtctcattcagcatgattccacctgggcatgagctggaaaagagctcagtcttcatgtcagggcggcctgtcaaggcaggtgggagaagtatgagaacagagatgcagaaccaaactcaagggagggtgagggctgggaagaaccaaccttcagttctgagatctgtgctcccttcagtcaggtggtagatccatttccggggcacacagagcccrtctttcctgcagaggtggtggtggcaaggaggaaagaatgagcatcaccccaaccatagtgtcccagcttcttttttttttttttgagacagagtctcactctgttgcccaggctggagtgcagtggcgccatctcggctcacygcaagctctgcctcccgggttcacgccattctcctgcctcaacctcgtgagtagctgggactacaggtgcccaccaccatgcccagctagttttttatatttttagtagagacggggtttcactgtgttagccaggatggtctcgatctcctgacctcgtgatctgtccgcctcagcctcccaaagtgctgggattacaggcgtgagccaccacgtctggcctgtcccggcttctatttactccattgtatttgttattgaagcccagctctccttgggtttcaagctaccaagcattggttaggcacatctttctccagagggcaattaatacagccactgaattccgtgggccaagcatagtagatataccagctaagaggccagctcttggtgggtggattctcacactttgggcagagactgaacccagtgatgcttctgcctccttaccactcacatgcggatggtagcacgaaggtggagctgcatcggggcagagccagcagccatattgaagacaatgttgtccacagggtcaaaagttgccaactcctccttggtgggagctgcccctgcgataaagtaccactggcccaagtggacctctgggaactggagagacaatgaagggagcaaaagagggtgggttccagcacaggatgggttcaacctcttcatcagtcaaaacagcaagatttaggggtagaggtgttggctgccttcctctttccaactggggattggatccatgacaaagagtcattaaatgacttttcctctttgcccctccccagtcaacctgggtaaccaccccaccccccaattctgccatgcctctgcattgatggccacagtactgatatttttcttcttgctttcattatcacaacactcacacccccttcctctcttcctttcccaagatggtctccagtcatcctaggccatccacccaagtccctcagagcctccaccataggcttccccyaatctcagtccatacctccttcccatccacgcccagagttgtcagttgactgtgctcagggcactggtagatggagttaaggataataccatagaagtagagcagagctgcccaaatttggtggaacatcttcaggcaggagggagctggtgctctgtgtgccttaactgctctctcccctactggctgctcagtccactctgctttcagctcccttgcgttcgacccttgaccctttcacctgctaatgagtaacttcaaccttgttttccaacccaaacctggattacttagtgtttgggacttcctccccctcttccggatgcaaccactccatagtacaccctggcatgtccagggtttctcaggagttatgaggagagctgagctgtccagggagaagcctgtggtctttgaacctgtatctgagctggttatttgttgcactgtgcagcactgaagggaagtagcttgactgggcctctcattcattcacttagcaaactgttttgaatcccaagtcccagttgtttcccaagaactagctaatccccggggacataaaaaaacgaataagacatagcccctgatcttgaagaagtcgttagagggaaaactagctgtgtagacaaaccattgcaatacaacttggtaaatgctttagaacaggtatgatgcaggtgctggggcacggtggattgctctctttagtttacaattagaaaaatatgtataccctggcagtgttcactgacacattcactcaacatttattactacaaagaggctatgtaatctggctgttagagaggatagatgttggtgtcaggcagaatgtgtccaaaccctaactacaggcagggcaggtagctcatgcctgtaatctcagcactttgagaggccaaggtgggcggatggcttgagcccaggagttcaaaaccagcctgggctacatggcaaaactctgtctctacaaaaartacaaaaattagccgatgtggtggcacacgcctgtagtcccagctactagggaggctgaggagggaggattgcttgrgcctgggatgtcgaggctgcaatgagccctgattgtgccactgcactccagcttgggcgacagagactctgtctccaaacaaacaaaacaccaccaacccctaactgctatgtctgttttttcatctgtaaaattggcaaatcatcaatcttayaggattaaatgaaataatgcacataaagcccttagcaaagacttgcacatggtaaktccaaagtatatatttgctataattaatagtaatgtttgcaaagcacttagtttctggtgggtaataagttctcaaataataggcagtaagaattgccaaataggttgtccttggatagcaccaagtgactggagcagttaatgctgtgagagatggatcttcctcgatagattatttatttacttatttatttttaagacagggtctcactctgtcgcccaggcatgactttgacttccccggctcagatgattcccgagtaggaggtataggtgcacgccatcacgcctagctaattttttgtagacacggagtttcaccatgttgccccaggctggtattaaactcctgagctcaagcagtcggcccaccttagcctcctaaagtgttgggattacaggcatgagccaccacacctagcttgataaatttatatcccatggactgccacaaaaaatttgccragggctgaggcttgcgatttagttaaaaaacaaacaaaatttgggtgaccagtatattagagtttattaatactgttctattttggtgtaatgtttgmatttttttttttttttttttgagatgggagtctcgttctgttgcccaagctggagtgcaktggcrcgatcttggctcactgcaatctccacctcccgggttcaaagcaattctctgcctcagcctcccaagtagctgggattacaggcgcccgccaccacgccaggctaatttttgtatttttagtagagatggggtttcaccattttggccaggctggtcttgaactcctgacctcgtgatccacccgcctcatcctyccaagtgtgagtcactgcgcccggccgaaaatttttgtaataaaaagctaaaatgtggttaggcacagtagctcacacctataatcccagcactttgggaggccaagtctgcaagaccaggctgggcaacatagcaagaccccatctctataaaaataaaattagccaggtgtggtggtgtgcatctgtggtccctactagggaggctgaggtgggaagatcggttgggctcgggaggcagaggctacagtgagttgtgattgcgccactgcactccagsctgggcgacaaagcgagaccctctctcaaaaaaataagctaaaatgttaacagctttttattggggcagtaaagtacaagtgctcgatctggagtcctgtaggcctggatttgtcaattctgacacttatgttcgtctaagtgtactcacttaaaaaatgttaaaagctcgttaaaaggctttttaaaataatacacaaaacccgtagtatatgggctggcacaagtgctcattaaacagctgcttattagaactcttaactaaaatataaccaggacctgggtataaactacgaatcccagaaaggttggacaccccaacagcgatgtgtctttctggaggactcgcagtttcgcggggccgaggcccttggcccagggcaggttaagagaagagggcacggagaggmggtaatgcctccacccccggccttcggaagcacgctggccggcctttaaattccccacggtcagggtcttgtctttctgtccactcggactccatttgctcccaattctcaaactcggaagcgcctcttttcttgacaagtcgtgcaacttagtagcacgtttacttttcctaaaacgtgtcatgtccccttggccacacaccgacgaatgtgacgcccacagcccttaaaacgcccacccggcagaaccgaaatctagcccaaccaagcaaccgagaacaaaattgaccagtgccgcccccaaacgcctactgaaagagtaacttccggaggcacagaagaaagggcgcagcgagggcaatagggtggagaagagttttagctggctaggacagtgccgcctgaaattatcagcctgccaagatttaaacatagatgaatgtggcataatcccccatctccaaagtccaaggtccatacgaccgtccatagcccctctcgaggcagtggtagagtcccagctggtgactgtttttcaggcatttacggtagccacctcaatcttctagcgctcmagcgcgcgcacagacgtgaacgccgccagagggggragggggtggggcgatgcttaagtgtccacgcatccgtagtgcgacgcacgcaggcgtagtacggtcccccgggcgacagcggtggcggctcctcggggtgctcggctccctcccacmtaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacggtccgtggggaagtcgggggcggagccgcggggtggtgkgtgkgkgtgtgtgtgtgtgtgtgtgtgtgtgtgtgtgtgtgtttggctgtgggttagttgtgccgttctgctggaacaccgtgggaaggcagtagacgcgggcagtcagctagcaggtcygtcgccccgtgagtgccgtttcgggtctatagtgagttaggagggttcgatgggcgtggcgcgcgtgcgcgaaaccactttctccgcagagtgtggggcgaccaccgctttcgcgttgtcccaggattttccgacctctggggcgcttgtcctgccgtgaccggtgatgacactagtctctggtctcgtgcttccttcctaatctgactggctccctgcttattgtgattggcgtcgtggagcccctcccacctctcgtcctccagctccctaagccgtcgatctcctgccctttgtgtttctctccctgtgccccggaatcagaagggggatggggacaggtgtgaatgtgtgtgtgtgcaggagawactttttaggtattggggcagggattaatgctagggagtctttcgggtacactctggtctgggcaacagcgggccytccttccttcgttcttctttagagacctgtcggccatggagcctaatgatagtaccagtaccgctgtggaggagcctgacagcttggaggtgttggtgaagaccttggactctcaaactcgtacctttattgtgggggcccaggtgagacacctcactagttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgaytcactgaaacttccacctcttgggttcaagcgattttcctatctcagcctcctgagtagctgggattataggcgtgtgccactatacccagctgatttttgtatttttagtagagacggggtttcaccatgttggtcaggctggtctcgaactccttacctcaggtgatgtgccctcctcggcctcccaaagtgctggtattacaggcatgagccaccgcacctggcctcagattttmtttttattgatccctttgttygtattccagtagaacgttttctgatgttttgtgagtgaggctgattttgttctgtcctccacatggatagaacttaatgcagagggaaatacagaggaaggaagaatctgtgtgtcatcatcatgggtggaccccaacccaaagggacaggcatggctctggcctttgggaagggaaacagcacaggaaccctaagcaagtgtgtcttactgatagacattggtcaggtctatgctgtgttyttaaagggtagaaatcagaacccataatggagataggkccttgatagactgttgagtgaaattactaatttttatggcatagcttgagtctcttgagcttaaagccttggacatagctatctgtgtctttactcctgtaatacttggagacaaattgcatgtggggtggtccatggttttctaaaatgtgataytacctggatataagaaagccatatatagacttgtgattagatgtatataaatactctggtacttcccaagagtcagtttgtagttaggaaaaatatttctctttttgcttttttttttttttttgagatggagttttgctcttgttgcccaggatggagggctggggcgcaatctcagctcactgcaacctctgcctcctgggttcaagcaattttcctgcctcagcctcctgagtatctgggattacagacgacgcctactaccacgcccggctaatttttgtatttttagtagagacagggttttaccgtgttggccaggctggtcttgaactcctgacctcaggtgatccacctgcctcggcctcccaaagtgctgggattacaggtgtgagccactgtgctgggaccttttttgctttcttatcttcttagtctttcttcaktaacctgataccagaccccatcttctttgccattttttaatcttggaaatcacaggagagtctggtaaataaactggtatcatcttgtgtttggaaaggggtcactgatgtctctagacacatactcccttggatgccagacagataatataatgtccatgtgktttttttttgtttttcatccgtgttatttttcctggatctataacctgagcttcattaagtttatttatttaattttttgagatggagtccctctctgtcacccaggctagagtgtagtgatgcgatctcggctcactgcaacctccgcctcccgaattcaagtgattctcttgcttcagcctccctagtagctgggattacaggcgaccaccatgcctggcttatttttttgtatttttggtaaaaaaggggttttaccatgttggccaggctggtctcgaactcctgacctaatgtgatctgcctgccttggcctcccaaagtgctgggattacaggtgtgagccaccgcgccaagccaaatttattgtctgtattttgacagctgttactttagtttaagggtttgcacagtaatgatctcacggtcaagacaaacgggtagtgattctgtggtggtttttacccctcacctccacaactcggttgtctgtctttgttcttcctctttcctccattctttccattcctgtgcatgcctcttcttttcagatgaatgtaaaagagtttaaggagcacattgctgcctctgtcagcatcccatctgaaaaacaacggctcatttaccagggacgagttctgcaagatgataagaagcttcaggaatacagtaagggggctggggaggcagttcagaggttggggctactgtctggagggatgaactgaggccatgggtttacctgttcatactatgttttggtgtgtgtctatttttctgcagatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctgtaagcttatgttccacaggggagggcttttgtgggtagctttggttgtggtagcaccagggaattaataagatagatgcttccatctttagattgggttcagggggccctgtggtgtgctattggtctcagtctttaaggagaaaaggaggtagggctccagggaatgaattggaggtgtggaggccttagtgttggcttctcccagaacaacttcccttaccctttccccagagtgacggctctgctgtggatgttcacatcaacatggaacaggccccgattcaggtattgaggggcctccgagggtcagggaaggggatctgggagaaggaggctgggaggtggggtggacctggctgagagatggctgggacctgatttagtaggtggtagaactcatggcttcatctgyaacctaccctgataaaccttctctcattgtagagtgagccccgggtacggctggtgatggctcagcacatgatcagggatatacagaccttactatcccggatggaggtaagtgggcaaggctggctagggtctctctccaccctccctctcccttttctctcagcctgggagttagggcttcactggccacatycacagggtttggccttcataatctagtcttctctgcagtattcattcttttgggcagaaaaagtatctttgtgaggctctctcatttctgccaatcctcttggtgcctggtatctggggagtttgtttcagacttagtctcatggcatctcttttcaattaaaggattctactctcttaacttgtggaggctgggaaaccaacttgtggaggaaaggaaaccacaatctctactctttgttagaaatttatttacaaatattacagatgctgtggccgggtgtggtggctcctgcctgtaatcccagcactttgggtcgccatggcagggggataacgtgtggtcaggagttccaatccagcctggccaacatggtgaaaccctgtctctactacaagtacaaaaattagttgggtgtggtggcacgcgcctgtaggcctggctacttagaaggctgaggcaagagaatttcttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagttaggatactttctctgttcagtctcctgtagagtaatcctctgcagcagtcttaccctgcctttggtatcctgactctcccctaccttcagtgtcgaggagggccccaaccgcagcacagtcagccgcccccgcagccaccggctgtgaccccggagccagtagccttgagctctcaaacrtcagaaccagttgaaagtgaagcacctccccgggagcccatggaggcagaagaagtggaggagcgtgccccagcccagaacccggagctcactcmtggcccagccccagcgggcccaacacctgccccggaaacaaatgcacccaagtgagagatggagggaatctttagtgggtggggaatcctaagtgaagtatggggagaaggaaatgaaccatggcaagggagggaaaggattacttggaggtcttagttgaagggttagcattgaggggcgaggaggggctctctcggtataggtaaatgacgctaggacaggcagctgagaagaactgctgctctccctayggcaaggaaatccaaatggtatctcctgagcctgatcggaattctcctctgagttcacgaaggcctgctctctttcttagaattagtctttcaccattgtaggtgcaggattgtggtggggagggtgggagcagttcattttcttctccctatcctctcatgggtgggagtaaagaatagaagctttggctgggtgcagtggctcatgcctgtaatctcagcactttgggaggcagaggcgggcagatcacctgaggtcaggagttcgagaccagcctggccaacatggtgaaaccctgtctctactaaaaaatacaggccgggcacagtggctcacgcctgtaatcccagcactttgggaggccgaggcgggtggatcatgaggtcaagagatcgagactatcctggctaacatgatgaaaccccgtctctactaaaaatacaaaaaattagctgggcatggtggcgggcacctgtagtcccagctactcgggaggctgagtcasgagaatggtgtgaacccaggagacggagcttgcagtgagctgaggtcgcaccactgcactccagcctgggtgatagagcgagactctgtctcaaaaaaaaaaaaaamaaaaaaaamcaaaaattagccgggtgtggtggcaggcaacttaatcccagctacttgggaggcagaggcaggagaatcgtttgaacctgggaggcggaggttgaagagaatagaagctctgctggtccagagaaggattgggccagggctctgggagaccagggagaaagagggcacatgtggtccctgttgactgtgagggtgggaatctgaggaaggctttggctcattgccccttgggtttgtccacagccatccttcccctgcggagtatgtcgaggtgctccaggagctacagcggctggagagtcgcctccagcccttcttgcagcgctactacgaggttctgggtgctgctgccaccacggactacaataacaatgtgagccctttgatggccctgccctttctcctcagccccagtactcccaaaacagaacaggctgaaatrcagataactctttccctccctggaaaaacattgcaacagggccaggtgcagtggctcacgcctgtaatcccagcactttgggaggccaaggtgggcggatcatctgagatygggagtttgagaccagcctggccaacatggtgcaaccccatctctactgaaaatataaacattagctggatgtagtggtgcacacctgtaatcccagctactcaggaggctgaggcaggagaatcgctagaactcgggaggagggggttgcagtgagccgagattgcactactgcactctagcctgggtgacagagcgagactgtctcaaaaaacaaaacaaaacaaaaaaacacacattgcaacaaaacartttctctctaaacctgtaagtgattttgtcctcccttacagagaaggtgataatctttgctgtaagcactgtcctcgtatcgtaccccttgtgcccctgaatgaatttagaaaatgtaaagtacaggagatcagtatatgatgacttactgattcatagtagtgttttaataggatgttccttatgtgaataagatataatttatttgcaaagatttggtctacatgtaaacttccaaggatataactgaaagttttggaggacatggtattctcagtaggcattattgcttttattagtgagatggactccagcttgatattttctgcctttttgtgtttggctggttgtgcgcagcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacaggtgggttagggggagtctggcctgagggagagtgaggggtgttgatagagtgacccagggtagctactgggcctgaaggaggttaggaaaggaggagactggaaacatggtgatgaaggctggagatactttagaggtttatcatgaggttttcttggttaggctcttgtatttttctcacatctgcctgtccatctgtctttttcagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccragggtcatccggatttcccaccagagtgtggaacccgtggtcatgatgcacatgaacattcaaggtgagaatagttgctggcgagaagagcaggatcagcatgatgagggaggttcatgctgaggtgtgagggaacagggtggggaagggagaggcacatgctggtggtggtagcctggggaccagagcagaagcttaagtagacagatgwggggggtgtgggggttggtttgtctttggaggtgtgtttgtgtggtgaagggagtacctctccctgtttagatggagggaaaggcaggctttctgattgggggattatgggcctgaagtatgcctgatctcagaaggatatagttaggccttggccctacctacctcagggccactgtctctgtctccctgcccagattctggcacacagcctggtggtgttccgagtgctcccactggccccctgggaccccctggtcatggccaaaccctgggtaagagtgagggcatcagggcaggctgagctctgggtagagaaagggaagggctgwgtgggtgggttgaaggggtccaggttcaaggttacatcagacccgccccccaggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactggtgagcaagggtcggggakttctagtgcgtaacagtctagggagagactcctgtggtggtgcatggaagggcaggtctgaarttctcccttgctctctatccagcagggcgcyggtctgggtaccaatgcctcgttggcccagatggtgagcggccttgtggggcagcttcttatgcagccagtccttgtgggtgagttttcattcttccccactcagagtttaaactcctttcctagtytgctcactggcactttccagttctttccatattttsttggttcctgctttcctggaatggggctgctgtagtgtcttgtgtcttcaggtttcagcttttttttttttttttttttttttttttgaratggagtctcactctgttgctaggctggagtgcagtgtacaatcttggctcactgcaacctctgcctcccgggttcaagtgattctcctgcctcagcctcctgagtagctgggactacaggtgcacgccaccacgcccagctaattttttatgtttttagtagagaagggggtttcaccatgttggccaggatggtctcgaactcttgaccttgtgatccacccaccttggcctcccaargtgctgggattacaggcttgagccatcgtgcccggccagcttttttcttttttttttaagttacagagtcttgctctgtcacccagactggagtgcartggtgcaatccagtgagttaaagctcactgtaaccttgaactcctgggctcaaacagttctcccacctcagcctcctgagtagctagcagtactakctcctggctagtaattgtctttttttttttctggtagagatggggtcttgctatgtggcctagactcctgggctcaagcagttctcatgccttggcctcccaaagttgctaggattacagccaagagccaccatgctcagcccagctttctttttttggtttcttacagctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggyctggtgtggcttctcccaccatcactgtggcgatgcctggtgtccctgcctttctccaaggcatgactgacttcttgcaggtgagtggctggcttgccattcacctcatcttcctgtcccccggcccagccaggcagtggtaccttcttgccattayataaccactgggtaagagcccctagtgacatgttaggggaaggggccctrggaattcattgactctgaacctttcattttaaagatgaagaaaatgaggtttagaaaaagaaagtatagtaattagtgtcactgctttctgacarcctgttcagaggaagaggtaggtaagttgtgctgcctgactctgttaaatacctaccatacttctgctttaagcagtgaagatcagaatgtaactccccatcttcccagacccgttggtttgtgccctcttgatgccgtattatttccgtgtgtcttcattctcacctcactttctgttctttgttctttatttgccaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggtgagcaaaaaggatgctttggcttgctccaggaaggggcagccagaggaatgtagatggccttggtttaggggtrttgccaaggtgggatgaggttgatgatctggttgtgggtgggcaggccaggtggtaaaggccattgctaacatctgcccttgtcccccaggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccgggtaaatgaaggccaggggccccagaactctcctcttttgcacattttattccttatttctgactgcttctctgccaggtaaagctccaattgcccccacacaagccctggacttgttggggtcgaggtggaagtcttgggaggactgaggctttgaactaaacctgttctgtttcctccacagatggcaacccacacattgatcacggggctagaagagtatgtgcgggagagttttgtgagtaacccttctctattcctttcctctcctgggtctggtcraggcagctgcctcctccactcccagtcttatgattcttgattttgggatctttgtgttatcttgtctctcagtccttggtgcaggttcagccaggtgtggacatcatccggacaaacctggaatttctccaagagcagtttaatagcattgctgcgcatgtgctgcattgcacaggtcaggggctggccaggcgggggcaagbggggcctgttgcatgtgcagggctgccacgtgccagcattccctccttgtattttgcccacagatagtggatttggggcccggttgctggagttgtgtaaccaaggcctgtttgaatgcctggccctaaacctgcactgcttggggggacagcagatggagcttgctgctgttatcaatggccgaattgtaagcaccacctagccccagatccttagccttttgtttcctgaggtttccattctctgcagttttcatttttcttttctaaactgacattctgtaacctggatctaatctatttctaaaggtggttgagggttttgtgttctaaatctgctttctgtccctcagcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccaggtaagggacctgttgggcgatggggtcagggtacttgagagaactggagagatctgagaggaagtatggtgttctttaatttcacagccrcttcctgaggagccaatggaagttcagggagcagaaagagcttcccctgagcctcaggtactctagagagggggaggttgaggggccagataatgtggagtggagggctgggggagaaaggtttggaggctaaaaattctgaagcctggctcttcccgccatctgacacccagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagtaagtgtcaggaagtaatccagtgggtcatggcagctgaaagtcaaggacattactattttctcttttcctccccaggaatgggtccctattatccagcaggacattcagagccagcggaaggtgaaaccgcagccccctctgagtgatgcctacctcagtggtatgcctgccaagagacgcaaggttggttttcctcttccctaagcctctctctctrtccaggtttccccgtcatgcctggaatcaaactatgtagagatggtgggagctcttgttattcagtctcccctcccctcgtttaatgaggaaactttttctgggattcagacttgctcttggttgttgcataaccatacaggacttgaccttagtctgtttgctagcagtcctgtattagttgctcagctgcctaatccccatgtgcttagatcccattttcctttaaggtgggtttcctcttgtggattacctagctctgaatcccggatggcttgaccccttctgcctttcgttttgaagagcacgttcaagcacattcactttagttttggctagtgccaaagagaattaggaaggcatttctgctgtaaaaaccacatcctggactcttaatttcccctctctccactagcatggagactcagtggagtggttgactcatggaaagggtgagccggatggtggcactggatctgacgttgatcctcttttccctcccaaccccctgtcccccagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcaggtgccaccttgaagcagaatagggatggtctagtgggaggggttgggctagggtccctcttccctggatcccttcagcgatgaactggtcagcctggtgctaccatttgttttcccctttggcatctgggaaggcttgacagtgccaccccgggctatttgacagygtgcttggggggggaaatgttagcttctgagggatggccttgtgtgcttgctgggatcatrgggacttggccagcstttctccaacctgcttrctttttctctttagctccggtctgatatacaaaaacgactrcaggaagaccccaactacagtccccagcgcttccccaatgsccagcgggcctttgctgatgatccttagctctttgctctatggcccttcctcatcaggggaccgtttcccccctcttccttcacagtatttaagaaataaaagtcggatttttctggctgctttctctctacattgtctccattaggtagtgtgtcccttaatcttgtgtgaactttttwaaattaatacttccttggaacactgttgtgttctactcagcacgctaaattgtacaagccagttttgatgtttgtttttttttttttttgagacagagtattgctgtctcccaggctggagtgcagtggcccgatctcgagctcggctcactacaacctccacctcccgggttcaagtgattctcactcatgcctcagcctcctgagtagctgggactacaggcgtccgccacsacgcccggctaatttttgtatttttagtagagacagggtttcaccatattggccaggctggtctcgaactcctgaccttgtgatccacccgccttggcctcccaaagtgctggaattacaggcstgggcyaccgcgcccagcctgrtgtttgtattttttgtgcgaaagcactttatatataaataaaaaacctgtattttgagttgggagcatattccaggtgcacactagcatagagctctcaaattacccatcaaaaaaagtttctgagcagctgcagacctaagtatagtctttagcataactagcatgcagcgttaccatgtgaaatcccacttagtttgacaatgctggaattggtctatccaattcaaagagccccttaagtgtgctccaacattgaggccttaacagagatttccccttagttcatcataaagaactgaagtcccatggctgcaaattctttgctagtccctttgagatgcagttgaagtcccttctaaacccccccatcccctaccttggctagtttagtgctctatcaactaagcatggcataagcttagaaaattccagctagacctcttggaacatgagctcacggacatttaacaggcctgctggagagtccatgtgaagacactggttgataacccagtaatgttacagatgtcycaccaaggccctagatatgcaaaggaagccatattgggaccagcccaggtgtcagctgcagactgataaccagttgacctcgctcactggcacaaaaaagcagatttatccagctgagctcagcccaaattccagactcacaaaaatttaaagatccaatacgatggtcatgtttttagtttcaacagctcactggaataagtaatgaatatttccctgactgaaactacagatcactcagcaccatgctttaagacaatgcaaacaactcatcccccaaatcattgtagaagtttttttttttaaatccttttattactcttttttaacaaacagccccagggacaggggaccaggggaagggggaggaggggaagtgaggccccagccccrsaacccctccccgcccacccctttcccccttatatatttataatctatatacaagccccgggggtagggggcaagaggaactccctcagcggggtgggggcaacccaggctccttgtcccctcgggacccaggctcctctgcccgtcgggagggcccttctcgaggtggcrgccctgtccgctcccaaggcttaggtatccagcgcagggcatctggtggggaggcctaggggacaggcatgtgttaaasagtgagtcacagtgagaggtcagcgatgagayggaaggacaggaaatcargtggcaactcraatttagagttggggccacaagggtttctccttcacctgctggtaaaggtcgacgcgctgggtgcggaagactccactgtaggtggaaggcgtggccttsagacgggaattgaggccagagraggacctaagggaagaagggcgtctaaggcaagcctaggatccagaccctggttccaaagtaaggaagcacttggaaagtccacatccctattccgtttcaccttccagttgggggagtccrtgatgatccaggtcccccaaggttgctgctcagtttttgataatcctggaayggctttagttccactggatgcagctgaggggaaaaaaatcatgagctgcctaccttgaaatacagaatccctactcccaagtcttggcgctccctagcccctcagttcctgtaccttacctctgctcgccccaagctagcggggaagggcctggcaggtgaaggcagcacccgagtagcaggagcaggtgggggccgcacagccaggctggggggctgcagrgcagggcccacaggtaacagagaaagggraggtggggcaggaggtggtgctggcggcagggagccaaagttcaccacaggcagctgtgagtctaccatgggtagaagcatctgtaacaagaaatttgggtgtgcatgttgggggcagggaggaatgtcagaaaaccagggaaaatcaaagccagcaactggacagagaaatcaaatgaaggggaagtgtgamgatacaatatacctgctgggcaggagcccctgaagggagaaakccactttggccaccaggctgcagaggagtagaataaaaatccgaaggggatggcagatcctggcgtacctgtcgggaaacagggagaaatatatcaacccccacaaaatcattctccctaccctatcccccaatatctaatacctgcccccctcttacctgaagcaacgatgtgtcaggcaaaggactggggcagaaagccggagagtagaggaaggaaggtggagggtagagaactcctccagccggcaacttccccagctctgtagcttgcattgtggagaaatccagaaactggcccttgagagctamcccagagagcagtgctgagggaggggctgggcysgggggtaggtataggggctgtgatctgaaaataaattgtggggagaaaagctgttaggaagccagagtcctagcaatgccttaagtccactagcttctagtaccctagaactgtgtcttccccttccctctccccgaaacacatctccaagtacttctgtgatccacaggcatcgagtcttacctgtaagggtgcagtgagggtgtcccagggcggaagcctccactgtttggatgtaaytgagagtccatggctcccccagagatctgcaggagaggagcacggttgaaacagctttagtatctgtggtcaagaaaaaagatcaccatcccacccatagaagcaaaaagtagggagaaaaatgatgtgacaaagtggtatctcacaactctgcaacgtagaaaggcttgattataaayacataccaggcagaaaaaaattattattcactgaaggggtcatgcaatgggaagcggggcctacctgagaactggaaggcccagcactgccatagaaaacctcaggatacaggcgctggcctgaggagctgggctccgggacacagtgcccagaatccaggttcttggattgtggctcagcagaggcagcagcactgggaagcagctcccagtctcgtgatacaggaatggcctgggaaggagaggcctcgtggagagggatgtctggcatcctggacgccctggtcactcccagcaatcttccccagaaatcttgggcctttccaccaaactcttactcccacttayctcagtgactgatgctgttagctccttctctgctttcaagctgtctcctaccaytaggcgtaagtctgagtcctgtgatcacaagaaggcaggagacattgtcccgtgacagacatgtgtcctctatgtcccacctttagtccttcccttctctccacccaactcaggatacccagatccagcccacacagaccttgycactagtgccaaactggactgggggaccaggtcgatgggatggccgaatggggccaggctctgtgsctcggtctgtaygctgtgatcgttctgtgccaatggggccagggggyagaggctgctcccggggcagctcctggattgggcacacagtaaagtgcattgggggagggaaagggaaatccaaattggaatgcccagaacacacacgcagagagaaaaagcagaaaaaggtagggccaaagtcagattcctggaaacattccccttatccttttttggtcttttacctttctgtccccatcgtggggggcaggtggtggtctcctaggaggttcagagccaggtggaccctcacaaggaacagcattcaggggtgaggagcctccaggcctcttggggggtccctctgctgcccccttgagtcctccatcaggggaacttcgctggctgcagggacctgatgacacctgagaatccccactcaggtccaccccactgtcagactgactcatctgagaggagtggagaaggagctagttaagtcagggtagaragcaccccaatacctgactgatgcacacatacaaactgcagaaaggggacagccaagtgagaraacagctccagactcaamccagagcaggtggggggtatgaccagtgctcaaaaaagtcccagctcagacacaccctcccaccctcactcacttctgtgccagccacatcctcaaaaggactcaggggctccatccaaggctccatggagctgggccggtaactctttcggctagtggctggagaagggagcaccaaccagaagagaagtgaggagatgacagttcagaagcccctctcattcttaacccttctaccatagtcctttcactcagctttactcaccagtatgtaaacggttccagatgtgaggggtcagggcctctgtgcctgtatctctggactctgcctgagggcctgggccctcaggcttagagcccaagaatccagagctatgaggaggtggcaaagattcctacagatgagaagggccagaagcaaaacatgaattgggtgggaattgggaattataggaagccaggacagagtggggtgacacagggtgtggggacaacaagggagacacatgggagactaatactgagaattctggagtaaaaacacagtgaaagaaacaggaaagaraacagagaaaacataacccagaagaawtttcacgagtaagagtgcagtgaagcacaatctcaaacccatcccttacctcctgtagcagctctggttttctgggaggcygctcccgacgtttagggggaaagggactaaccccggcagagtcccgaggagtcccayccacccctctcaccattggccccggctcctcaaagtgggggtctgggaaagagaaaaagggtcagcatctgcctggctctgccactgaccctaacttttcctctctactccacctcccaattcttctacccttgctccctgcagaaacgcacccagcrgcagggyccctaggccaggttctccacccgctccctccagcacttgaccttctctggggatggagatattcccacccataacccctccagcttaccagaactgaggccgctgttgaccctctggggctcgtatcgggttgggggcctaggagaggggccctgaggggcttggggargcccaggcttgtgccttggatgaccccctggtgcagttacactcccttgacggctactaagctgggccagagcctgttggatgccagcagggttgctgtggataacttggtccaggcggaagacagcagaactgctgggaggtgggggaggcaggggaagccccgggggacgctcctctggaggacgactggagaaaacagagcattagctccagtatccactaaatcgttaytttttcccacaagttatgtttcccaacttctgcttacaacctatyctcttccctattaaagtccaggtgtttttgagtccttctaaggrttcctatgcrtacagatgcacagactggaaagcaaagaaccagcaatgaatacataggtgggtgttcttgactctaacaccctaccarccgctttccagttgccttagccagacatggaaatcctactgacattctagagcccatggcccctcaggccacaatctccactccacccaaacttatctttccctcaggctttttccccctcctccaattttta

SEQ ID NO: 13440 - DNA, 60754 bp, Homo sapiens
ctgccttctgagttcaagcaattctcctgcttcagcctcccgagtagctgggatcacaggcccgcatcaccacacccggctaatttttatatttttagtagagacggggtttcaccatgttggccaggctgctctcgaatccctgtcctcaggtgatccacccacctcggcctcccaaagtcctgggattacaggcgtgagccaccacacactgcctgaagatcgtgatttttaaatggctgtgtgtgccaggcacaattctcacagcaaccctaattgttcactaacaaattaaaattaaaaaataatttttttcttttcgagacagagtttccctcttgttgcccaggctggcgtgcaatggtgcgatctcggctcactgcaacctctgcctcccagattcaagcgattttcttgtcttagtctccctagtagctgggattacaggcgcccaccattacgcccagctaattttttgtatttttagtagagacacggtttcactgtgttggccaggctggtctcgaactcctgacctcaagcaatacacctcagtctcccaaagtgctgggattacaggcgtgagccatgtaactcagaaggcagaggttgcggtgagtggagatcacgccactgcattccagcctgggagacagagggagacttcatctcaaaataaataaataaataaaatcaagccaccatgcttggctggaatttctttttttctttattttcttctaaaacatcctgtcataacatgttcattaacaaataccgaacattctggttagtgggtacaaaaatagagttagaatgaataagatctagtatttgggagcacagcagggtgactacagtccacaacaatgtattgtacattttaaaataactaaaggagtataattggagtgcttgtaacacaaagaaaggataaatgcttgaggtcatggacacccatttaccctgatgtgattatgatgcattgcatgcctgttatcaaaatatctcatgtaccccataaatataaacacctacagtgtacccataaaaactaaaaatatatatattattatccagcttttttttttttttgtgagacagagtctcaccctgtgacataggctggagtgcagtggcataatcaaagctcactgcatcctggacctcccaggctcaagtgatcctcccacctcatcctccggagtagctaggaccacaggtgtgcaccaacacgcccagctaatttttacatttttttgtagagacgtggatctcactatgttgcccaggctggtcttgaactcctgggctcaagtgatcctcctgcctcagcctccctcccaaagtgctgggattataggcatgaaccacagcacccggcattatgagcattcttctgtacaatgcacccttacagcacagtgaatacagtcagacaaagtacctgtcctcaaagggcttatattgttaagagagaaacatactaaatctataagcagaaaaagtaacgtcatttcagatactgataagtgctatgactaaggcaagcccatttgatacaacgggctgggaggggtcacttcagatgctatagtcagggaaggccactgtagagaggagaccatgcaactgaaccacaggtgatgaaccacaggaaagcattaaattgtatccatgttaaagataagaaaataaaggtgcaggaagttaattgagttgtccgaggtcttacaactagtaattaacaaatcaggcttcagagctggctctgactcctaaaccctccttcttcagcactatgctagaggcaaagagatcttagctattacaggatctcccaccccatcttgccttcctgctatcctacaacagcctttctcaaattctactttgaactccttgctaattcctaaaaactgcttagaggcacaaaggggaaccccaccacctatcaacaggtttaaggaaagtaccaaatgtctttcaggaaacttcccaaacattaatgaatcatttacatgctgcttcacactttactacgtctgatgccttcccccttggaattttattttatttcgagacagagtttcactctgttgcccaggctagagtgcagtgctgcaatctcggctcactgcaacctccacctcccgggttcaagcgattctcctgcctcagcctttcgactagctgggattacaggtgttcaccaccatgcccacctaatttttctattttagtagaggcagggtttcaccatgttggccaggctggttttgaactcctgacctcaagtgctccayccgcctcagcctccaaaagtgctgggattacaggcatgagccaccacaccaagcctccccttaggaattttattacttatttacttattcattaagatggaatctcactctgtcgcccaggctagagtgcagtggtgcgatctcggctcattgtaacctccaccttccagttcaagcgattctcctgcctcagcctaccaagtagctggtattaaccccccttggattttttttttcttttttttgacggagtctcgttctgttgcccaggctggagtgcagtggcacgatctcggctcaccgcaacctcttcctcctgggttcaagcgattctcctgcctcagattcctgagtagctgggatttcaggtgtgcaccaccacgtccagctaattttgtagttttagtagacacagggtttcaccatgttggtttggccaggctggtctcgaactcctgacctcaagtgatccacctgcctyggcctcccaaagtgctgggattacaggcgtgagccactgcgcctggcccccctcggaattttatttggccctaaccactctgtgacgtttctggacaggaactaatcacctcagcttacagagaaaccgaagcacaaactgatgaggtactggtgttgcctaaatggctttgatcaaggtatttaaactagttggttctcaatttcccaaattttccataaagaaaaaagagagggcattgaaataataatccttaaagtcctatttgggaacaacatttagggaaataggtttgtcattgggtaaaaccttaaaaacatttaaaatgtttttcttgttctttttaaattcaatttgttttccttgtagctttggactatggctgagcagataactcaatttaacttccttaggtccttccatgatcatttattaattcaaaccactgaacctaatacaggtagaagattggtttctggggagaaactcctttaataacagcttggttagttgaaaagctgaattgcatgtaaagtagctacttaaatagcacacaaaaaagtctttcggttttcatacatgtgaagactataatttggacaagggaaaaactgaaagttacttgtactctctaaagttttcccagcaaagaaacaggaatacaattaatagaggatacatacttaaaatatatcttaagagaaaatttatgtattttgattcataattgtctcctaaggcctggtatactttgcttaggctcctagtctttagaaagcagcaataaaattacatttcttttaaaagtatttgtaattcagacttttattagccttccacttaatacgactgttttgtttttaaaaatttttttaatagagacaagtgtcacaccatgttgctcaggctggttttaaacaccaagcctcaaggggtcctcctgtctcagcctcccaaagtgctgggattacgacatgagtcaccatgccccgcccattttcaatcactacatttacttgttgtgactagttacagctttggacttgaaagaatgccaagctaagtcaaacaaaatgtgtctgcttggtaaaaaggaatctaaaagaaaaatatacatataaagaaaatgtggtcaagctcgttggctcagccctgtaatcctaaagaggccgaggcgggaggatcacttgaggctaggagttygagaccagcctggccaacatggcaatatcccgtctctactaaaaacacaaaaattagccaggcatggtggtgggcgcctgtaatcctagctactcaggaggctgaggcatgagaatcggttgaacccgggaggyggaggctgcagtgagccaagatcctgccactgcactccagcctgggcaatgaagcaagactttgtctcaaaaaaaaaaaaaaaaaaagtaaaaaggaaatgtgtctgcattctttgatgttttctggctaaaaactattttttaaaaaaagcaattagaaacctacaattaccttgtttcttaagatttttagttaatatggcttgtgttgaaacatactcaactgaaataaaatggggaaaaaacacctctgaagagtagcgtatttgtttggtactttgaaaaaagccaaaacgctagaaacgggtttttcatctattctaatctccacttggaaaatactacctatacacagacataatgaagatttttttctttttctttcttttctaaatagtgatagggtttcaccgtttcccagtctagtctcaaatttgtaggctcaagagatcctccctccgtagcctctcaaagtattgggaatacaggcctgagccactgcgcccagcccacagtcaagatttagtcagcagtaataaatacctacgcagggagaggatgtgtgcttgtcatctgccttctggaaaattaaatacaggcacaaaggattcttcagctacatgtctgatcctgccctccacaatacccgtctacagggatgtttacagggatgtgttaatccccacgtaatggggattgcctattgaaataacctcccagtaaggatttttttgggcaaaatattctcgtttggcaatttcgacttactgattcttttgcaaagtcaacttgtttctgggcaaactttaaaaataaactcctaaggtagcatttagctagcagctagcacatcctaaatcgtgtctagatttaacttacacaatatgtgctttgcttttttcctaatttgcaacagaaaatagtaatcagctggtagtttcagaaatcacccttttgctgagtcttaawtttttttttattccagggaaacgtgaagattgtggrgcgctatttttttttttaaagcaaaccacacagcatatctggccacctaaaacacaaagtgtttgaaactaaccgtaagatttcctttctgctcgcccaacctgtcactggaaacgcagtattcatttgtaaccagctttggagcagggcttttaaaaataacgttttcttgctaaagtccccaaaaatctcttgattcttggtggcaatgtccagttgagtctttgcacacactgtatttttgccaactgggtcgcaactttgcgagaactccgggggacctcgtaggaagccaggttggcagttatttttttctccacttgccactaggttgcactagatttaggatgctggggaatatgcgccatttaatttttaaaaataaagtaggaccatcacgtgacgagacccgagagaggaaaaaaaaaaagccgaagggacagggtttttcattgaaatcccgttcaaatcgccttccctccaaagcctgaaagagctgaattctattaaatcctggttggcaggttttttcctcgggtccacgtcacgagctcattctccgcttcaaggttcctttcgactycacaacgtgaagccagggggaaggcctccttaaactgggggttttcgccaaaaaagccagggtcaccccccgggaaagtccctatttaggggtttatcgggaggggactgagcctgacgaggctgcagggccgcgaggccccgccccccccggggttcccagcatgccccgcgcggacaggacgcggcggcggaggcggggcgaggaaggggcggggcgaagaggagagaagggcgtcggttttgcgacaggggcggtgcggtgcggaagcggaagtgaagggtgcgcttggcggcggcggcgggagctgcggagtcgggaatcaaaacaaagggcctggggggggcggggggaaggcggcggggccggaatgtgagcggaggtggagccggcggcagaggtgagtttgcagacagtcctgcgaccagaccccggcaggctctgctccgaggccagcggggcgggacggaggacagtgtcccctctttccccgcctattgctggtgggatggtggtggagaggggaggttagctaactgggacgcgccagttgggccccccacgaaagagttggcttgtctccctttcgggtccattcactactgtcactgttggcgccgctgttccccttcgagggcatttggctccccgcccgcccctgtctgacccctggtggggccctccaggagtgaagtgcacagctggaaggttaakagagaasgaaaggggcgggtgtttttgcaacacactcccccctccccggccgttttgcattctcctcggccttttagcaacacatagggtgtagtctcagggttgacaatgtctagggcttcagccactctcactagtagttgtaacgcgacctcgtgatacaccttttagagtttctcaagcacctttccggtattaccaagagctgtccaattgcatttgtgtcttttggacttctctgagcggtaaatattcttctcttttgcatatcggtgtattgaaacctaaactgttttcctatttattaagctttattcgttcaacagttatttattaaaatatgccaggcattgtactaaggacaggagttggaatagtggataagaaaacatagtctctgctgtcatggagtttatagcctaatgggggagaaagataataaaataagctaaaaaggccgttttggacagaagagctatgggggagaaaacggtaatgggatggggtggtgtggggtcaaagactagattgggtgctaaggaaacaacatttgctaaatgttccccgtggattacctcatgtaatccaaacaacggccttgtaaggtggtttctattattatcacacccattttagagatgggatctgaggttcagagaggttgtgagttgtccaaagctgcaccgcagtcaaattggagaccaaaatgcagacagtcgacagagcctatgctctcctcattgaattggtcaaaagacttgaagagagtgacagaaaggagactgtcgctcaagtcaaacagaacctgcttttggctacctaagttgcttcgtggatggtatttgggaagttttcagggtgcaggcacctgaaagtttttacttttaatcgcttgtattgagcagtattgaaggcaccttgatgtagtggaaaggggtgaacaagcctaatcttgtgtcaggctcgctacaaaacttcattaagtttctttttctctctctgcaaaaatgtagctaatttctcccctgtctatttcacaggattattgcraaaattatataagaggatcccaccgtctgggtttttttcatcattatattccttgtgccaagcacaggcctgctgcatagtagatactaagtaaatatttgctgaatgaagacataagtaatgttaagtgaaaatactttataaactagattatactgtgaatgttagctcactttcaggatttggctttgaagaagtttgagagaatgtttaagttatgaacactgtgaatatcacagattcttacgattttgagaggagttttttgggggacataaaacctgtatctaataggaaagacaagaatcgtaatttactatcagtggtagcagttaaatccatctccaaattaaccactcccaatagtgtgtagtaggtaatgtttactttgtatttacagagtagggagcattttggttggcacaagagatacagtggtgaaaatagacagtggggttcatttatctaattttttttttctctgtaatgcagtggcggggagaaattagccacattttgcataggaggaaacagaaacttgaaaacaaaaatttttttagagatggaatctcactctgttgcccacgctgaagggccagtggcacaatatagttcactgtagcctcaaattcttgggctcaagagatcctcctacctcagtctctctagtagctgggactaggcgcatgctgccacactatgctaattttttgaactttattttattttagagctgtgatcttgctatattgcccaggctgacaaaagagccacgtagtaaatataggctttgtgggccatacagtctctttgcagagactctctttgcaactctgcaattggaatgcaaaagcagtcataggcagtatttaagtgaatgagtgtgtctgtgtcccaattaaactttatttatggacactgacattttaatttcatgtaattttgtttgttggtttttgagacagggtctcactccgtcgcccaggctgcagtgcagtggtgcaatcacagctcactgcagccttgactacgcagtcttaggtgattcttccaccatagcctcctgagtagatggggctacaggcatgcaccaccacgctcagctaattttttgtagccatggggttttgccatgttgcccaggctggttgggaactcctgggctcaagcaatccacccaccttggcctcccaaagtgctgggattgcaggcctgagccacggtgcctcgcttgcatttattgttaagacctgtaagagtgttgttgctctggcgtagatataacacatctgcgacttgagatttttctatcagttagatttttggtggtatatcagattgcactttcatcattagtaaacyaagaaattggttcaatttgttctrtagcaaatcaaattcaaagtccacagaggccacttagtttggacttttcatgctcagatcaagaaaccagtgcaagaagttgctcttaagtcaattttaaaatcttacatatagttgtcaatgaggatgtggtggtggctcttttactcagattagatgctctcttctgttaacttttgactttcctgagcagcatctttagggagagagagccgaaaagaattcagaaaaactgtagaaaaaattgattccagccaagtgaggaggtgaagtctcactctggaatatgcaagtttccaagatatggctacctctctcaaacatggttacatgtggaaaggaaacaagactcatggagagttcattttttatttgaagagctatgaaacatraagaatggcagattatagattttttaagaaatcaggttgttgcagttagattttaagcataaacagtcaaccaagtttaccaaattttattaacccgtaatatgctctgatattttgtgtttttttctttctttattttattattattattttgtttgttaagatttgaattgttggccgggcgcagtggctaatgcctgtaatcccagcactttgggaggccgaggagggtggatcacttgaggtcaggagttcaagaccagcctggccaacttggtgaaaccccatctctactaaaaatataaaaattagccaggcatagtgacaggctcctgtagtcccagctactctggaggctgaggcagaaaaatcgcttgaacccgggagacrgaggttgcagtgagctgagatcgtaccactgcatgccagcctgggcgacagagcgagacttcctcttgaaacaaagatttgaattgttgagagccataggactgtaaatatagctgtggtttcacattttagtatgttgtaaaatttgtacttatgcaaggaaataacactgaaatcttactcattcttaacagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacggtaactatatgcaagactaaggatgtagcagattcctcatccaaatagatgagagaggtccatttggtctgggatacagtctctcatcctagagtctgtgccacatttttctgtagatcttgcctgtattgcctcttataccacattataatgtgagagcacagcacaattttttaactcttctatttcactttgagtaacagtagatgccttgaatatttaatgttaaaatttgggaaagatttcttcctcattaaagtcacaggtaacaaagattaaaaatccacattgtggagtaaaatcagaggaaaatacaaaatatgttgtattttactgtagccctcttgagttttgagtctataatctaggaagggttgggaagagcttatccactgcctgttttttatttcgagatttctcttgaatatttacttctcagtatacatttatgtctctaacttcttgcttactcattgtgattttgacattttcttttttttttttgaggtgcagtcttgctctgtggcccaggctggagtgcagtggtgcgatctcggctcattgcaacctctgcctcccaggtttaagcagttctcctgcctcagcctcctcagtagctgggattacaggcctgtgctgccatgcctggctaatttttgtatttttagtggagacgaggtttcgccatgttggccaggctggtcttgacctcctgacctcaagtgatcctcccgcctcagcctcccaaagtgctgggattacaggcgtgagccaccgcgtccagccaattttgacatttcctgacttcatgcactcatgttaccacctttctatttcttattttctattgtatgygggattcaagtgagactgtaatataattttatataagggtattaacaacttttatttgattttattttttgagacagagtctcggctcagccccctaggctggagtgcagtggcacgatccgggttcactgcaaccactgtccctagttcaagggattctcccgtctcagcctccctagtagctgggtttacaggcactcgccattatgcctggctaatttttgtattttagtagagatggggtttcaccgtgttggccaggctggtcttgaacttctgaccttaggtgatccacccgcctcggcctcccaagtgctaggattacaggcgtgagccaccgcgcctggccgggtattaataactttttaaaaaccagtttaattctctattttctctaggttttcactatatagttgtctttgttgcaagacatcaagtaatttgggtcattttaggagtgttttattttagagacagttgacagtgagggttggcatcaaaagcaaggcttcctgggatggggtggtagatctggtcctcatggagtcacacaattcagaattacacggtcaactttacagatcttgaaactcaattttgtcagtggcatgcagaatggagtaggttcaggggatcaactcatartaagcctgcctgtatgagcctgatctgtataaatcagaataccagtgtgttaatttcagtctgaactataattaccaagagggcagttcattggctggtcagcccgttgctgttatctcccttttagggaaagtttagctgaaaattcacatttcttccagatgagcctatgctcccaggtgagtgtagaatcacagcaaagggagtggaattttaggcgtcagatggaccctcatatgctgtgaacggtgagcacgtctcagtcactgtagcagggccccctcttcatcttaatgtctcttgcagtcagcctgtgaaggctgatgaattcagtcccctttcagtggctaggtactgtgccaggtggtctatgtgctctatcttattttatcctcctagcaactctaggaggtatattgtattcccagtttatggatgaggaaaccaaagtgtaggttaagtaacttacccaaggtcatacaactattgagtatcagattctaacccaggtctctgccactgatgctctgctcagaacctttgtaatatactggcttcctgtgtctgtgttggagtcatgtggcaaactatttgtcttggatctttttcttggatagttttctaattctctaaatcttttcactggctgcaatataattgtcattatggctttaggtcatgatatcttagggtttatgaaatgtcatcagcaacacggatgggccatctgggtagatggctgatctcatctgtgtttgaaactttactcttttcctttgggggatcttactraaaccccttatggcctgaccacagaactattaagtattgtcctcaaaccactgtgtgtgttagccatctttattgaatgctgtttgtgaggggttgttttcataccacctattttgtcttcagaagattctgtgaggcaaggggaaattaccaaaaggaagttactgaggcatggtggctgctaaagatgtaaacaggccctcccaccccagtctgtttcaattcaggaagaatgtagtcttaattttagttgtgtgttccagtgttcatgtcctgcagacctctctgaagaatgttcctggttttaactagctgtgattccattttgttcagttatgatttagtgatgtaacagaattgaacactatttctgtttgtgcatgcagtaagatatgagtaaccaaaaaacyacggacctcataaaattaatttatgttctgattttcttttctcagaaagagtacatggagaacaagaaagttgctgtggaactaaaggatgtaccatcaccccttcatgctggctctaagctttttccagcagtcccacttcctgatattcgttctcttcagcagcytaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaaggttcgtatctttttatttcttaagttgggtgcagctgaggattgaggaatgacttttgaagtggatttatcttgaaaagtattatacatggggttgaagattctcccatggtataggggaatctccccatcagcataatttttgctggttctgaaagaaacaaagggtaagatgggagatcattcaaaaaagtagagagtcattatttttgtagtttatacttttagagcctcttgttgcaaacaagaggttggcaaagccttcgtgttctatgtttaaaggctaaagcacgatggattttttataacttacattcagcttacacatgggcccattcatgtaaggtagataactgcatgttgtctttttgcaataatgtgggaaacctgaagcttggcctcagtcacaytggtgttcaagtgagactttgctaccctttatgtaaaatatgtgtgaggtcttcgttgcagcagactcatgccccagaatgtaaagatctgaccacgtgaatatctttcttgatcatgtcaagtcacttctggaaatgaatttatgaactgatagctaatggttcttggaaagattatttgaaagtccyttttattagaggctagcaagtggaaaggtaaaacacttagagtgtattttcagttgttgtatataactccagcttctgaaatgatgtatctgacacctcctcctttttaaaaaaaatttaaaacagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttggtaaatgacagtatggcataaaatgtgcatatttaaatagctttcaatatctcatactaacattgcatttaatcacctttgaaggattccttatggttctaaagctactgtgtatgtgagtctccaattccatatcttggtagaaatctttttattattatggaccaggaagtcatttgccctttatgttgggccraggctatacacagaagctgtgtatagaaaaattggtagtatatcaggagaaataaaagtgctggaaaagacttggtgtcaccttaggttggaaatcacacttgttgatggtatactccctagaagtgcttagaacaatttactratggctgattaaaaacagtatttgaaaaccaaagagttctcagttaaaataatttccctaaaaagtagttaatgcgacgttttgaaaacatttttaaaatattaaatcagatgttaatgcagcgttaactcaaaatcaacgacagtaacagcttcaccctttgtcagctcctcagtgttggttactaccaagtaggtagataagtgtgggctaagcttgaaagtcgggtcctggagctgcagtatccggtcagttagtgtgcttgtgttcagagaagcatcactgcttaatgtcagagtggctcatgcttggaggtggatttattgtgggcttaaagttacttgacttttagatttgtcttctcctgaaaaacagaaataatctcttagagtgatactttttgacagcttgattgcttattaggtcaaccagtgaggttggtagccttaaaacttggcattcattaataatttagtttttctaccactgagaatgataggtagtttattatcttattgtaacttgccatttattttccactacaagtaattgaaaatgttaacatttcttaagggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaaaaaaaaaatttaataattttaatctacagtagaggaataagcagatatttgtttgtttgtttgttttgagacagagtctaagtgtcacccaggctggagtgcagtgacgcattcatggctccctgcagcctcgaaccctgggaccccagtgatcctcccacctcagcctcccaactagccaggatcacagatgcaygccatcatgctcggctcattttttattttttgtagagacgaggtctccctatgttccaaccagaaacagaaactaagaacccatgactgtattctgtcccttggacacccctggatggctttcaggatccagggttaggtggtggaggcttgtctcaaactcctgggatcaagcagtcctcttgccttggcctctaaaagtgctgtacgtgtgtgtgtgtgtgtgtgtgtgtgtgtgtggtgttttttttttttttagaattctgattgaaaatttgtttaatgatattgcatttgtgccaagttttcaaataaaataaattagcaaaagatcacttccaaagtactagaaataatttaatcattctttcagttatgctccctaatttatattttagttctatactggtataatggttatatatgtattatttcctttgattttcattactgctctttgaaccaggcacgtagaatatataattcacaatttacaaattaaactaaggccctgagaggtgaagaaacttgtttaagatcacttggccaggaagagcaaagatccaaatctagatttgtctgacccccagagtctgcttttaagctgaaactagaatttgggtcttttgactcttagataattaattatattgatagtccatattgcttgtctaaaatgatatacccatgttctttacaaaaaccagcaagttattattgtgtattgcaggtgcctgaggcaactttctcaaaataaacctttccttcctttggggacttatatgcgagcctgatagttttaacagaaataaatgcattttagctcccttaggggatatcctccctcctctctctaccacctcaccccagatcctgaaagccatccaggggtgtccaagggagagaatacaatcatggattctcagtttctgtttctggttgggctagtaaagcaccttccttatctctcttttctgcttattagtagggacggaaactaaaaactatggcttccagctgctaaaagcccaaaacaaaacaaaacagaaaacaacaacaaaaggcagattgcacaagcttgcatgggtagcatggacagttgacataaaacacagccttaaatcttattttagtcatttgtctgatctttaccacctcyaaattgttggcagaagctattagagcaaatttaactgagttcaaatttcacttcctatattctacttattttctgaaaggaggatgaaagaaatgcaaaaacagaagattggagatgagagcagggttagtcacaaacccagttcatatcaagaaccaatgttgagattactgagatctgttgtaattttttaccattcccaatagtaataagaatttttttctcaagaattacttattaaaatatgggcagacatcagtgatagactggataaagaaaatgtggcacataatacacgatggaatactatgcagccataaaaaagaatgagataatgtcctttgcagggacatggatgaagctggaagtcattattctcagcaaactaatgtaggaacagaaaaccaaacagtgcatgttcttgccttataagtgggagttgaacagtgagaacacatggacacagggaggggaaaaacacacactggggtctgtctgtcggggttgggggaaggggaggaagagcattagaacaaatacctaatacatgtgggggcataaaacctagatgatgggttgataggtgcagcaaaccaccacggcacatgtatacctatgtaacaaacctgcacgttctgcacatgtaccccagaacttaaagtataataaaatttaaaaaataaaaaatatgggcagaatgtgtagcaattttctagcctcagctcctgcttattcacccttattataaattaatgcaggtaaccgttgcccacatcaatgctactgcaaagaatgccgctgatgataaactgcggcagagtctccgcagatttgcaaatacacacactgctccagccacagtggttcttgtgtcaagtaagtacagaaacatctgctaatttcagctaaactcactgtgtgggaaattatcatagaagccagcaacatgtgaaagtaaaatgtatccccaaagaggctgaagtacatgagacatgtttatggttattgttgagaactgtttagaaaaaaaattgggtctaggtggatttctgtatttcctccttggaacttgagttattgtgggaccaggtttattttttattttatttttttgtttatttattttgagatggagtttcgcttttgttgcccaggctggagtgcgatggcgcaatctcggctcactgcaacctccgcctcccaggttgaagtgattcttctgcctcagcctcccaagtagctaggattacaggcatgttccaccacgcccagctaattttgtatttttagtagagatgggggtttctccagttggtcaggctggtctcaaactcctgacctcaggtgatccaccctcctcggcctcccaaagtgctgggattacaggcgtgaaccaccacgcccggccgggaccaggtttattaaagaaaaatgtgatttttttttttttttttaccttgtgctcagtattaataatttttaaagtttaagttaattttcaaatttgagtctccccaacatatttgctcctttttaatactgaaagtaacatatgtgtcttggaattcttttggtaagattgtcttacattcttctgatgtgaaacgtgtttctttcctaagaaacgrgggaagcaattttgaatatagtccagcctttcctttcttctcagtgggtgtcaatagagttgtctgtctttgtcaagtgtttctaatgtttggggatggggttggtctgtaccttttctttcagctgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccagtaagtgggtttgcgttatttttgccattttccaatattacattgtggaggctgaaagacagcccataataagggrgttgccaggcccagatggggctgttctttgtaagaggtgggttagattttgaagtaaggcttagaaacyttcggttcttctcacaaatatacagataattggtatgtatgaagtttgcttttatttatttcaaaatatcatatgaaattgacttgtagatttaccttcccaacttgccagtgtcttcaaagctagcagtgttttgtgtcaggtggatagaaataacggattaaaagtcatgattctttttgcttccaagtattatgggtagagaatatggcgagggttctcacatacttgtgtggttggcaccaaataagtggagtcaattgtgcatttttttcggtatttaatccttaagcttcagcgggcctctgagtctgtgctttctattgtgcattccctgtggtgcatggacacaattagcaggagtggttattgctccacctgtgtgtagcctgtttatgccatatactgggaggagggtgtgagcacatttccaggactagcatttctgatagacttgacttgggataagaatgtttattgcagtgctgggctgtgtttaagccgctggcgaatatgtgtgtaactctgaaagaattaatgataatggagaaggagccatggtgtgggtgatccaggagagtgggcaatcccatacgttaaatgaaagtcttcacatataatttaataactgagagttacagaagtacgttagacatgatctcatgcaaagtcttcatttaagggagaaagaaatcagctcttagaaaaagtaaacrtgtcattggtgattgcagcagttaagagagtgggccccgggtatcctgattccggcacttgcctgctagtcacctgtgtccccgatacccaacaagccccctgyggtctggcttaagttgaaactcatgctatggacagttgagagttgtggataccagaggcttacccagggagtaagcatatacaggccttaccttaatcttttgaggctctttcctaactcacctttgtcattatttgtttttagtcacttggctgtagttacatttcttcccttctgcttctgtttgacggtcacttttctaactttgaaggccttatgtaaatacggtgttttttcctgggaggtgaaggttgcagtgagctgagatcgcgccactgcactccagcctggtcgacagagcgagactctgtttcaaaaaaaaaaaaaaaagtaaatgtagtgttttaggtaagaacttgcccactttggagattcttattccttatggttaaaaaaaccaaaacaatgttttgataattcaaaccatttagttttgctggatgttttttcccatccactagagtgataatttaagatacatttctttttatgttctttagtctgttcctttaattttaataaattaaacatacattggtactgcctgggttttgagtcccaggtgtaataggaaaagtgtagattttgttgataattggtcagtacccctcaaataaaaagaaaagcctctgattagaaaagtatggtgtgggccgagtgatgtggctcacgcctgcaatcccagtactttgggaagctgaggtgggcagatcaccaatcacctaaggtcaggagttcgagaccagcctggccgatgtggcgaaaccccatctctactaaaaatacaaaaattagccaggtgtggtggcgggcactggtagtcctagctgcttgggaggctgagacaggagaatcacttgaacctgaaagtggaggttgcagtaagccgagatcacaccactgcactccagcctgggtgacagagtagactgtgtctcaaaaaatctaaaaaaaaaagaaagaaaagaatagtatggtatgatcattgtaaaaacaaacaaaacacaatatttagaaatgtggaaagtgaaaaccccacaattctaccctccagaagtaaccactgttaatattttggtattgccctccagatttaaaaaatgtacgtttaaaaaaaaatgtgtcacatatacagtgttctgtggcttttggaaaaaaactatgtcagagcttggatgtcttttcatgttaatatatattaatataaatctgccacattttaaaaaccagaactttggtttgaaaagtacttgtatggctggtctttatttaaccagtctacctgttagtggacattttgtttatacccagttttgtgttttgttttgttttttaccatttccagcaaggtaatttatatctttaggctcctgggctgacataccatagggtaatttccaaggcataagagttctgggttagaactttactagcaagatccatgtcttcctccaggaaggtggtactaatttacactcataagagtgtctgttttaaatgtttgccaggccagtaagtgaaaaacagcatcatcttataattgacttttaatctttaacacagtgcaaaatatccttttatgattatcgttgtttgctttttatttcttctgtaaattgttcacatcctttgcctgttgttagtgatttctcttatggtttctggatttaaccctttatataattatcttaagttttctcctggtgctttaatggttctgctttttaaaatattattcttatttaaaaaaaatttttttgagactctgtcacccaggctagagtgcagtggcgtgatctccgcttactgcagactccacctgccgggttcaattgattctccttcctcagcctcccgagtagctgggattacaggcgcccgccaccacgcctggctaattttgtatttttagtagagagggggtttcactgtgttggccaggcttgcctcgaacttctgacctcaggtgatcacccgctttggcctcgcaaagtgctgggattacaggcgtgagccaccgtgcccagcctctggctagttttttgtagacgaggtttcaccatgttggccaggctggtcttgaactcctgacctcaagtgatccacctgccccagcatccctaagtactgggattagaggagtgagccacaatgcctggcaatttttaaaaatttttaatagagatggggtctcactgtgttgctcaggctggttttgaactcctgggctsaagtgatccccccgcctcggcctcccaaagtgctgggattacaggcatgagccaccatgcctggccagttcgttcgttcgttcgtttgttcgttctttctctctctctctctcttttctttctttttctccagttctacttccttctttctttctttcttttttttttttttttycacagaatctcgctctgtcgcccaggctggagtacagtggtgccatctcagctcactgcaacctccgcctcctgggttcaggcaaattattctgcctcagcctctggagtagctgggattacaggcgtctgccactttgctcagctaactttttttgtatttttagtagagatggggtttcaccatgttggtcaggctggtcgccaactcttgacctcaggtgatccacctgccttggcctcccagagtgttgcgatkacaggcgtgagccactgtgccaggccaagttctacttcttaatacataaatttcaacttatctggaagaattatgactacccactgccaaataaaacttccagcctaactrctggcaatctgctgttgaagctgaacaggctctaaattgttgggttttaaaaaaatttttgtttacttaagcctatagctcctagtattcccaggcattctcctatgcaaaaaccaaccaggactgaccctgctcaccttctggctctataagttattattcagcagacctgcagaataaatagacttttaaaaaacaacttygttgagatatgatttacatattacaaaattcagctcttttaagtgtacaataatttttagtaaattgagttgtacaattttagaatatttttgtcacctcagtaaatctattatgctaatttataattaatccccttccccactcccaggcactactaatctttctgtctctgtagatttgtattttctggatgctttatagaaatggaatcatatagtatacagacctctgtgcctagcatattcttttttatttttattttttgagacagtgtctcactctgtcactcagagtggagtgcagtggcacagtcactccagcctcaatcttcctgggctcaggtaatcctcccacctgagtagctgggactgtaggcatgcaccaccatgcccagctaaagcatattctttaaaacaatattcagttactttgtcaacactaaataatttaccctctcccatctaaatcactgtcatcttctcttcaaagttgttaactgaagtttggaggtcacccattgttcttattttgaaattgaatgtgtgcccttgaattaacctgacgtaacacttctttcctctgtattagcagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggtaattttgatayctcttgctttctgaagtttatggtaggtttggtttgtttctgtgttttacgtgcccgcttgcttttggcgtgtccctttttgatttcagtgtttgatgatactcaaagtcaatcgytttctgtaaaggatctaacacatcttgggtacttaaaatttaaaccccactgtgcttgtgtctttgaaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaagtatgtgaaactactctttctcatagctgcttcttgaatgtgaaggaagacatatgaccttttgccttcaattttccccttctgttagaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctaggtgagtccagcttcttgacccatgggggtggttayatgtaataggaaggattatgaaatagtatgtttgttgaaaagaattcagatagtactgaaatgcacaaagtaagtctcccatcactcttctgccagtccccctctcctcaggtaatcatcgttaacatttaggggcaatgctttcaccatttcttcttcctccatctggaaattgtggtaagcagaggtcagaaagagaagcctgttggagagtccctggccagtgcaggggggcatgtaaagatgtccctatgttcgctgtgttgaggaaaaagcccaaacgagccgtgcattggtggttctgattcatatggttctgtataggaagctatttggaagtaaagttttctgtaaaccatggtaattatttatcactgtctctcacaccaaggaattcttgatgcttgggagacagagaagccgtaaggccgtgttgcattcccatgagctccttttagcattgtgtttgttctgctgagttggtggcagatcactgtagaaagtgactatggatcagccgggcgtggtggctcacgcctgtaatcccagcactttgggaggccgaggcgggaggatcatgaggttaggagatcaagaccatcctggctaaccggctaacacggtgaaaccccatctctactaaaaatacaaaaaattagccgggcgtggtagtgagtgcctgcagtcccagttacttgggaggctgaggcaggagaatggcatgaacctgggaggtggaggttgcagtgagctcagatcgcatgactgcactccagcctgggtgacagagygagactccgtctcaaaaaaaaaaaaaaaaaaagagaaagtgactatggatctataaaattacatctaaaaagccacataaaagttttccttatgtgcagaaagaactgtaacatgtaggcaagaacgtttaactctttcagagacacagaggaggttagacgccttaaattggtatcacaggctgatttcctaaggataatgcacaaagcagaaggttaattcatcaggactgcctctaattcctgcctttagctttaacccaaaggaagaatatatattaattggttggcggtaattaggggtcagtagatagtacttttgacaatgtctgaaatcaatgtgtatttaagattaaaaacacagctgggcacagtggctcacgcctgtaatcccagccctttgggaggctgaggcaggtggatcacttgaggtcaggagtttaagaccagcctggccaacatggtaaaaccccatctctaccaaaaataaaaaaaattagctgggtgtagtggtgcatgcctgtagtcccagctactggggaggctgagacaggagaattgcttgaatccaggaggtggaggttgcagtaagccgagatcgtgccattgcactccagcctgggtgacagagcgagactctgtctcaaaaaaaaaaaaaaaaaaaaaaagattaaaaacacatttgaaaaccaaatgtttggtttggttgtgttgtggaaaatctgcttctgtatatagtttcaaacaaagcctaaatgataaaatctaaatatacagaacagttttttaaaataatgtcaatatgtgtgttttaagcaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtaactttttccctcttgtgcttgctttgttatactctctgatggagtctctagtcaagaggacctaatttgatatacataaccacagccgggatagaagtgtgactgaacaagtttgaactccttccttttccctttggtctgctcagggtggtgctataaatccagtttttacaatgttagccccagagagcaagacgcctagcagtgaaaagctcttgtcttaggcagaaattgaaatggcaatttgtggccaggcatggcggctcatgcctgtaattccagcactttgggaggccaaggcggccagatcacctgaggtcaggagtttgagaccagcctggcgagtgaaaccccgtctctactaaaaaaaaattagccgggcgtggtggtgcacgcctgtagtcccagctccttaggaggctaaggcaggagaattgcttaaacacgggaggcagaggttgcagtaagctgagatgacgccactgctctctggcctgggagacagagtgagactccatctcagaaagaaaaaaaaaaaaaggcaatttgataagtaaaacattgatggatttcagttagctcttcctgctgaaatacaggtaggattctaaaataatgttggctggtcttgtttatgccttattatatttgactcattttttaggtgcaattttgctaaaaatgcacctttttagtagattcttaaaaatggccatgtcctgggttttgtagagtctagaaaagaccccaaacactcttcccatgtgttggcctctgagcctgccttggaaacctgtgtgtgccagagcacacaggcaggccgggccagtgtcacatctctaaaggtcaccctatcctcactttcttacgtcctggtcagcagaagagcagagttcagacatactccttcatggaagcgctgcagtcgacaaatgtgttccttcatggttcaccttcagttttaagacgacagggttctgggcggacatagcgtttagttttcgcttttcctgttgtaggtgaagagtgttgagctcagcccccatacagattatcaactcaaggctgttgtgcaaatggaaaacttacaagatgcgatcggtgcagtgaatagcctccacagatacaaaattggcagcaaaaagatcctgstctcacttgccaccggggctgccagcaaatcactctctttactgaggtaagaaacaagcaagctgtttatttcaggaaataacatttgacccagaaacaattttagaaataataaaaatagattcaatcacattcccacccccttgtgatgattgcatgtggaataatgcttattctagattgatacagttagaaacaagccatttgactcttgtctaagtcattaatcaaagctggaatacagcttaaacttgacaggcacttgggagtaaaataatacgcaacatgttcaaataggttctaaaaatagtagacccctacaataaaagtttataagcctgaaaagtctaaaatattaccttgagatcttaggtagaaggtagatttgtgtgtaaagactagatctacaaatcttcaagctctccatttgcagatatatccttagtgtcaaatagatactcagccccataagtctaccttaagactatctcagtctcaagcgtctggtgatggttttattcatagtaaaatgtgatacttctttgggtctccctgtttcggggagactggcaaaacaggacccactcctgagtgtttccttggatgatcagagatcttttttctaacttgtacttcactattacttaaattacgagttacgggttttttttttgttgttgttctcagaataaaaatgatgcttattgaagaaaatttggaaagtttagaaacataaaagaagcaggggaaaaaaaaccatccacaggyctatggcccaaagccaattgcacttaacagtttggcatcttcttttagttttgtttggattttttccctttgagcgttttttggtgcctctggttttttaaaactgtagttgagattatgttgtattcagttgtgtatccttatctatgggaacgccaatcacatatatctaacaaactgcagtgtggcaggagatatttaagctcttctcccttttgctctgaattcatcatgcttttctgctccactggtgtggaaaaccctatgattgatactaattctactgtgtaacgtaatcttctttcattgccttgtccctaaaatcctttctttaaatttttctggaaaatacattctgacataccagaaatccgtaaatttattttgcatatgcactgggttaattttatgaactctgtttatataacttgtaatatggaggaaatggtctgttccctaatcaaacttctgttttacagtgcagaaacaatgtctgttcttcaggatgcccctgcctgttgcctgcctctgtttaaatttacagatatctatgaaaaaaagtaagttaggtatattttttctttatccagtcagtactgattggtggcttacatgcacaaaaccatggtaatgactcttgaggaacttcagcctggtagaggagaggagacagagacactggcattcagatttacatgtcaatgaatgtttagcagacagttttaaaacgtcttttatttttaacaaagttagacctttggtcctcagtgttgtgcttatttttcccctaattgactagctttagtttgttttttttgtttgtttgtttgttttttaatttttttggagacagagtctcgctctgttgccgaggctagagtgcagtggcacaatctcaactcactgcaacctctgcctcacaagttcaggtgattctcatgcctcagcctcccgagtagctgggactacaggcatgtgccaccaagccttgctaagttttcgtatttttagtagagacagggtttcgccatattagccaggctggtcttaaactcctgacctcaagtgatctgcccactttagcctcccaaagtgctaggattacaggtgtgagccactgcgcctggccaagttttagtatttattggatgaacatttttaagcactagactataagctccaggacagcagggactagctctgccataatactgtatcctaagcacccagcccatagtagatgcttagcagggactagtgagtacaagaccaaggcactgcagagaaggcagaactgggcaagacttargtcttgtccttgaggagcttatgtctagcgggaagagaaaatgctcgtgaatccttatggacagtgaagaaaactgattggaaaggaggagaaaaagctttgagaacacagaggaagggaagaamaaggaacttggccattatcccacaggtaatagggagccactgaagtgctggaggaaggaggggaggggaaaggtgtggtgatgggaatcatgctgcaggaagactcttctcgtagcagtggtgtctgagagggcaggaacaggggagagaaggaggcagagagggaaagtagctacatcagtccaawttcagagcagatactgttgggacagaactcgatgttacagaaatgtcaaaatgtcaaatgtcattgaaactagagtgggtaactaattttttttattaaaaacaatttttattgagccagggtctcactctgtcacccagggtgtagtgcaggggcacgaccctaggtcattgcagcctcagactcctggactcagatgatcctcccatctcagccttttgagtagctgggaccacaggcatccgccatcctgcccagttaatattttttaatttttgtaatgagggggttttgctatgttgcccagggtggtcttgaactcctggcytcaagtgattctccctcctaggcctcccaaagtgctggaattacaggcacgggccaccacgtccagccagagtaactagttttatgtagcaagcaaggtaaaagggagaggtcattttgattctgagtgttttgccttgcatgactgggatgatggttgcacagttaaactggaaatagggaaataaagcatggcaaggaggtacagcaagtttttggtcttggttttggacattcaggttttaggggccattggagtagctgggtggagaggtcacatagtcttctgcacattgagggacttctttgggagagaagtaggctctggagatagggcagtcatttgcctttaagacgattgggacagactagagagcagataaggttgggagggggaaggagaaatagagggcaggaatggatggaatgccaccagggccagggatgtgggcgagcacccaggatgtgtgccaagagagcacatcaggaatggggggatccaaggccatgaggaaatgcatgaggtgtggggatgaggcagaggccgctgataacttttgagtcatcactacagagtcctgtggctaaaatccagkagggaaggggctgagagactcgggggtaacacagcagaagcagctcctgagcagctggatgtttccattacagggacagggtagagtacgagactgagaatgagagtacaagggagagtgtgtctctccgggaggtggaagaggaccaggggctggtttggtagatgggaatctgagcatatgtaggacactgggaagaaaacactggtcagacagtgagaagaccagggaacacttactgagcacttactatgagccaagttctgtccaggcctaaccacacttaatcctcacattgaccctgtgagataggcgctatcatcaccccattttacagatggaaaaagtgaggccccgattggtcgtggaacttgactaaggtcacacaggttgaagtggagtcaggatgtgaactcaaatctgccagcctccagggccagtgcctttaagttccaagtaagaaagatacaggtcaggaggagaactggggagtccagtgtcagagggtgtgtggatcatgcagttgaggcataggagagttgagagggtcacggaaagcacatatacttctgagaggggagaatggggatggtgagaagtaacacagagaattggaagtgaggggagctgcatcgagagaggtttccaactcaagagaatttggtgaggtcacttaaagaaactgggcaggggctgggggtggctttcaaatgaagtgagcattgtcatggtcggagccagagacgactcaggagtaccaagcatcactggtttgctagtgaatgaatttgtagtagaattattccagttttacctttgaagagatggaggaaccattcttggttattgttctttatttaaacaggatgcgtgtttctgtataatcaaagaaaaaccttctaagtcagcgtctctcttctcttgcttttaggtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcaggtgtgccgttcgtyttcctttagaagtaattcttttctataagattgtggaacatgttaggatgaccttgtgaacatcttagacccctgcggaatgtcagcttccaattgtgttctcttttcttcagcgaacatgaatttgatccagactcttacaagattccttttgtgattctttctttgaagacatttgcgccccaggttcacagtcttctccagacccacgagggcaccgtgcctttattgaggtgaaccatctcaaagcctttgtcgatataatgccctagttctgctttttataggaagcctgccctttctgcccacatctctttacaaataagtactctacaatgcttcatcctcatgtgtttagccttcagtcaaagtacagtcatgcaccacataacaaaattttggccaaccatggactgtatataggacagtggtcccataagattataatcacatattttcactagacctttcgatgattagatacacaaataccattgtgttatagttgctcacagtgtgtagtacagtaacaggctgtccagatgtgtagctcgggaaccatgggctgcaccagcctaggtgtgcagtgggccgcascatctaggtttgcataagtgcacctgatgatgttctcaggtgacagaatcacccagcaacacattattgagtacatatccccatcatgaagcagcacgtgactgtttatctgaaatgggatccattcactcagtacttcaacaagaaaatgtgtgtttgcgctacattttagaaacgtaaacgtgaggagggcagattcttccacagaggggagatgtatcataagtgctgcagtcgaaatctccacaagtgttgagagtacacagcttcaaatatgcatacatttcaagacttgtgagagaaaagtattcttcagaagttcatttaatcactccatgagccacaacagtagacttaacacaaaggccaacacaggactcagtggcctgcacgtccctgctgatgtggaagcagacgcgtaactgacttggagcccagttgccctatttttaatccccctcctggaaaactacccagaaaatgccatcagaatgcatcagagaggccagtgcctcagtgcttgcctccctgggtccttaattttaaccttcaaacctggtggtgggcattcagacaaatgattaacacatacattaaaccaaagccttctgtttagcaagcgcctccttttctgttattttgatttaacctttcctttttttgttgttttttcctatttcagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactggtaggtgtcaggtattttgtcctggagctaccacctgtccactatgagaccagaggaggctattggcttttattttaaacagcagcacaatttgccaagtgtgaaaacaccatggatgtgtcctttgatcttttgaaaattcctaaaatgcttgaggggttggcgttactggactttgttttattttttatttatttattttttttgagacggagtcttgctctgtcgcctagctggagtgcagtggtgcgatctcggctcactgcaacctctgcctcccgggttcaagtgattctcctgcctcagcctcccgagtagctgggactacaggcaccagccaccacgcccagctaattttttgtatttttagtagagacagggtttcaccatattggccaggatggtcttgatctcttgacctcattatccacttgcctccgcctcccaaagtgctgggattacaggcctgagccacagcaaccggcctagactttgttttttagatagggccttgctgtgttgtccaggctgctcttgaactcctgagctgaagatgtcgtcccactatggcctcccaaaatgctgggattacaggcatgagccaccacacctggccagtttgaaagtaccaacataagctatgtaaaaaatttgaaactcaaatttcacatttacagatccttttagcaacctaattttgtgaagcttttggcttgccagttgactgaccttttaaaaatagtttcaggggctgggcctgttggctcacacctgtaatcccagcactctgggaagctgaggtgggtaaatcacctgaggtcaggagttcaagaccagcctggccaacatggtgaaaccccatctctactaaaaatagaaaaatcaggcatgatggtgggcacctgtaatcccagctactcgggaggctgaggcaagagaatcacttgaacccaggaggtagaggttgtggtgagctaagatcaagccattgcactccagcctgggtgacaagagtgaagctctgtctttttttttttgagacggagtcttgctctgttgcccaggctggagtgtagtggcacaatcttggctcactgcaagctccgcctcctgagttcacgccattcccctgcctcagtctcctgaggagctgggactacaggcgcccgccaccacgcccggctaatttttttttttttctgtatttttagtagagacgggtttcaccttgttagccaggatggtcttgatctcctgacctcatgatccgcccgcctcagcctcccaaagtgctgggattacaggtgtgagccaccgcgcccaggattttttttttttttttttttttgagacggagtcaccctctgtcaccaggctggagtgcagtggccggatctcagctcactgcaagctccgcctcctcggttcataccattctcctgcctcagcctcccgagtagctgggactacagacgcctgccaccacgcccggctattttttttgtatttttagtagagacagggtttcaccgtgttagcaaggatggtctcgatctcctgacctcgtgatccgccygcctcrgcctcccaaaatgctgggattacagacgtgagccaccgcacctggccgaaactctgtctttaaaaaaaaaagtactttcaggtatttgaaggaaataccacttaatgcagatttaccttcgaaagtcattttggtccacgttttggactttgataaatgtgaaaataaatttaaaagaccaaggtatttggacctagacttgggtgagtgtctgagttacgggcatgtcctgagttgcagatatccaaggctgctgcccgtgaacgacactttacttgttgccttcctgtgtatacacacatacttcctcctctttgtccccaacacttttgcttctcccacctcccttaccctacaggaaaaaaggtgaggataaccaaggaattctttctgagtcagcctgctcttaggaatgtgtgtactcaggtttcttacgggacacctcctttcttttccctctgtcttagacttctcaggggccatagattatgccactcctcctttctcctaagccatgagcccacaagcctccrctttttattttattttattttattttatttatttatttatttatttatttattgagacggaatctcgctctgtgkcccaggctggagtgcagtggtgcaatctaggctcactgcaagctccacctcctgggttcatgccattctccttcctcagcctcctgagtagctgggactacaggtgcctgccaccacgcccggctaatttttttgtatttattttkgtatttttagtagagacggggtttcaccttgttagccaggatggtctcgatctcctgacctcgtgatcygcccgcctcagcctcccaaagtgctgggattacaggcatgagccgccgcgaccagcaagcctctccacctttctataaagatttccgtttgattacttatacctttttaataggtataagcagtcaagatggtgcaaaaacctgttccttacacccttttatgtcatgctaatcttacaacattatcactttctgtggttttctgggtaacgttttcagctccactatggattaattttgctcttctgggccacctacctgatgaccatttataactttgtggaaaggtacgttccacatgaccaagtttcagaaggatcttggaaatataactagtttctaaactgggagcttcttgtgtactttgacttctgctataaataacactatagtagactctgctttaccttggccgcttaactttgaggattagtgggacagcatttgacagcccgtgaataagttagttagctagttattggactatgagacctgaatatagaaactgagacgtaaagcagctactgtatttggttttgtttgcttccccatgatcgaactcaagccagggactgcagggccattttcccttctttcagctggtgaaatctgtgctttctgtcttatacacgttctttttcttctagacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcaggtaaggcgtgtcacgggattacttgtttacaggcaggaatgttcctccatggctttggctgcctccatcaaagaaacagtttaattcctaagaagtcagttctgggcagaacatccactaaaaactttcttcagagggcaggaataacacacacaggcggcttctcaatttttcagaacgctgctagtttccagttttagaggaactccttggaggactgaggagtattttccctctaagctctatagaccttcttcatcccagcacagctttctccagaactgttcatgattacaaggaagctcccatgaatagccacatacttgtatgttggtgcctatgtgagagtcaagggcttaacctttcttctaaatttaactagttggagacaagttactgggctagagtgtagcactggatcctatgaagacttttaccagttaactcacagtgttataacagcttcccactcactaaaaacggcttgaaaaacttgtagaccaatttgtctggacaaccaatacagttttcatttctgtactcacgacttttcttttcaaaagattacacttttcatttttatactcaacgactgtttgggagaaggtgtgccaggccaaaaacgataagagtttcagaaggccttggacatttgttccttttgaccaactacattttgttgatcgacatgtgtttcaaattgcacacattctacataaagggagtcatgctctgaggctagtaacgagagggtgagccagcagcaaggaagtcgctgtctgctgaggtcttatgtgtataaataaacyatttgctttgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgagttgatgaaaagaacagaaatgaaagtaaatattttaggacattttatcttctgccaaactctaaatagttatctagtatttctattaagcattcttttggaaaacttgtagtagttttttgtttttttttttttttttttgagacggagtctcgctctgtcgcccagtggcacgatcttggctcactgcaagctccgcctcccgggtttatgccgttgtcctgcctcagcctccagagtagctgggactacaggcgcccgccaccacacccggcttattttttctattttttagtagagacggggtttcaccatgttagccaggatggtcgcgatctcttgacctcgtgatccgtccacctcggcctcccaaagtgctgggattacaggcgtgagccccagcgcccggccggaaaacttgtagttcttytaccgatgatactactcattccgtatccacttccgttgttaaaacctaggtgtttctcaaaggactgggatgtcactgaatatggtgtttgtgagttgattgacatcgtatcagagattccagacacaaccatctgcttgtcccaacaagataatgaaatggtgatttgtatccccaaaagaggtatgtgacttaacatttgctggaaggatattgtctatctcctgttattttaacatagtgtggcatggaagatgtggttttccctccctgtccgtgcttcctgaagattccacagaaagcacagtgtgaaaactgctgctctttggattctgtgttcttcaaagtaggtgaagctgttctcaagaacaaaagcaggctggctttttagaattgactctaaggggaaaaaggggcatcatcagcactttgctcaaatgccttctgcagcctggctgtggctacatgagccttagtcatccagttgagaatctgtcaccgtgcctgttggctttgctcttctgttgaactctgagctactttatttactgtgcacacttgagaagggaagacaactcgaatgtttttttttcttttgcctttcaaattttaatagttgaagtcagaactgcacaggtccagttacgggtagaaagtacagtatttgagggatgcgaaactcatggatactgggggccaatttttcgtgtctgcagtttccgcggggcagaccgcaagacttgagtaggtgcggattttggtatccaggcagggtcctggacccgatcccttgagaacaccaaggggtgactgtatggtcgtatcctccttctattatctggttcttaaacggtgctcctgcagaacattgatgtccatgaaatcatagaattccagggcccattctcacttaaaaattaatagaaacaatctcagcttaagctttccctcctgtttatttttgttcaacttttgaagcctgattctctcttctgctagcaagttttaactgaagatcagatgaataaacaaaaaaagtggggatattcagaagygtgatttcatgggaataatttctagagtacttgcttaagtacagggacctgggtgtgtgtcatgttaatagatatggggcaggggctagaaaattgtttctagcttataagatgacattgtttctagcttataagatgaatatatatgaatttcataatataataatatcataacttcctggtgttctgccctggaacatgtttgagaaccacttgcaaagagggaagagtatatgtgtttgttttaggttgtgtgtgtttggaaggcaaggatgatatcgtttataaattcccaaaaggatttactctagtgtggatgttgaacacaaatgggtagaaaaaaactgtgattttatgttttttggtttttttaaaagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtgagtgaagaaattctaattttataaagtatttttctgaacaacgtataggaaatactttttcacgttccagacctgtttttctgggaagtagggagttacgaaagaggatgaaaatctaagctattccagtcagagaagccatattcctgactcattagtatttttagataaatatggctttttccttcaataaaggattattcaaacttgttttgggggtaattattgaaaaaaagattcagtaggttttcttttttttgtttgtttgtttttgttttttgagacggagtttctttcttgtcgcccaggctggagtgcaatggcgcaatcttggctcactgcaacctccgcctgcgggttcaagcagttcacttgcctcaacctcccgagtagctggggattacaggtgcccgccaccatgcccagctaatttttctatttttagtagagatggtgtttcaccacgttggccaggctggtcttgagctcctgacctcagttgatccgcctgtctcagcctcccagagtgctgggattacaggcgtgagccaccacacctgctgatttcttacactgaatatttgttcattacttttatacttttaaaatccttcgtgttgaaggtaggtctgagtacatgaggtaacatcagtgctaagctgttcgctgttgctaagttaaaccaaatttctgttgttgattttattttctttttttactactgaagtgctttttaaaaattgttttattgtggcacaatacacataacatagaacttaccttcgtaactatctttatatctcctgtccagtagtggtcagcacattcacattgttatgcaaccgatcttctgaactttttcatcttacacaactgaaactttatacccattcagtaacgctgacttgttttttcattactagctgcatactttttttgctattctgtaaacacccgtgatttgtttattttccctttcctccccccgtgtgttttcaaaggtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggtaaatgtttttttttttttttttttttttccctcatgggataaaactcacagtgacctaattctcattaggacgtttgcgtgtgctgtagcgtttctttatttacaccttgaactacttaactgtcacagcattatgactcgttttgtgtcattagtgcttattaggtaatagaagccttggtttggaagttgagagttttggtcttcctcttgtgtgtttctgaatggccttgccaaagcaatgcctttgtgaactgatgaggtcactcttcaccccagggttcggtcatgaggtgcagctgcctcagcactgctggcctgagcttgactccttccagtgtgagttttgcctgtgacgttcttgggagcccgtaatyacacagtgtcctctccctccacattctcacccacttaggagtaggcttaggagcaagcgagggtgcagagtggcctttgtcactggcagagctgtagtagagagggcagctcgtgctgtttgctgtcctggactgcacttgacccttcctgtcctaggcagagcagctgccagttttcggcctcctcccccacagraccagaagaagtcactgccaggaggaaggaatggaaagggaagcatgaaggacggcaccctcagttacaggcccattactagctgcacacatttctgtgtcatttaattccgtaaacagccagaacgggttcactctccctttccttcccactgtggggtttttttggagttggagtcttgctctgtggcccaggctagagtgcagtggtgcgatcttggctcactgcaacctccgcctcccaggttcaagagattcttcttcctcagcctcctgggtagctgggattacaggcgcccgccactacgcccagctagtttttgtatttttagtagagacagggcttcaccgtgttggccaggctgatctcgaactcctggcctcaggtaatccgcccacctcagcctcccagagtgctgggattacaggcatgagccactgcacccagcccccactgttttttaatgtattggactgcagctaagaagacgttcttaccttggcagaggtaggaasgctcagagctctccttaggtactgattggttggaggaggaggtgagagagcaggaagcacaaccaggagagccgaacatccctgagccaaggcagaggaatggccagcagcatcgcaggagggctggtcagagagggactgcctgacttccaggtttagctcagtgggaagagtcggtgctgctggccaggtcagtggcagtgttggttgtgtagacagaagccaccttggagtgtggtgaggagtgaggagaggtgagaaaatggcccaggtcatctggacagcatcctggtttgtctgcttgtgaagatggagggctgtggcagcagctagaggctgtggggctgagggagcaagggaggatttgggctgttggttttcctacctggaaaaacttgagcatgtctgaaagccattgatgtggatctgtctagagagagaagatgaacatacaagggcgagaaggggtaagacaggagggccttgaggtgtgggagactaggaaacagcacacagaggaaggaggaagtatacagggcaataggctgggggcaggcatgggcaggtctgatgtttatcatcaggaatagaagggagtcctcttccaagagtggttttccactagagagagggactgatctctgcttagagagagagaggagaggcagggctcaggacttaggagtggggagaaggtccacagttgtcatggtgagtggagagtggcttgatcaggatgtcacgtggagtgcaggggtatcgagagctcactgcaagttggcaccgtagactctgggagagcagcagttggggtgtggctatgcaggtgtcggttcagggaaagcaggtggttggattcaaggtgggagtttaccgatgggcgtcaggaaaaggcatgggatgagcgaatttaaatattgacaagaatgtcagtgccagcatgacaaaagaggagagtgaagcaagggagtgggctggcaaattgggagcagataggaggcagtgatgctgctgaggtttgagaaggggcggagttgagcgggtagagtctctttctgcactcccaccccaacagcagctccagacttgcttttgcaagtgggatgctcaggaggtttgaatgatttatgttggatggggtaatgacaggtttgcactgtgaccctggagatgggtgtctgcagtgaaattgaacacaggaggatgtcgtcggagatgacagaggcaaggcattgaaaggctrtacggctgtggtgtgggacaggtccctgggtgttcagttgcccaggatgatgaaaggggtggactcaggtggataggaagaccccacgccatgacctagggctttgctgggtgagtgtgatgggtgggcagctggggtgtgagcagcaagaatggggagagctgagagaggctccgtggtgcctccctggctgcccactgggtctccygggagcttctccaaccttacctytcagattcttatagaattagtcccagcacactctgagcattggtgtttttaaaagctccccaggcaattctaatgcatagccgggattgagaatcaagggatggatccaagtcgcaccagaggagcaggctctggtttggtttctttcctaagcagctgtagtgatggtgggggtctgggtggmtaagatgactgggatcccctggacttgtatcggttggttgattaaacccgcttctgaggaggaaatctatacagtcccataatcatgataagtagggtgggaccctgccagcctccctcctgccttggctctgggcacatgtcagaaccagataaagatgccctggtcttgggatggctcctcaagtgccacccacctctctctgcctctcagaatccacggtccaaagagtgccaacwtgtggtgacttagccctgccaagacctttggccctggcaggaaaaccagataaagggggcaaacaagctgtcaggatgagcattggtttgtgagagcagtgccggagccgtgtgtgtgccaaagctctgcctgtttttgtgccaggaaaggctcacgccacagcctcaccctcgccacccacagcctgctggctcagtcaccagatgcgtgtttcttcacatggtgtttggtccccaagtgacaatctctgtcttttttgtaaggtttccctctcagcgcatttaaccgcttaaaccctttatctccttgagaatctgaaataattgaggagtggacagttactagtcagatgaaaataccagctttgtggtgagtaatagcagactagaaaaatgcagcttgccttgtaatcagagtaggccctctctcacctccccagcccgccctggggacgcatatgggcaagtcgggtctgcacagaagccatgtgagtgttgcttagagtctagcctccccatccctaccccccttcgagcacagcaacccacacttcacaagcttggaccactggccatcagctggccagtctgtgtccttcttatagtggggtttggaaagaatgaatgaaaaataaagagaatgatgcaatttcctcccccattattatcttgttgagagttttcagttatggaccggcagggggaggacagtttctgcttccatgttggtctggtgtcccaaagacgctaaaaacaaacccacttgctttatttcagtgtaagagaaaaaaattagagatttttcatctgttggtctcattaaccaaaatgaagtgagctgagttgggtataacctagggtgtctctcttgagctctgaaaagtgtgaattctcgttttccccaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggtaggcacgttaatggctctttagaactatcattgaaaactatcgattgggcatttccggattacctgatggtctagattagagtgtgtagagctggaagggacccgagagaccatttcatggatgaacacgccgagacctcaggcagtgaagcagccctgcctaaatgggtggcagaagccagtgaaagcctggtctcctcatcctggcactggggtgtgtttgtcccrttctaggatgaaagcctggtctcctgatcctggctctggggtgtgtttgtcccattccaggatggatttcgctactgttttatctttctgaatgagatggtttatgtggtggcttgaagagagagatgagtaaggtgagggcagaaaggaaggttggccagccagtcccccwggcagcctttcaagaatggcgctccaagattgagagaatcttaagagaatactgcatgcaattctcgggcgacagatataaaaacctagagtaaataaatgaaatcctggaaaaaataagttaccaaaattcactcaagaagttaaaaattagaccaattaccataaaagagactataaaagatcactgaaatataccagtgaaaaaggcatcaggaccaagtgagataacaattgaatttcaaccaaccctaaaagaacagataaatctaccttttaaaaaaccattctggggcccggcaaggtggtacacgtctataatcccagctactaagaaggctgaggctagagaatcacttgagcccaggagtttgaggccagcctgggcaacatagcaagaacccatccccaagaaaaaaaatactgttctaggctgctgaaaaagaaaaaaggaaagcttaccatttatttttacgaagccaaaataaatttaataccaaaaacataagatagtcccttaaaatgatcctaaataagatattaacaaatgagctccagcaatttaaaagaatgatatgccattatcatctaactgtgggacacatcattaaataatgaaaggatatacatccagcattttctaaactctgttaatatctatcctaagaacaccagttctggacaggtgttaatgcatatttcaggacaaaggactttccctgtccagctaagattgggaatatcctttctcttggcgattccatagcatgttaaacactttgaaaaggtttgtggtaaagaaatctgcttccttaccctgcatacacaagggttttgtgtttgtttcttgttgcttttgatgtgtttttaaagaatgctagtgtcatcctcttatcacagtgtttcttggaaaactggtttggaggtgcagtttaatggccccagtgttcactgtgtgtaccgtgatttgccaacacagtttgcctcccccgatttcttccctactcacacactgtctcttcagaccgctgcagccttcgacttgcaaatagaactgaagtttgctggaggctatagccttctcttggaggaaatccttgaatatatccctcctccttttctttctcctcttccttctttcctctcctccycctcctttcttcttctttgtcttttttgtcatcttcatcttcttcatctttgtctttgtccaattcgtcgtcttcgtcttctttatcgtcgtcttcgtcttcttcatcgtcgtcttcgtcttgtcttcgtcttcttgttctttgtcttcatctttgtcgtctttatcttcgtttttgtctcgtcgtctttgtcttcatcttctttgttgttgtcttctttatctttgtcgtctccttcttcttcgtcatctttgtctccttcttcatcttcatcttctcatcttcgttgccttctttttcttctttgtcttcgtcttcaactctgggccttttccctcagtgggagrccttcactttccacggggcagggccagtcactaatatttctaatgctgcgttttctttttaaccaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtgggcatttttctcagcttccgggagagcatcttctgaacagccacaggctaactgtcctgaacagaaaaataaaatgctgccagaataatggaacggcaggcattttgaattgatcctttcaaaacatactgttggtctaaagtaaatgattttagcatttctccttgatyctttctgtaaacctttattaaatccctrtatgccaggtgagtaagtttcaggctgtaactctagaaaggtgttggttaatgggagagtcaagacccccaagcaggcaactagtcagggcggtcagggcagtgggcgcgctgaggagggccgtgtcagggcccacttcccaagcctggggagcctgttgcaaaaccttcaaggatgtgcctgagggaagcacgtgacaaggaggggagagagcattctgggcaaaggggatgatgacatgagcagatgcagggttgtgacaagtggcatggagtgtcgagaggctaasagggagctgagagctcggttagggagggcgtggctcctccaggtaaggagggaggactgtgttggagagagctggagcccaggtttgcatttgaaaagcaccccagtggtgctgtccatggtagagccgagagaagcaggcatggagaagggaactgggctaggatcctggccactgcagaggtctgggtcagtgttagatggagggattgagccagagtaaaaatagtagaatagaggaagtaggaaggacccaggcaaagcttgcctgggagctgagatcagtgacctggcgacgghgtgcacatgtagggggcctgggagcctagctccactactaccactctgcttggctgagatggagagcggcaccatcagggagaggactttaagatgctgataatgaacttagtttaaagggtctgagagattgctcttaattcttttaggtggttgttcagtttctgcaaaaaaatggcaaagagctctcatgtgagaactaccttaatttatatgccaaagctggtgtttggaagacagtctttttaagaattataaaggatatttctgaaactgtgtctcatgatttttgaactactctgctttttataggggtatgtttctgtcagcttctgttgctttaaaagctaaggagagagtagagaaacatgcttcttggcagtaactcagctcctaaattctagcctaaggcaggctccgtaggtcacactcttcctgaatgttagggcttctgtcccctccttttccgctgcttaaccagtagtatgtcttgtgtgcaggtggtctggataaaaggacatggtcataagagaattgtagtgttaaaaaatgacatgaaaagtaagtaagcacccatcccctccccccttaaaaaatcacggttctctcactgacatttctctctgacgggtgctctttgtcctgtaggtcgtttgagttcactcagtctctcccctgccaatcatgaaaaccagccctcggagggcgagcgcatcctggaggtgcccgaatcgcacacagcctcggaactcaagcttggagctgacggcagtggtaagagaggaaaagcagagacataggagcttgtgaaattctaggagaaacggctttggggtcggggagagcgagggaaaggactccagcaagtcatccaatctgctgaagttacatagccacacatttttcaaagcagttttggtatttagttagtaacaggataaaattgacctttatctgttagcattgcatggttgactggttaaagtccctgaaggatgttggcacccccataatgatcatcttaccccagttcagatgttgaagaaaaaaattattccgacacttattataatggatattcatgacacttgcaacaggggagagagagccaactcccaatacatagcctaggagcagagtgagggctcagtgggtggaaaattactaagaggattcttgctataggcatgcaggccagccaaggatctagacatcagtggttgggaataaggaattcgatcagctgtgaagggtgaggggattctcactaaactgactcaagctaagactctagagcgagccggcaagttcagcaacagacatggaaggccaaggtcaggcctgatccggaagagggctcagggtgcctgactcatggctggtcaaggcgtctttgtcacaggacagccctaggcaggatttgatatactaatgcattaatattacccaaaattacactgagtcacatagatttcagatagatccacctctgtagtagatagaggccaattcttggaatgttatagcagttctaacttttctgaaggacttttgaattcatcgttataggtgagaattttgtcttcataacatgcggcgagatagcacgttaccgtcccctgtgcccttaggataactgagttacacagcatttgacgttttatgaagcgccctcctgggaatcatctgccgaagctgccccacagccttcagcagtgctgacctccgttgtgcagcggaggctcggaaatctcaggcagtcacgtattacagctcacccagagtcagcagctaggaagccacggaaccaggcccagggcttcggattctgagcttccacttgctgttaactacgtacaccccgtctcaggctgtcccttctctttggaagctgactgcaggacccttttctctggttgggtcttttgaggggccagtgttcctaagaacacggatcttcagaagaactagcttawtaaggcgttccattaccaggatcttcctgttagtgggttttgggtttttgtttttttttttttttttttttaataccttaaatacttcttgactctcttatctttaaggcttagaaggaaaacttcaggtgtgagcccagggtgtgtgctgggggtgggcgtggaggtcctgtggtgtcacggccctccttgtttgcccagggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctggtgggtgactccatgttgtcatggggattttcttcggggtttaaaacaaaaccacgatgaratactgatatagtaaatgacggaggtgggaagggactaccccttttcaggtggaaaacactgtgctgattattcgaccttctttccccacctgggttcctgcagaatgggatgcacagcctgaggttgcctggcgagcatcaggcaagggcgatttggcagctctggagggctggtggctcggggctgtgggcgagtccacaggggtgggtggggcctcctgggcttctgctctcccagactttgtgaaggttcagctgctctcaggcacacctgtcaccagatgtacacgtcacccatggtgggggtccagagggcccaagggctttataaaggggtgaatggagggaggtgtctgtggctggagccccggactctgcccagtgatataacagacaggaagctgagcacactgagtcccagcctagtgcaggcattggcactgaccctgtgctcagggctgacagacaccatcacatttaactcttaccacggctccaggtgagagccgtggaataaaggcagctgctttattccacaggctgcgtgactaaggcacagctggtgccgtcactagagaggcagtggccccgggctgctgggctagcaagggcagagccggcattggaacccaagccctcttgtcctgcggtgtctcctggcctctggagaggatggcccatctgccctgtacagatccctccctgctcttcatctgttggaacccaactcctccccactgctggtgctgctttccaggtcaccaggaacaacccgtggactcctggcttggcttttaccatcttggttgttcttggcagcgttcagcactgttgcccaggaaaagaactgaggctgttgacttggaaaataggagatggggaagtaactgcctgcggatagaaccagcctgtgcagtcagacctagaccatgccctgctcctgtgcagtgccccsctagggttggtggcacattgatgttagctcgtttgtggggttgtggcctttgtgccttcagtctgggcaagttcaactgcatgcaccggacaagagaggaaaataattaaaacactgtgggcagttstgtcagccrctcttctcttgagggtcagcctaggcagggagctggctctgctgtcccctctgccactctcaccttccatgggcctttgggagcaggagccctgtgccctatgcagtgggagtctaaggcataatgatgcatctctttcaagcagcgtggccctgtgtgtagagcaggtgaattacatgtggctcagccacagaaatggcagtccagaagcactgtgggaaagctggctgtgctcaacttcctgggttctgagggtaattctcactctgcgtagtccttccttatccccggtaatagacccatggggagcataggtcctctctaaatggagcaggccaggagctccctgacacccagatgctccgaccccaccccctaccacccacggcctcccgcctcaggaagtctctaagtcgtggatagctttatgggtccttaatatctggcaggcagaatgaatgggcagagaatccaaaatggaaaaacaaaaagttttaacctttgctcattcatttatagctcaaaatagagatctttccaactttgtaatccagtgggagaggtgggatgcagtttatagatacttgatttctgtgccaagttcactggccacacaactcatatgtaaactgtggcatagatgtagcatttagaagctttttattactattattatcttttgagaaaatatgagcaaggaagagaaaacccacacttcttacagttcctggatctgaatctgtttgcttttctgtgtttacagaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcaytggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatkaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatctattttgagtttcccaagtgagtggttttgtctgtctgtctgtctgtggggaggaattacaaaccaatacagttctgccatctttcattttgggtctcctcaacttctctccccttctggaaatagaattgtgaggtggagagtaaatccgtctacatcttagaggccttttaaactcagcacacgccgaagcaggtggctggatggtgggcccttcgtcgtcaggatcctccaagttttccagcctttgttccagcttataattacatgtgggaaaatacagtaaccacaaaaaccttccagttagaaaactctattaattcctaggctctctcttcttgtgaaagaaatccagcgtgcccgctgtctcgtttttggtcactgctaagcawgctttttgaataagccaatttggaaaagagttattccacagatacagttgtgaagccctcccatcccctgagaccgccattaccccgtcacccctgccrccagcaccctctggcaagaatttaaaaggacccagaagagacttgagtaaattgcttcttgatgacatttttttcaagttcagcaatgttaaaagctgctaaagacctttccaaacatttcacgatggcaaatttgtgcagaaaaagttgagtagccatcgtgccccttttgagcggcgtcaggaggtcttgttaggtgtggactggggctggaacggtggctttgcatttatctttgtttgtttcccacctaggaaggtgattcagaggtgggggcctagaagacagctgtctgggggagagcagacctgtccgtagcagagggggctgcgctgattgaagaagatctgttccctctctgttccctttgccagaaggagcgttgcgctttgggattcaccttcactttctagctgcttccatgggcagagggtgagtcatggcgcagaagccctcagcggcctccacccacctgctgtccccattgctgggggggggggcggtgggcggcaaaacttcctcaattctcctagtgtccctggctgggccttaaactgacaaagacattaataggaaaaaagcaaacaaattttacttcataccagttttgcgagagtcttcataaggaaatgaagaccccagagaaatggctaagcctgagtggttttttgttttgttttttggttttttgagacagtctcactctgtcacccaggctggagtgcagtggcataatctcagctcactgcaacctccacctcccaggttcaagcgattgtcctgtctcagcctcccgagtagctgggattacatatgtgcaccatcacactggcaaatttttgtatttttagtagagatgaggtttcaccatgttggccaggctagttttgaactcctgagctcaagtgatcctctgggctcagcctcccaaagtgctggaattacaggcatgagccaccacgcctggctgagaacgctttttttkggggggggggggggcggggggaaaagggctagagagcttagaaggtgccaagccagagcaccaagagccagaactttccttagcaagatgaagagaagaatacacacgttccgggaaggaacgmcttggaagtgggggagctgaggtgcagaggaagaaggcattgcagggtggaaggggccgttcttrgagggaaatcctgctcagtggctgggctgctcagctcctcactccgcacgaggtggtgaaccaaccaggagcatccgcaggggagcagtaccagggccagcagggaacatattgggcctgcttggcaccgtctcttccatccgcctcaggcagctcatgtgatggcctccaaaggcttcccaggtgcagggcctgggcatgagggaacccccgctcctaccacccacctgcccccmctgcagtttctggtatcagcaagtgcagacaaatccacactggggctgcagggtcgccgcccttggtatttcagcagccagagtctgatgcatcaagggcaggtgtggcaagaatcaggaaatacattttttttttttttgagacagagtctcactctatcgcccagactggggtgcagtggcacgatctcggctcactgcaacctcctaccgggttcaagcgattctcatgcctcagcctccgaacagctgggattacagatgctgccaccacacctggctaattttttttgagacggggttttgccatgttgctctggctcgtctcaaactcctggcctcaagtggttcacttgcctcggcctcccaaagtgcggggattacaggcgtaatataatatagatattatatatagatatagatatagatgtctctataatatctatatataaatagatatatctattatatataatagagatatmtatctatatataatatatagatatctatatatwatatatagatatatatctatatatwatrtatagatataatatagtcacacagtcaaccatgcccggaacccccaagcccccactttttttttccgagatggagtctcactctgttgcccaggctggagtgcaatggtgcgatctcggctctttgcaacctccgcctcctggtttcaaccgattctcctgccttagccttccgggtagctgggattacaagcatgtgccaccacacttgctaatttttgtatttttagtagacatggggtttcaccctgttttttaaattctctaaaaggaagaggacactttttttgttgttgttgttgttgtgttgtgttgtgtgtgtgtgtgtgtgtgtgtgtgtgtgtgtgtgtgtgttttgagacaaagtcttgctgtgtctccagactggagtgcagtggcgcaatctcggctcactgcaacctctgcctcccaggttcaagcgattctcctgcctcagcctcccragtagctgggaccacaggcgcccrccaccatgcccaggtaatttttttgtatttttagtacagatgggttttcaccatgttagccaggatggtctcaatctcctgatctcgtgatttgcccgcctcggcctcccaaagtgctgggattacaggcgtgagccaccgtgtccagccctgtttgcttttaaatgggagagacctgtttaaatccctccgatgggaagagaaagaacaattggggctacagtggtggggagggagggagatgaatgatgactctgtcactaacaacccctgggaccgtgggcagtggatttactgccacttcctcatctgtaaagtgagaagtgataacaggatctgactcactgtttcaagtgtttattctgcctccgcttgcaacctcttgcaacctccgcttgaaaagggtaatggatttactgctacttcctcatctgtaaagtgagaagtaataacaggatctgactcatcaggctgatgtgaggagggaaccagccagtgtgagcacattgctcaaggcatagagataagctacaataaatgttattcccattatcaacctcctccatggcttctaaaaggagcaagtctaggtgtgcaggaccccacagtctgcaaggtttcccagcttggaaggtggccctggtaatctggaagcgtctgtgacagcttaaataaattggattttttaatgttttctttttttaaaaaaatcagtaggaattacaggaacatacagtaggtgtacccagagcttagcggaagtaccagaggcaggattttgatgagggtttgatctcctctggttcgttggatctgtgagtgactgctgtataactggcctgaggtcagacctcgctgacccccccactcccctctcccctttttttttgagatggartctcgctctgtcgcccaggctggagtgcagtggcacaatctctgctcaccgcaagctctgctcactgcaagctccgcctcccgggttcacgccattttcctgcctcagcctcctgagtagctgggactacaggcgtccaccaccacgcccggctaattttttgtatttgtagtagagatggggtttcaccgtgttagccaggatggtctcgatctcctgaactcgtgatccgcccgcctcggcctcccaaagtgctgggattacaggcttgagccaccacgcccggaccccccaagcccccccttttttttttccgagatggagtctcactctgttgcccaggctggagtgcaatggtgcgatctcggctctttgcaacctccgcctcctggtttcaaccgattctcctgccttagcctcccgagtagctgggattacaagcatgtgccaccacacttgctaatttttgtatttttagtagacatggggtttcaccatgttagccaagttggtcatgagctcctgacctcaagtgagcctcccacctcggcctcccaaagtgctgggattacaggcatgatccacagtgcccagccttgacccacattttttatggggaaaagagggcggtgggccctttgcagcctgagttttcactgcacgttggagcgggaggggtctgtggtgggtggaattgggtcctccccaaatgcatgtctacgtggagcctcagaatgtgaccttggttggaaagagggtttttgcagaagtaattaaggaaagggtccaaatgagatcatactgcattcgggtggccctcactccratgactggtgtctttttaagatgagagggtgcacagaggcacatatacagcggaggcggccacgtggagacagaggtgaagactggagtggtgcagccagggaactgccaaggtgccaggagccaccaggagctgcaagaggcaaaagaagattcttccccacagagggagcagagcaccgcagacaggttgatttcaggcttctggcctttaggactgtgaaaggagacggttccactgttttaagtcacccagtagaaggtcattcattatggcatccccagtacacgaagagtctggcttcatgattggtctaggttggtgaaggaggacacggggtccyctgaggccattgtggtggcactgagtagcccaagggacccttttcagcatcagaatggtgggaagtggtgtgcagaccaaagccgcgaacacgcagagtgggaggactggggtctagcagcctgctgggagggcctgtccaaccaaagaccttttgatctacaaatttttttttttttttcgagacgaagtctcgctgtgtcacccaggctggagtgcagtggcgcaatctcagctcagtgtaacctctgcttcccatgttcaagagattctcctgcctcagcttcttgagtagctgggattacaggcacaagtcaccacacccagctaatttttgtattttttggtagagatggggtttctctgtattggccaggctggtcgcgaactcctggcctcaagtgatcagcctgcctctgcctcccgacgtgctgggattacagatgcgagccaccgcacccagccaatttacaaatattttgaaaatgctacttatgaatggcccaataattttacttctaggagtttatcttaaggaaaaaataaaaaattcagatgaaaccttatccccctagatgtttatcaagacactatttttttttyccagggggtgcgatcttgctctgttgcccaggctggaatacagtggtgtgatcatggctcactgcagctggaacctcccaggctccagcaatcctcccacctcccaagtagctgggatcacaggcccgcgccaccgcatatgcccagctatttgtatttttagtagagacagggttttgccatgttgcccaggctggtctcgaactcctggactcaagcaatcctcccgcctcagcgcctggcccaagacactttttttgtttttttttgagatggagtcttgctctgtcacccaggctggagtgcaatggcacgatctcggctcaccgcaacgtctgcctcctgggttcaagtgattctcctgccttagcctcccaagtagctgggattacaggcacccattaccatg

SEQ ID NO: 13441 - DNA, 13242 bp, Homo sapiens
  misc_feature (1)...(13242): n = A,T,C or G, or insertion/deletion polymorphism (see Tables 1-2)
aggaccatcccagtcagtgaggaccatcccagggagtgaggaccatcccaggcagtgaggaccatcccagggagtgacgaccatcccaggcagtgaggaccatctcaggcagggaggaccatcccaggcagggaggaccatctcaggcagggaggaccatcccagggagtgaggaccatcccaggcagtgaggaccatctcaggcagggaggaccatctcaggcagggaggatcatctcaggcagggaggatcatcccaggcagggaggatcatctcaggcagggaggaccatcccaggcagggaggatcatctcaggcagggaggaccatcccaggcagggaggaccatcycaggcagggaggactatctcaggcagggagggccgtcccaggcagggagggccgtcccaggcagtgaggaccatctcaggcagggaggaccatcccaggcagggaggaccatcccatggaagtaagggccatctcaggcaatgaggaccatcccagggtggtgaggataattctggggcagtgaggattattccagggcagtgaggaccatcctggaccagtgagtactatcccagggcagtgagaatcattcgagagcagtgaggagtatcccagggcagtgaggactatcccggagcagtgaggaccattctagagctgtgaggactatcccagggcagtgaggattatcctggggcagtagggactatcytatgacaatgaggaccatcccagtgctgtgaggaccatcctggggcagtaaggaccatctcagtcagtgaggatcatttcagtcagtgaggatcatcctgtggctgggaggaccaccctggggccgtgagactcataaaatacctgtgaagatcattgcaggraaggaagaaaccattctgtgacaggtggaggggtccctgggataaagtggagcgatgggtcccaggagtggtgagggcagggcaggccttccaagcatcctggctgtgctcatgcaggcaggagatgtcacagcactgcttctcctcccccagaagtctagctcagaacttggcctccggcctgggcactgcctcatacctgccagaattgatctcaatggagctgcacaatgagaggttttgcatgttgtctagaggactttggttgagttcagagctgagcacacttgccttcagactctcctgggactcccaggtaactgattcaatgcttttgatactgggctcgggrccgtaggtaagtgatgggagcacattgacaatggcccrggcttggaagttgggggttggaacacttaaatgggcagtctcggttgttgacaggtagttttggtcatgatmtttgttgctggggataattgatgattagtcagggggtgagagccttggatactgaagcagcgagtttggaaaattggtgaagcacctcgcatactgaaatcgtggctgtaggtaatggctggtgtttctgggatactgatctgttgactgctgatagctggtgtagggtcttggatactgacctggtgattgtgaataattggcaaggggtcttggatactgaccaggcgattgctgctggctggtggaggctgttggatacygaccccgtgactgttcctggctggtggagggtcttggatactgacccgggaattgtaggtaattggcaccaccrtgcctggctaatttttttgtaattttagcacagatggggtttcaccatgttggtcaggcgggtctcgaactcttaacctcaggtgatccacctgcctcagcctcccaaagttctgggattacaggcataagccactgcgcctggcccttattattattttttaaggtatagaaatctagaatttttttttttttttctgagacaaagtctggctctatcacccaggctggagtgcagtggcatgagatctcggctcactgcaacctccgcctcccaggttcaagccatcctctcacctctgcctcccacgtagttgggactacaggggagygctactattcctagctataattttgtattttttggtagaggtagagttttgccatgtttcccaggctggtctcgaacttgtaagctcaagcaatctgcccaccccagcctcccaaagagctgggattacaggcatgagccactgtgcccagccttagaatttttaggtagtttaatttcttcacctttgtctctgtgactttattaattgcttcttggcttcgggaggttctccctccagatttttgatgarcattcagttctgtttttttaaattctcattacttatttttaggttttgattgtgattttggagttggtatgcagggaacattgaattctgtgctccctgctgtcctaaggaagggacttgaattagtcaggagtttttgggtcacaagtgacacaaactctttttttttaawttttttttattttttacttttttaaatttgagatggagtttcactctttcacccaggctggagtgcagtggcgtgatctyggttcactgcaaccttcaccccccgggttygagygattctcctgcctcagcctccggagtagctgggattacaggcgcccgctgccatgcccggctaacttttrtctttttagtagagacggagtttcaccatgttggccaggctggtctcaaactcctgacctcaggtgatccacctgcctcggcctcccaaagtgctgggattacaggtgtgagccatcgtgcccagccacaagtgacacaaactctaacttgaactagcttgagtgaactagttgtattagcttgagtgaactaacttgaactagctaggggatcctttatgggatcacctgagtgaaaaatggtaatggtaggaatgccttcaggcatgggtggatccaggggcccaagtgatagtatcagatattactgttttttggctatgggattggcttcattctcaaggctctgtgtagtggcaagtcagaatccagtaaggaaaataaatcattccagattcttcagaaggaagtaaatacagggaatttgttcgtgagtaacagaggagctgagaagccaataggaaatagtgaggcaaaccaggagttaggaactacaggatrctgctacttggccagaaggacaaagggaggaggtggtattactacagtccagaaactgcagccctctggaasgcataggttcatggttggattgctcagaagtggctagaatcagagaatagatacaactactackgaagacccaccacatgcagagatagagaggctrataaataccctggcttgccctctcctcccagaaccagtcttctgccagtgcctcccattagtcaaacacagtgataagatggtgagcaaaggaggctgggaaatgtggtccttgcagtgcagaacargrcagggygggaaatggatctgagagcagacagacaaaaaactggyagagttgttagcaacttggcagagttggtaataactgcygagtccggtagaaaaaagttatcaacagttcttgcaagaatcctgtgtggcttggggcacatgagcaccccgagccaattatatggccagtggagtacagttggctgattggcttawgactggggctgagaatggggaatgggcaggaggtgaaatgcatggtggggaggtaagctgcaaatatccactcattctgaccaaatcacagagtgggctgctctctgggatgacgagagccagggacttcagtgtcagctcaatgctctttcgcttgtctgttttccttcttagttttactctccccatgargctaggtccaaggcttaggcagcttcaggcttgtaatccttgaggagagactgctyttccttgacagcttcctaataaaaagtcttggggcagagcttgattggttgggctttggtcatgtgtccatctttgggccaattgcagggtctgcagctrgggtactgtgattggctcagccagaatcacatgattacctctgtggcccagaggccagcatatgccaggagaatccctcatccagggttatgtgagttgggtggagggtgtccccaagagatgtcaggctgctgttctgggcagaccaaattcaccattcaaggtcttggtttctggcttggtgccttctccctgacctctgcttcttgactcttcaatgagcagaaagaactaagggaactggctgggcatggtggctcacacgtgtaatcccagcactttgagaggccaaggagggaggattgcttgagctcagtaatctgagaccagcctgggtaacagtgagaccccatctctaygaacaaaacaaaacaaaaacaaaaaaccaaggggtctgatatttcccccacttcccagagtgctgttgctsttctgtatatatgatgatcctttatctttcttgttgggtattagagatgtgcagtttgccagaaacaaagcagatgaggtcttggcctatttggctaaaacaattttgcactgttgaaaagtagacaaagtagaaaaagggctaaaaggaggagatgtagcatctcggaaacaggtawacctctcttctgctggaagtctaagttggataaatatccactgtaaactggaactaagcttttgggcacattggttttagagtatttgacttgaaagtttttcttgtgtgcaaatctgtatgtgttttgtgggggctctcaggtgtgaacaagagatgacattaggatgtctgaggagattctcggcatgtgaatggggccactaggggaccttggggggtgactagcagagactagagcagaagtagggtgactttggagaggactggggtgaccgtggtgtcttggataactttgagggtgctgttgagggtgtctgggagtgaaactgaggatactaacatgagttgttatgagacaccttttaggagttcaagtagggtgaccaggggtgtctgtgggggtggttctagaaatgatcgaggctgggctcagtggctsacgcttgtaatcccagcactttgggaagccgatcacctgaggtcaggagtttgagaccagcctggccaacatggtgaaaccatgtctctactaaaaatacaaaaattaggctggcgtggcagcagctgcgtgtagtatcagctaatcgggagkctgaggcaggagaattgcttgagcccaaaggcagaggttggagtgagccgagatcacaccactgcactccagcctgggcaacagagcragactccatcttaaaaaaaaaaaaaaaaaaagaagaagaaagaaagaaatgattgaggtgattctgtggggtaaccttgaggatgagtgggatgacctttggggggtcctctgtggggtgaccttggggggtgtgtgggattatgagagtgtctgagaattgagttttaggttaagtaggggtgatttgggacaactctaagggtgtgactgggggatgactttaggggtccctgggggtgaccttgtgagtgagattggagtttctttggggtttctaggaggtgactttggggaggtgagtaggggtgattttgaggatgtgccagactttggggttgtctgttgggctgcttgtgggtatcagcagagatgactttgragggtgaccaagaggggtatctggggktgactctggggcccctgtccccctctccccagttctcatccatatgagcaagggcttcatgttactggccgtggccctgtgctgagtcctcctccygcccatggccctctcctcctggccagtggtcctccgcctgaacatggccgactttgtcttcagtttcctctgcctcggcattggtaggtgttggcttggggggygggggccctccctaaccccagccctgctctctggctttctggaggtgtatctagacttccgtgctgctcccctcrgggcctctgtcttagcatgtctctggggagctctgactcagttctactctatctgtgggatgtctctctcccccactctctgtttccctttctttttttgtcccctctctccrggtatctttctgtctgttgtgagggcgtgtgtgtgtgtgtgtgtgtgtgtgtgtgtgtgtgtctgcttgtcacggagggtgggagagratgtctcagtccctcttttcttactgggggtcatagggctcactgtccagccttctgtctctggccccaccccattgcagggctcctgatttctcttcagcctgacgctcttttcagttaacggcaaggcggtgcacccaagtccggtggtgtcctacctggtgacctcctacytgtgctgggacgccagcgacttgatgctgcactccggtgagggcggggcctcgggaggagggcggggcctcgggaagcgggtggggcctagggtgggactcggagtacagcggcccacctagccatctcccaggagccgtgtcctacctaagcccagtgggcatgtgaagcagagggcagcccttgaatgcgcggcggctgagctaccgcgggtgggccgtgcagcagggcgcagcgaggcggacatccaaacagcggaactcagacrctgactccgagcgcaccccgggccttcccatttcatacacccwcgaggatgagacccaagcacctccaaggaatagcacccgaggtcttcaggacaccgaccggtagccatggccagatgcccggccaaccccttcagcgtggccacgccctggatattcgacctcccctgaggccccaccccctgatrtcaggccacgccctccgaggggaccggtggcaaactccagccctcgctctagggcccgccctttgcggctttgtccctgcccactgggtcctcacagtrcctccaccccagaggcccagcatcccctcccgttctgcagacacttgtccagcgtcccgctgagctcggcagtgtggctagtttgtgtggccctgcccctggtgcccagccttcgcaggccacaccctgaagccactctccacccgctcagccagggtgctccgatgtccacccttgtcccggagttccggcctcagctccgatgtccacccttgtccccaggtggacacagcaccgcccagcatttggtgcaactccacccttctgcagaacgggcccctccctgggaaggcatggcttgcaataacatccctctgtaccttttctggcttccccgccacaataaaacctctcagcctcagaccttccattgccccccacctccccaccagggcagggtccatcctagtgtgagtgaactgttctggcgtccctgactygccctttgggatctgagcctttccctgcctgtttgtctgcacctgtcacagccccttcytttycccacctgctggtgacctcagacttccaggcatgagaytgacacagctggggtggccccagcctcagccgagtgggtccaggtgcaccacatctggaaagataggtgatggcagaacgtgacacacattggatgcacatttgattttactgggggtaggggacagggctgggcgttcaggagttctccgctatggtgtcctcgatccacttcacataagacagcactctgacggcgacagaaggcttattgggggtgccacaagggacgtagccccatgatgtgacaccttggagcacaccatcacacatcagcgggccccctgaatcaccctgggagcacaaggtgggaggggagagtgagaaaggtctacggggcccaagttctgcctggggagccccagctcgcagacagggcctccagtgcccactcccagaggaaggtgggcagggattcccacagaggggacagggtctccagtcctggccaagggggaagggacctcagggtccagckmcngcacatggggcagggtccaggwggacagtgcctgcagacaggtyagggggaggaggggcaggaccatctgcaggacgctgcccctgygggcacatcgcagaggccacctctccaggactactctctgactcgacggtaacaacacattaccacgaggaacggtgaactctggtgtggggggtgagatgcagttgtccctggatgggcgggggaaggagggggagctggggcactgatggggcgagtggctacagctagctgggaagcagtgaagcagatgcctggttagctctcagaarccagttcasaggctgagtcccctccctcagcccttccagaccctgggggcagggctgcctcaccacacaggtgtctttgccaccttccaggtgtccgacacacagcatgaagtctgtcwccttctggacrtgggctttttygcactcatcattaggcaggattttgaggtccacacactggagatcatctggaaatgagactacgaacccgggagaaaaagggctgcagcccgacctcacctgcttccctggccctttctcccttggacrcaggagtccccatcccygccttgggctacacagtctgcccccacatacaattctctggttcgatgctgccccagccggaagccaaacaggtgctccccacttcgggttcctsggtgggcaactccacgaccttcacagcrtctgtgatggtatcagcaggctctgtcaggcggagcagcatgaggtcgtggctgtagtcctcgtctgcttggcgggtgtggttctccaggaggctcatgttgaagccagggtgtgggaagctctcactgacatgaacaaactgggctgtgttttcgtcgtcaaacaagttgtggygacccagccagagctggtaattgctggggaaagatgggaatggagggatgagaagaygggaaggggaaaaggggatggggcaggggagcatgggggagggtccccaaagagagaaagggaaagagaaaaatgtgggtgggcggagacagaggaagaaagatatagttatggagaaatacagacagcgaatgggaagatgaaagaktttgagagtgcaaaaggcaaatgaagagacasagcaaaaaagagctcaaaaggacagaggggtgaraaaggcggaggggagggcagtgagaaacagggtgagcaaaaaagaggcagatgagaaggataaaagacagggacagcgagaaacaggcccagggaagagggaggaagagggaacagaacayggaagggagcgagaagcagacaaatgaaaaaggacgcgggacgtcagagtgagaactagaaacagaggcagagaggaagcaggagtgaccgagtgtgggagagaaaagggagggaggccctgggggagggtgggggcaggtggggagggtgggggcaggtagggaggaggggaggcctgagagcggctcagctgcagctggggctgtggtgcgggctccccaggggcaggtggcctggcctgaagtccaaggtcgaggcccccttcccttcccagcaccctcccgcgcgtttctcgccccgcctcctccttcctcctccctcagttgccccacccagctcccgctgaaaccagcccttccctgtgtctctccagagtggagggatatcctgtggggcggggagctggacagagggagaggcrccccctcccaggcacacaagttggggataaagcccttcctttactctggggcctcccttaggtccatctgggtgtgtgtttagtagggatgagggagcggtgaggtagagacccagagagagagagatgggtagagagatggagggtgagacacagtgacagagatgccgcagagagactcagagacagacagagacaggggagatgcagagacaaggagacagaggagagagaggaagacagagaccagaacacagtcacacagagacacaagcagaaccagatcccaagagacccaggcagccttggagaggggtgtccagcccagctctgccctgccaggcgacctgcgccagagccttcctctctgsctcagccccccagtcttgcctgaggttatccaaggggaatgccactggcctgtcaatcctgtggcagcatagatgccctcctcccagaccccaggcccctactcactcgctgatgcaatgagcagctgtgagcacccactggcggtgcaccaggatgcccccacactggaaagtgctgaaatggtacagagccgcctgccagggctgggaatgctgctcacactcccagcctcccacaatccgggactgaatcgggggcgcagcacctgcagaggcggtgctgggtcaggaagggcagggttggcaggagaggccagggacaaggctaggagagggagctgggctgtgggtctgaagggacattgcgggtagaggaccagggctggaggttggggacatgggcaaggggtgttgggaaggggtgggactctggactgttccctgggcttttggagtggtggctggacctggtggggagattttgtgctctgacagtagagcagcctccagggatcagggtaggagacaggagacagtgtctggagcagacactgcatctgggcgtcaggtcatttggggtctggggctgggggatgggaggtggtgggttaggggagtggaaarggattctggaaaccaggsatcaaggcgccaagggtgggacaggatcagaggctcactgaggaagaatctggagggctaasgggctcctaggctagggaaacaggacctgggttgggcttttgaggttcaggaaaggatgcagctttagggraccaggtctgagaggtaaagaagagcatctsgactgaagagtttgggggtgacttggggtccctacattggggttggaaggggccagcttggctgggacagttagatttcagggcttcctggttaaagggtaaaagaaagggctatggttaaggctagaggtgggcttcygagaggttttggggtccttcctgtgaaccaggaatggcaatmtgaggggaggttggggccctgagaacacagttgcggtcaggactgggacggggctcaggaggagggaggcgtgagtggcagtccttctcggacagggtgaaggatgggatcttcgtttctcatggggatggggttcatggtctgagggtactggaaggatatggggtcctcttggaggcaatcctaggaagaggattggagaagtggtgagaacaggcgccaagcagctgtgggaatgcaatgcaggacccacttgaygtgaggttgtagaatcacatactgacttgggggaggccagggcagaagcgctggctgagaaggcattcaggatccttggsgtggggttccagaaaaccagagctgtgtaggaacaattcaggcagagaagggctggggcctggggcgggatggaacttccccaaggaaaggagcatgtggtgggagggtktggtgtttttcctgggagagctgggggtgctgggtgggaagggacatttgcagacccccccmcataccagrtgggggatcccacatgccagtttgggaagcagggttttctggtgaaatttgggggaccctggaaggactggggagaccagatgtcagggtctggaggacacagttgagagcggacagctggatggaaaaagtcactggagtgtggtgggatttgtagactcaggagccaaataggtggccgcagggaactaggggrcaggaggggatgatcagagtcctgtggggtgggggaagcccatgggagggttggggtcctccagagagagacagagatggcccagaatctgcccctttggtaaagcggtgggacagggcgttggctagggaagaggagaaagtactgaggcttcctgggaggagcaggaatctggtgtgggagtgarcactatgacaacatggaggagcgggggtggaagtttagggtgggsccgcgcaagatagataagagccggggcaccccggactaggatagactgtgrgccagagggatgagggtggggtgttggaggggaaggtcttatcggggggggatgtgaggccagcaagagaatcagggcccgttccccctcccacatccccccactgtctcaccagtcccccccagggacagggcgaggcacagaaccaggaaccacatggtgacagaggtgtccaggggccagcaggtggaggaactggggaacctccctggggagscttttaaaagcccttatcccctcagagccccacccctgccctgctggcacccagatgttggccaaggcccttcccctgttgcctgggggctggacaattgcccccccsscyccgatccccagagctgtagacggggagggagaaccagcacctgttctgcaggccctggatcacgctggacgcattcctggggttgaagccaggtggggcagggcctgtggctctggggctttgctctggggagcagccagtgaggcaaggggggactgaggggaagcagaaacaggaagacggaggaatcagtgacccctggtacaaagccccatatacctcagtctcaattaaggccctgcacccccagacctggtgccctcaaacaccagcagttagggctctgattccctgcaccactcggagccaagatactagcatctcagctgccagttccccctgaaatataagccttggmcttcagaatgccctggttcttgcactcccagacccaggacctaggtccccaaagctactgttcctttcataataaaattttggggtacacatcaccacattcctagtgcctccagatccaggaatgtgaagtttcaggggtctcccagggtaagttctttagcattacaaaatccartgtccctcccaaacaatgctggggtctcaatgagcctcccacttcttgctcccagttakgggtgctcaacgtcctgtcctccaaagtcccagagatctggacaaccttccctcccaggtcaagatcaggctaaccacagattccaatgacccttcccccccaccaccagtacaatatttaggtctcacgagccaggttcatgtacttcaacattcagcgaccttgaacatcacattttgtggtctctgaagataattaggaactagattcctgcagcctcaatggtaaacccataggcttccaacaggttgtcttggctttttggtaaaatcaaagcagctcagagttccagcctctgctgtatatcagggacctggctaaggaaaggacagtatttgcctttttgccatggctaccaggaagccca

SEQ ID NO: 13442 - DNA, 13609 bp, Homo sapiens
catcagcgtttcatatcacaaattaacctcctttccaaatttctctttaagttttaatcctcttgtttaagtggctttatttcttaaggtttgaagtgcctttattcmcattgtatagactcgaacattcctcaaataaatttaccaaatttctgctttctggcttgaaaatcatcacttttttagattttcacatcactcaagagcaagactagcagctggccgtttttccccccattgttgatgggtcagggagcattttttattaaacaaaatttactttaaaagagtgcctgacagtgagctgggagccttataaccttttccagatgaggacgctgttctgtctgtcagtttctcaccagctaagagcctctcacctacaaccagccttgaaggacaaaaatcatcatctgtcctcggccacagtgacagttcgccacatggcatggacttttgattgttgaaatcaaaattttaaatttaaaaaacaatttaaatttttttttaaattttgattttagaaagcatatgttggtgtacatgcatgtatgtgagatatactgtctacagacacaggtcagtaatgggcatgtatgtgtgggtgcattcatacacggctggacttctccttagaaaggttatagttgctctgctcctagtgcttgaggtctgtgttgtattattactgcttggttttatcccttccccgcctcctgctgacattgtattgtagaagccaaaggcagggcccagacaggtcatcagcaaggcacttaggggatcaaccttctaggcaaccttcctctctgatgcctgcagctttcgtctgtggacgcacctttccaacgctcttatgttcccctaaacctctcatctctcctcagcccatgaggatcagggcctttgaactgtgagagatcaggactgggaggtagacaccaggcaygagcaggtagtaaaagaacagccccttagctctcaccaggccttacctctccacccccaaagctgaacatgtctgccatcttgaggtacaccacattccccaaagttctatttttttctctcagatctgagcctttgcttacagtatgccctcaacctagaatcttcttccctctacttctttatgttaatgtttagtcatctttcaagatctgctgtcctgggatctacttaaaaggccttttgcagtccagtaaaactccccactccccacccttttgtccccactggtgtagtgggtatcacagtggctgtttccttgcctgtctttcctagtacatgaactccttctgagggcatgtgctgcttctctcagcagagcaaagtgctctaaggtgaactcaagtgtcatactgtctggattctcattccatctctactactcaatagccttgtgattttcagcaagtatctttgaaatgttcagtgccaaagcttctccaactataatatggggctagtaatagtgtctgtattgcatatggagttatgaagattaaatgagaagaacacataaaaagcaaccaaaaccataggcagcacccaataaatgatagctactgttaccattattctcagcctagcattttgctggatagctagagatgggagaaacctgcattmgtttcctgaggctcctgtaacgcataccgcaaactggatgttgtaaaatgacaaatttattctttcagtattagaagctagaggtccaaaatccagcagggttttgctccctccagaggccctgtgggaagaatctgtttcttgcctctctcagcttctggtgactccaggtgatccrtggagtggtgcagcctctgccttcatggtcatctccccactgccgccgcctctctgtgttctcagaactgcctttgcctctctctcataagtgtacgtgtgattgtatataggacccacatgaattttctgtgataatcttgtctcgggaggccaaggcgggcggatcacttgaggtctggagttcaagaccagtctgactaacatggagaaaccccatctctactaaaaatacaaaattagctgggcatggtggcgcatgcctgtaatcccagctactcgggaggctaagacaggagaatcgcttgaattcgggaggcggaggttgtggtgagccgagattgcaccattgcaccccagcctgtgcaacaagagcgaaactccdtctcaaaaaaaataatctccttgtctcaagatccttaacttaattatatttacaaagaccctttttcctagtcaggtcacatttacaaattccagggatcaggactcgataactttgggtggccattattcagcctaccacagcttgtcctctgacccccaaagagtcacatccaacccacatgcaaaatatgttcacccatcccagcaacctcaaaagtctcaaacccctgtcttggccattgttttttctagtcttcagagaagatgtgagctgtcatgtactcctctccccactgtgcctaggatttcctcctccagattcacaggggagatttgggggtaatagttgttgtcagcagctctctattttttagatcaatgggttcacgctgatcgcttgcctaacattaaatrtggaatcaaacttgtaaagtaggcaagactcgaggcctcctgtcccaatctgttttaggccacctgttcacaccaccactctgttgtacccaccagtctcactagccatccatacagcagcactggcatcactcccatgacccctccctgcagcacattagcctctttcctcagccaggtggaggtttccacctgtcaagttctcttttttttatttcgaaacagactcactctgttgcccaggctggaatgcagtggtgcagtcccagctcactgtaacctccaccttatgggttcaagcaattctcctgcctcagtctcccgaatagctgggattgcaggcacccgccacmatgtccagctgatttttgtatttttaatagagacggggtttcaccatgttggccaggctggtctcaaactcctgacctcaagtgatccacccatctcggcctctcaaagtgctgggattatagtcatgagccaccgaacttggcccacctgtcaagtgtgaagcctatacccctctttggttccccgacatttgtgtttctggtctcaggggcacctctgacattcagctcctttgcagagtagccatggctgacaggtcttggctctgctgatgatcacactttctatgctgatgattagccccgcccagtcccccatgctgacctttaagaaggaggtagaaggtggtttaagaaggaagtagatgttgcatttagccttggaagatgartggaataggcaggaggaaataagcaaggcagctgatgttgagtgttttgtgagaacgagggccagagatcataacctttaatgcatctacttcacagaaggccacacttccttcattacaaagagtctgtctttccccctctcaaattccatttcatgccttcataaactcctttttctttgtttttgagrcagggtcttattctgtcacccaggctggagtgcagtggcktgatcatagctcactgcagcctccacctcacaggctcaagctatcttccyacctcagtctcctgagtagctgggactacaggtgtgcaccaccatgcccagctaatttttgtattttttgtggagacggggtttcaccatattgcccaggctggtctcaaactcctgagttatgtgatccacctgccttggcctcccaaagtgctggagactaccggcatgagccaccacacccagcccatraattcttaatacaggtttatggcttgtaagacaaaagaaaatgacaattcattattttagaatcttcggataaaaaactacgtacgtaatattttataaggccatcacttgtaagtgcctcacagagtgctgggcattgtgttgagcacttcgcatrtgttaacgtacctcattcttaaccatggttacacagagagaaaatgctattatctcaacttcggggcgcagaaaggttaagtgatttacactgtttctcacagctagtacgksggggccaggattcacctgcagcctgtgtggctgagagccagccctcctcaccctctccacgcaccactctgtgctcgcaaaatgcaggcccactggccatttctcctcacagcagtggtttctgtgcccatgaagctgaagtgtggagaaggcgatcaacttagcatggttctcctggcaagcagcacaagctctgctggctgtgcctccttatccatctgcagcatggcaccctggtatgcagctcctgcgctgcccaggctgggagggccaccccaggctttttccctgccagaaccacaacatccacagtgcccaaaatagccccagcrttacattactgaagtcctgcttctgtgatgaatccagccatctgtctcaggagacttctaaggcaggcttttgatagcaaaacaaatagtcctgtggacagatttgggttttgtagggaatttatgatttttgaagttgcatttcattgaacctctttcctttttttttttttttttttyttaaagacaacgtcttgttctgtcgcttaggctggagtacagtggcacaatcatggcttattgtagcctcaacctcccgggcccaagtgatcctcccatctcagcctcccaagtaacttgggactctgggtgcgtcacaccacacccagctgattttttaatttttgtagagacaaggtcttactatgttgcccaggctggtctcgaactcctgggctcaggtgatcctcctgccttgacctcccaaagtgctgggattacaggcgtgagcctcttcacccggtcctcctctttctttaataacctactttataacagactaacacatattttaacacaatttaaataataagaaatgaggacaaagggagaataaaggtagcaaagtaaggtgaattccaggagtgtgatttctccacaaaatgagtaacaaaaagtcacatacagtgtctggaagtgggccacggatttgaccctaagattcttacaggcaagagcaaagagagaaatacaactaattgttaggttcatggtagccttaagactgacactattctaacactcttgaattaatacctrataacaatttcccccctcccctggccctccatcctttggcatttagagaagtgtctgcagtgcacgtgggaaaccataacatgcactgaaagaacattccagaagcccaggttctgatccaggttctaccaatccctgacaaagtgacctctgggaatcacttacattcctcatctttggtcactgggagttagaattgtacttttatttaatatagagcaaataatggatgaaaaactataccaaaaattggtttactgcttatatttcaggcctgggacttccaggtaaaaaagctccatagatgaaatgtctgagacatgcatatttacttattttcttttcttttcctttgtttttttgttttttcttgttgtttgtttgttttattacatatctacttattggaagtgggactgtcattgtcccagttactgatgaggaaattaggcacagagaagtcaaatgacttgcttaagatctcaaatccaggaactgcagaagtgagatttgaacccatttccaactccaaggcctgtatagtaattcactattccagaatactcctgtagcaacctggccattcgctgctgagccaatgccccctctctttccacaaactcttctcctgtagcttcgaagctatggtaggtgaccaggagtcttggccacacttcttccattgcctgcccaggaggtatctccaactttctcttacacacatctgtatgatacactaagacctttttccaaattgcacagagagagaaaaagggattgagttgcttccatatttttgctgctcattgtcctcttttcagtactattttattttcagaattttttctagccacacttttcttctcaagcacagcaggtagcctttgcatagctatgagagtgacaggattcttgtcaaccagaccatagacgcctacccagccaggtgtaagaaggtccgctgtgggcagagaagttgatgagccagcacggtcagtcctgtctttcgctagcagggactattgactgctctgtgccagacattttgttaaaaagtggtgttatcggcctggcgcagtggctcacgcctgtaatcccagcactttgagagaccgaggcaggtggatcactcgaggtcaggagttcaagaccagcctggccaacatggcgaaaccccatctccactaaaaatacaaaaattagccagacrtggtggcgcatgcctgtaatcctagctacttgggaggctgaggcaggagaatcagtgaacctaggaggcagaggttgcagtgagctgagaygatgccgttgtactccagcctgggcaacaagagcaaaactccatctcagaaaaaataaaaataaaaataatggtgttaccaagacatagaaggtggggtccattctttgaagtgaccactcattgagtaaattaacatcatttctgtttcatgccattgaagagctgtgaataataatacccttgtgtcaggcttcctgtggtctagcactgtgtcccgtactttatagtttatttcctttaatactcatgcccatctagggtagtaggtaccatggttgttcccagttgatatatgacggaatcgaggcttagcagaataagaagtcacccaaactcatacccactggtcagcagtacagctagaattcaaagccacacttgtctaggtccaaaatctgcacccctaattaaccactcctggtaagaagctggttataagggctggtcaagtcagctatggaagaattctcagaaagtgactctaaaggtgttctttgaaggttgtgtaggaattcaccaaaactggaaggagacaggccttccttgcagggaaaaggaacgtaaggggcaaagttacagagacataaaaactcacaccatctttggaaaaaggagactcattttgagaagccaaagagtaaggttaagtgagaactctggacatttgggcctgtgggtattgggcagcagcccctgacatgatgactcgtctgtgtgacagcagaatgaatgaccacagcagagccagagggcctttgcagccctgttggtctcaaatttactcatgtatagcacatgcaacctgcattaataatcacttctttggaatgttttctacctggaaagggaattagtggatgtaacagttcattccccaaacataaaattttccttgacgttttgattgttataactcatttaagtgggaaagtataagatttgatatctagccctgaagactcatcattgagcacagtgctagaaagaaatgcctaccaggctaggtgcagtggctcacacctgtaatcccagcactttgggaggccaagacaggaggatcacttgaggccaagtatttgagaccagcctgggaaatacagtgagaccttgtctytaccaaaaaaaaaaaaaaaaaaaaaaattagtaatgagaccttgtctctacaaaaaaaataaaaattaaaattaaccaggcatggtgggtcatgcatgtagtcctagctacttgggaggctgaggcggkaggatcatttgagcccaggagtttaaggctgcagtgagctatgattatgccactgcactcccacctgggtgacagagcaagamcttgtctcttaaaaaaaaaaaaaaaaaaggccacgtgtggtggctcacacctgtaatcctaacactttgggaggccaaggtgggaggatcagttggtctcaggagtccaagaccagcctgggcaacttagaccccatcttgaaaaaataaataaataaaaaataagaaaaaaaataaatgccctaccttgaagaacatcacagctctgaggattttatgagttaccaaagaagtccttaaatattaagttatatgggctcatgaacatatactgatggttagtttaattaaaattaaataaaactaaatttgaaagcctttggttcytctagtaatgccagtttatctcatttcttcttgtatcaatatcatagaattacagaacattctgtccaggaggtgagcaccctgccagcctctccctcttcagtaggtgcagtcagaccaggaggtgataggtgctagagtgtggtgattcacagtacagaccctggaagagggctgctggctttccatcccagctttgacccttaccagtgacctgaccttgggcaattgactttacttctctgtgtgcttcttcatatataaaatgaggggtgattatactatttatctcataagcataattactatgagtatgtagcacagtatgttgctcacagtaagtgctcagtaaacggtcgttgctgttaataatgttactatcagggcgtcttgatgggtaatgaagagcacattgatttgyggtcaggactcccaggtacaccatttccccacgggacctgcagccatttattcatttagtctcatttccttatcttatgatgccagtctcatgctgtgaggaaggaaggctggatgaatataaaagcatgtgggcaatcggtggtgctattgagcagatgtgcagtgtagtgaggatcagttagtttttttttcagccctgccctcttcatctgccctcctggtgctcagcctcctcagccagcccattcccagtgccacctaggcagtattatagtcttctaggtagaggaggagaggaggctgctgaaagaagagaacaagagtttccagagcagtcataggaagaaaggacaaggaaatgaactagagccccagagacagggtgcccatgcagggtcccggggaatcctcctgggtgcctgcagcttggggctccacaactgccctgcactctgcccaccacaaaatggatcatagaagagccctcatttattgtcttgtgaccctctcctggacatagcacacttacctccacctgtgtgcctctggttttgctgctcacccgctagaaagttcttcacctgtccaggtgctatgtcttccccagacagcattccctactccctcttccccactcctgccagcagtcagagtttagaaactattctcctcaattgacagcaactgatgttcatctcattacacattattagtgtatttcctatgtcttaagtctcacaggccagagcataagctctgtgagagcagtgaagttttatttgtttttgtgccttctgcttcacatttatgccttgcacatagtagatgcttaataaatgttaatacttggccgggtatggtggcttatgcctgtaatcccagcactttgggaggccgaggcaggtggatcaccggaggccaggaattttagaccagcctggctaacatggtgaaaccctgtttctactaaaaatacaaaaattagctgggcgtggtggtatatgcctgtagtcccagctactcaggaggctgaggcaggagaatcacttgaacccaggaggccgatgctgcagtgagctgagattgcaccactacactccagtctaggcaacagagtgagactccatctcaaaaaaaaaaagttaatatttgaatgaatgcccctgtagtcccagctacttgggatgctggacaggaggaacacttgaactctggagttcaaggctacagtgagccatgattgcaccactgcactctagcctgggtgacagagtgagactgtctcaaaaaaaaaaaaaaaaragagaatgaatgacgagtcagtaagtgcctgagggcctggcccaacagatgaccacttatccaccaccctgctaatggtgttcacatgcacattccacttgtgagttgtgtgtttcttctgagtttggatactagagggtagtctcctagcatgaggcctcttggtgaacttgaaatttattcttctttctctaccctcaaactaaggacaagatcctgagccagtgggaacatcaccaagtttctatgctctttgaggccttgccacagagcagctgctcacctctttgatacactcctttaccagarataaaaaaccgcaaagcccaaaacagtgctcagttttgttttggtcttaggccagaaatgcatgccgttttggcttgggtcttttaaatgccgttctggaacctgagcaatgcctgtctacaggccaaacccatgtattctcattgcatttccccatctaaagacataccttttcaccttcggttttccttgtaggtaacgatgggggtccatcctcttcaagtaagactacaaacaagtttgagggactatcccagcagtcgaggtaagccatctcagcgcttcatttcccctgttggatccattgatgcaatggacagaattctagaaatgagttttcatgaatttcccagcgctgctcaaagctgtggtcagccaagtggggcwggccacaacaagaaaccagacgttcactcttggtttgcatgcacatcttgtgactggactgggcacaggtctgcagaccgttctctgagcagcaacgctgtctacccagttcacagacaggagctaacctcacttcccggtggtcgcagggttgtgcagtggtcttgaacaaaattcctgtcagaatgagtttttatttttgatattttaatcaagtaactttgttacttttccacttgactccttttgcagatttggaaatgaaaagataatccttagggaaatctgattgcctggagattttcaaacataaaaatagcactctttcaagttctgtttctaatatttttttttttaggctaggctgacagcagtgttcttttcttcccttttttcactgaaattgtatacttgaggagatctcttacgggcartttttatccagccttaccctaaagtgttttctctggaggtgccatccaaggaaaggacagagagccacttccagacccaaacttcagggaaaaagagtcagctcttatccagagtttctgaaagatgagaaaacaaaatctctctttttttgagatagggcctttctctgtcacccrgactggagtgcagtggtatgagcacagctcactgtagcctcaacctcctgggctcaagagatggtcctgcctcagcctcccgagtagctggaaccagaggcatgcatcactgtactcagctgatttttttatttttttgtagagacaaggcctcagcatgttgcccaagctggtcttgaacttctgggctcaagcaatcctcctgcttcagcctcccaaagtgctaggattacaagtgggagccaccatatccagccttttttttaataccactatcttatgtactctttataaccctgtgagataggcccaattactattatcctcagttttgcaggtgaggagagcgaggcccagagtggttaggtggtgggtgcagatgtcagagccagctctccagcctacttgttctcccaactccacattccacaccccttccttgcccttgtgccctgcctttcattcctcactcaccttccttcaaccctaatttgggggaccctgtaaaactaaagttctggtgttctttttccagagtgaggagaatatctgacactccaaaagcactcataaaaggtttttaaaggctggacacagtggctcacctgtaatcccagcactttgggaggccaaggtgtgaggattgcttgagccccgaagtttgaggccagcctgggcaacatagcaagaccttgcttcctaaaaataaaaaaaatcagccgggtatggtggtacatacctggctatacgggaggctgaggcaagaggaccgcctgagcccaggaaattgaggctgcagtgagtcatgatcgcacctctgcactccatccggggcgacagcaagaccctgtctcaaaaaaaaagttttggcagggcacagtggctctcgccactttgggagaaccaatcccagcactttgggaggccaaggcaggtggatcacttgaggtcaggagttcaggaccagcctggccaacatggtgaaaccccgtctgtacgaaaaatacaaaaattagccgggcatagtggggtgcgcctgtagtcccagctactcaggaggctaaggcaggagaatcacttgaacctgggaagtggaggttgcagtgaaccgagatcacgccactgcactccagcctaggtgacagcgagacttcgtctcaaaaaaaaaaaaaaaaagtttttaaacaaaatcaagctgattgtgaactagagcctttggcaactcgttaagtttgtttgtttgcttttgagatggagtctctttcaagagaaacaaagccctctcatgtttactgtttcttgtttagtggtggctttatctcagcaatattcccccgttgcccagagacaggaggatttcaagtgagctgaggaaagagcagtgaagatcaaggatggccaagagccaggacagaaaggagcacacacctttcatcttctctctttgactactttttgttttgttggttggtttggctttttcttttcttttaaaygcagttagctgaggcacaagaatcgcttgatcccgggaagcagaggttgcagtgagctgagatcgtgccactgcactcyagcctggtgacagagcaagactgtgtctcaaaaaaaaaaaaaaaaaaaaaaaaagcagcagcarcagcaaccaactcttaggacatcaggggacagaaatggagagatgagataataaaggggttcttggcagatggggctcaggcacttggctactgctgcttctcaggcatgcaggcctcctggtgtcctctgagaatcgccaaaacctcttgttaaagaaaaatagtggcttccacctaatgtagaccactgatggcactggggtttcagttgcagaggttaacgtttgatgatttagacaatgtggtatggacctgtattccagggacttgggcctttgtcaccctcatttacctgtcctccaaaaggaaagcaaggcctaggagagcctggaggcccgagaaccaagctctttgctatagtggaggaagtgagggctctggaggcccaggggagctagggccgaatttccacttctacctctgacccacgtgagaccttctgccagccgccaacacccccattcccttccatttccttgtctggaaacacagagctgctttgtgggatcatgtgggaagagttacttctgtgcactacattggggtcaccacttagagtgtgccaggtgccttcataaatgctttgaagtggaggagttgggctttatcattaagagggacttttttttcatccttttactgtgcctcctcagccaggcaaactgaaatatggaaaatagactaatcttttgttaaagacattttgaggctgggcacagtggctcatgcctgtaatcccagcactttggaaggctgaggtgggtggatccacgagctcaggagtacaagacc

SEQ ID NO: 13443 - DNA, 49979 bp, Homo sapiens
  misc_feature (1)...(49979): n = A,T,C or G, or insertion/deletion polymorphism (see Tables 1-2)
taaggaaaaagaaaacagggaaaaataaaacctcatcaatatcttccaacagttaacaggagataccacattcatgaaacaaaaaataggttataaaataggaatagagggaacaagaaaaagctcttagaaatgagaaaaaccttggtagaagggctggaagacaaacttgagaataacttccagaaagaaaatgaaaaaccaaagggtacaaaacatcaattagacaggaggaatgtggttttcttttatgagatatattgtacagcacggtgaatatagtaaataataatgtcgatttcaaaagtgctgacrgtaatytcatatgctttcaccacaaaaaacttaaagtatttgaagtgatgaattatgttaacttgattttattatttattgtatccataaatcgtaacatcactttgtaccccctaaatatgtacaagtataatttgtcaatttacaatttaaaagataaaaacaaaaacaaaaattttagaggggggaaaaagaaaccttaagaaaattatgagtgccaatccagaaagtccaagagtagaattctagagagagagagagaaagcaaatargaagaaatcaaagcaataaatcaaaaaaatgcccagcgttgaagaacatgagttgcaaataaacaggaccaaagagtaggcaagacgatggatgaaaacagtctccaagggacatcactgttctgggagttctgaatttcacagaaagaaaagcctctgaggccagatgcaaagccttcactcccagcacttcgggagtctgaggcaggagaatcacttgaggccaggagttcaagatcagcctgggcaacatagagagctcatgtctacaaaaagtttttaaaattatccaggtgtggcggtgcatgcctgtagtcccaggtacttgggaggccgaggcaggagcatcactcaagcccaggagattgcagctgcagtgagctatgacagcgccaccgcactacagcctgagcaacagagcaagacgctgtgtctcaaaaaaaaacaaaagaaagaaagaagaaaaaaaagaaacaaaaaccttcaggtttcatggaggaaaacatagtcacacacaaaggctctaaaaatgttacgtatcaataaaagagaatcagaacggcttaagacttcaacaacactggaaacttagagaccgcggagcaaaatgatgtccaaattcctactcaggataagagcagaacgaggcactttcgtacatacaaattctgaaaacttcatctgccatgcacttctcaggcaactagtgaaggatgtgctccatcgaagtgagacagtcaaatcaagagaatgacataggttccagaaaagtgaggctccaacacaagagggagtgaggagagttacaggaagatttcaggcacagacaagcctgcagcagattggaggcgctgggagagatttattcaagataaaatgataggaatactaattttcttcaaaagaaaacggacaatttcttgaaagatttagataattgcttcagaatttggggttgaattgtagtgacaaaatatagaaaactgagcaagcagcaagcaaacaaaaacaaataagacttgtaataacccaggaaaacaaaaagttatccagaaaagtgaaaacaatcctattataccacttcgtccagctgtaaatggcaatatgtagtcataatataaacaatcaatactgaactaaccaaattaaggatatatcactttgggcagccatggatccgtttgcactgagaaggcagagggtgaaagaaagctaggaacttcctacctattctcagtgtcaagcgaagagacatcacatgaaacaggggtaggrgacacaaatacagacgtcaagcaaatatgctctttagagttggaggcaaagatcaaggaaatctactaaggctgaagtagatactctgcaggggaggaaacatgattaggggaaggatgttggcacttctttcttacaagcctttctaggattatctgactctacaaatkacatgaagctgtaaccttgatttgaaataagattaatatgaatgctaataaaaagtagtaagggagagtatgtagtcaatgtattcttaccaaattaacaacaagtatcaacaagatgactaacacaaccacatgatgtccagacacgtctcagaacaaatgtctagctcatcttcaacggtattcgaggaacttcagtgtgcttggtaaaacaatagcctactagggatttcacttctaaaatgtctctgactttagaaataccaaaaaataacatgtaaccaagttttaaaatattatacacatgaaaaaaggttcttttcattattttcttggtttccagatgttgaacgttgtggtgcttttacaattgaagagaaaaagcattctgacacattatactggttggggttctctgcttttstacttggtcaaaaacctttacacgcattttggactttgtgtcatcataacttggcaattgggaaagccgcatgatatgcttctttcagaacttggttacttcttaccaaaagagggaaaagctttcgtatcaccatttgcctatgggatggatgcacaatgaacgggccataccaaataaaaatatcactttgtactccaaaaagcatgttctctgcttaagccctttctgtaagtttcagctgggacgcactaatggagaatccatatgacccacgaaggatcgtaagatatcccagtggacccggcacaatcatctcaaattctgttcaggtcagagtatcttagataaaactcactgaagggcatcaagtccttcagtacacagtctgagccaagccctctaccatttgccatggcaagagtataccaaattctaaacctgttgctcacgtatgccaccaactataaatgtcagcctcctctttcctagtcttcctgtccactcagcaccacctggaaaaactcttactcgtcttttaaaccgcagttcaaggaccacattctgtaggaagactttccaacaggtaaccacwgcctatttcctatgtccacaccttacacatatttctatcattgcacttatcacaccataatgtaattactcttctacaaataagtctctcacactagaccacaagctgcctgaggaaaagaaaagtctatatcctctttttttgttggctttttgagacacagtctcactctgtcgcccaggctagagtgcagtgctacaatctcggctcactgcaacctccgcctcctgggttcaagcgattctcatgcctcagcctcttgagcagctgggattacaggcgcgcrccaccatgccaggctaatttttgtatttttagtagagacagggtttcaccatgttggtcaggctggtctcgaactcctgacctcaagtgtccacccgcctcgacctcccaaagtgctgggattacaagcgtgagccactgcacctggtcgaaaagactatatcctctcaacctttgtatctgcagaacccttaaccctacacagcaatttccagcaaatatttttttgaattgaaatgaagaagtgaggtcatgaggctgaagtcagacaactggaaggccaaaacaacaaaacctggaaaaatacgtatttactcaagaagaaattctcccaccaggccactgagaagttagctttgcccactggagaggacactgtaacagggattcaagtaagcctagtggcgctgagggacgtgatataggtcaactatatctttgaggtgctctccttacactcaatgcacttttacccgaatgacgttaatttgactcctgataagatgagctaagtcccttcaacagtgcttggcaccaagcaaaactaatagcagtaacaggaaagtttaatcctcatgatgaattatttaatggggtttcaaacgctgtccctgagacttgaggcagtaggctccagctccattttccccaagtctaaaacttgataggttgatgtttcagactcagagattcggtaatccaaatgatggaaataattcttacccaaacaccttttcaactatttttaaatactgttgccaagcatcctaatatcatgtgtacttaatgaatttagcctagggatacttttacatgtcaaaaaatcaaaatataaacctaagcactacgtttcatccagtgtttcagcatcccagatttgcttccctaaatgaacattaagcttattatgcaatgtgccgctaccaggagccttagacaaaaccctaattgtgacttaacctatcttaatagggttttaaggaagttagctgctaagaaagtgactatccttaagcagacaccaaataaatgtgaagtcattgattgagggcttagggtataggtagctatgaatctgaggacataaaacgcaaaactgaggggcaaatcgtcatgttccttaagattacgactcatccacattccttcagmcgtttaatttcaccataataggcactgtttaataagcaaagcccaagtcgacttccttcgattttacatggcgtccaaacaccatgtcaagtctgaccctctcattttttaagtcgaatggagaggatatgtagcagctagccttgagcacctaaccacttttcaaaggagctacgcacaaaaataccctagcaacatgccacggtgtcagaaaggctcaggttcccaacaccatgcgggtcagccattaggaactcaggaagtgtttcctctaagcgggggaaacctaggaaggcttcctgaacgaggggtatttgcgccaagccttgacgtgagtctcgaacagttgcagtgcctccaggccacgcgggagggaggaaaggacaccccgggccggggcacaacccgcgggccggagccgcccgcgcccatcccgctcaggccgcagccaggcacggcaccctcccgtccccgagccacgtcgctgctcgtgggctcgcggagcactccccaggtctcacctcgggccccacaccagaaggagaaagctaggggccgcgccagctccgccctcccccgcggggcggcgggccccagcccgggcacaggaaggccacgtccccggggagggacgcccgactcgatggtctgcgcagggcccgtcggccccacgtgacgtgcgcgcagccaatcccagagaggccccccgatcatcgagacggcggcggtggtgggctagacgagtttcgcgcgggcgctcgccgtcccccgcccagtcgtactcggcgccccagctcggggctggcgccatcttcttggaagacaggaagagaagccaagggctccctccccgggaatggtccggaatcccgcaacaattgcccttccgggacggctttttctttttaagggggacttggttccttttaacaaagggctttcccccattcggttaccaccgaaggcaaagaatctcttgaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggtaaaaggagaagaggctacgcttgacctccccccccacccccagcctctatatggccaactgccgtgggaggagcacggcgcttgcgcagaggcggacaacgcggacgactctgggcttgcgcactcggaagccggccgcatgggggaggggaagaaggccaggtcgcactgagccaggaagcagttggcaaaggggcggggtgacgcggtgacgcaatccgcctgcgcgctgggcggggcggggcgggctggggcgggctgtgagcggaccgcgagcgctgggcgggtccgcggcgcggtcggtcggcgcctrttctcgggctgtttggcgggtgagtgtctcgccggtgtaccccgcacaagttgtgggccggccctcccgaggagctgcgggggacgcgccgctcgtcccatactctcgggcggtggtcggctggctctggggtgccggcggggcggtgtgggggaggggcggccgagcccaggctcttyggcacttatcgtgggctcccccgtcccgggcggtcctagtgccggcgacagtggctccgacacgggcaggcccgggcgcgggagtggggattccggtgaccccttgttgaccctgcgggaattcctctgcactgtcgtcggtgctgggcctcggggcgtcgagtgcggtcgaggtcgggaggtttggtgcttggagggaggatacaggtttaggcccgacaaacacttagagcttgtgtggccatcttgtctttctaacggtgccatttcctycctgaggcgtggaggactggccagcccccaaacctccaagcccatcggctggatgccgtggataagcgaggggagagcgactagrccctgtctgcgggtaccttcggcgaggagaggcgacgaaggtctgcaccagcgaggcacggacaggcagcagggkgtagggtatagggttggrggccgccgagttggcccggggatgaggagcaaacctgtggcttccgtggtctcagtggagtcccaactgtgacctggcctactggcccagacaaacctggcttgcttttttaccttttcggtctaattcttgtcagtgccaccagaccttgtcctctctccacggaaacacacgaaccaactacactgaacttcttgtagttcaaacttctgcacctttggccattgcccaaactcttaaatctggctacttcccaccttaactgccttctccttacctagtctgtgcttgtgggattccgcccaaattagatttcctccagacaggcttaggtgtttacctgatgttccagatggtatttgtccagtggactattggtgctgtgagggcagggcacatgttgtcacccatactcattgcctcggttggtgtctagcacctagtaggttctcaaatactttttgaatcacagtgcctgccgatatatttaatgtttcaaaatagttctgccgtcataaagaaaaacatcatggtgtaggggtcatgaaagctgattcttgatacttctgatttgagcctcattgttttcagtgatttttgatagctcccattaatgggttctttgcaccacccagcatcctaactcatgatgtgtactgttatgtataatcttggcattgatctcattagctataaaggttgtcctgattttttttcctcaacttccaccttgatttctctcaccagtgccacagccaggaataaagaacaagagcgttttaattagatcagatttacattctsactggctcttaaactagcaaggtgacctagggaaaggggccagggtttccctctatcattcataaatgtaattcagggcccctttttatccccaataccagcatacagaaactgctgtaaaagaagaagttgtgggtatttttttttttttttttgtctggaggaatggggacaccaaaactcatttggcagcagaggtgaggtaaggccatttgtattgtctgttctgttagtagtcatacatgccacttatccctgccccagtccctgttaggagtgttatgtgggtatactgaacgtggaccttccccgaatccaaagaatccagatgctttgaataagatcatggaccttccgggttctacatcgccagatgttgttcatcttctatcttttgttttgcgaaaattggttttttatgtgtattggggttattctgtggaagaaataagctgtgggtcaagattaaagaactttaaacaacttctggcatgtggaataaacacgatctgaaggaacaaaattttcatttgactacatttttgrtccaatttgcacccagtgtttaagttaatcacagtgcttggcagtttgtgttgctggatcaaggctttctcactgaaaaccatgtgcttcagaggttcataattcctctttcaccttccatttcacattagttaataaattatgagagaaaacattgtggatccaagttwtgtttcagaaaaaaaaaaacaggaaaaaaaaaagatggcaggagaaacttggtaaagtcaaagcaaagttgaaatgtcagtttaagacaaatagtttctccattttcccatatgtgtgcacagggttcagtgaggctgaggggttctgtggaggtgcgggagaggtgctctatggtatttctatgttgcactgtgtgggtttgaaatcagatacatgtaataggtgataaggtaagtgcctgctcttttctatcctcagcattggcatttaatctttccatgtgaacttaaagctcattttatccaatcctttaagaaaaaagccacaccrttagggattccagttagaaatggactaaataacatactcatttggggaaaataaaaatgatttgatttatgtaggacctgttttctagtttggtccctacttgtttggatttttaaaaattctgttgtaaatgatgtgcccccatttctattccttgatatttgttgctggtacttgacttacttgagatcttatatttagctaccttactaaattatcgtattctagaatttttttaaccagagtatttgtattttctttttttttttttttttgagacaaagtcttgctctgttgccaggctggagtgcagtggtgcgatctcagctcactgcaccctccacctcccgggttcaagtgattctgcctcagcctcctgggtagctgggattacaggcaggcgccaccacacctggctaatttttgtatttttggtagagacggggtttcaccatgttggccaggatggtctcaatcttttgacctcgtgatatgcccgtcttggcctcccaaaatgctgggattacaggcatgagctaccgcacccagccgagtatttgtattttctgtgtattcagtccaatcagcaaaaaagtgttttcttttgattttcttgtttcattatattcagtaaactcaccaaggtagtattaaataatcatggtgaaattgcaatatctggatcttacttggatcttgattcacatgaaaaaaatgagagaatagagaatatgaatactgattggatatttgattgcattaaagaactagctatgtgtaaggtttgtcattttaggaagcccttatttttagatatgtgtagtggaatataaatgaaatgttacatctcgtatctgcttcataatcatccaggcagtggcattgatgattgtggaaatagatgaaacattattgaccttcagttgctaattgttgaagctggataatggatagcacatgggggttttgtttgctttttgtataggtcttcatgtaaaagttttcatgtaagtgcttaaaaataattatggaagggcattcctgccgaattatcggttgtaatttaaatagatttaattttctattgtttagaaaacagtatttgcctttggttttcagaaatatcctgaattagatttaagcagttttcctttttttctttttttgagacagtctcactctgtcacccaggctggagtgcagcagcaccatctcggctcactacagccttcacctcctgggctcaagggatcctcccacctcagtctcccacttagctgggattacgggtgcccgccaccacacccagctaatttttttgtattttttgtagagacagtgtttcaccatgttgtccagactggtcttgaactcctgagctcaagcgctcctcctgcctcagcttcccaaagtgctggtattacaggcgtgagccaccacactctgccagcagttttcttactgttttcattatgattggttgctgaatttcatatgcctcatcagcatctattaatgcatgattttttttcccctatactgtgttgttggattaatattggtagatgcttttgatacattcctggaatctaattgctagcaaatattgtattcaggatttttgcatttatatttgtgagtgagattggcctatggcgttcattcattcctttgttcctttcttatgtctccatctgggtttgttattaaaactgtgctgtcttcataaaacaaattgttttcccttttctctatagaggcttggaatagttaaatgactttggtcttgtccaaggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaaaactccatctcaaaaaacaaaaagaaaaccagcttttggatttgtttacccttctttttccccccctcataattcattttttctctttattgatttcctgttttatctcctaagttttgcttttatcttccttccattgctttctagagattgcttatggctttgcttttgttaccctccttgatcctggggatatccagtaatgtaacaaattactgggagttacttttcatctttttccacccaatttaagcagataattatttgagaacattgactgtaaaaatgtttttcaaattttgtttaggcttttttttatggtagatacatgacttcaaacattttttaaggtattgattcaaatttctctatgtctgctaaatcagatgtatttgttgtattactcagttcttctctgtccttgcacatactgtgtttactgaatctgtccggttctcagagaactctrttaaagtttctcacttgaatttttttttttaagtttgtatttttcctagtccttgctttatgtgtttatctacagtgattatttgaatatacaggcttatgaatattacatcttccctataaattgtttcttttatcattatagcttgttatccctgttattctgcttatttttactttaattcccaccttggctgatagtagtgttgtctctcctccatgtttgcactagcctgctattttttaccttgtccctttattttcagcctctctttgttccttttgctttaagcatatacgttatagctggacggtttgttgtttttgttttttttttcccttggtttttcaggccaatctgtcttctcctttaagcagagaatttggttatttcacatttatactgataactgatattcttgaattttgtccccattgtcttgatttaggattacttctgattttgtttcttcttgttccttttccatatttttgctggtttgatgaagttgctgtttcctccatatttttctcttaatttggaagttctcattgttattttctttaatgattacctttttttttactttcataatcagatacttatctctgtattatttgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataactggggacctttccgtttcaaagggaaacagaggccccagtttccaggaagtaaattttgggggaggggattcgagaggcaaagtaaaagaagctttttattaggttttaagctccaaaaggaacccaatttggcagcagtctctcttttggggttgttactaaggttagccaccagactccatgctttccaaagcttcagggtttctaaaatttgtttaaaaattccacatatctctggctgggcacagtggctcacacctgtaatcccagcaccttgggaggctgaggcgggcgggtcatgaggtcaggagatcgagaccatcctggctaacacagtgaaaccccatctctactaaaaatwwaaaaaaaattagccrggcatggtggcgggcgcctgtagtcccagctactcgggaggctgaggcaggagaagggcgtgaacccaggaggtggaggttgcagtgagctgagatcacccactgtacttcagcccgggagacaatgcgagactccgtctcaaaaaaaaaaaaagaaaagagaaaaaaaaattccacatatctttaaaaatattgtcacatttttcagacactcagatgccttcagtactatttcctttcctcataaatgtagttcacattgctctctgtaccccagtgtcaaaatctagttctcaggtagctctaggaaactccagtgggtggcaaacatgttcaagttacagtgctctatgtaatgaagtcccttactccttgaaaggtttcaaagagagaggggaaatgacataattccagaggtcagggaagtatgtatccgtgtgtatcccatttgtgtccctagtgtctaacatatagtcagtactgaaaaaaaatttgaatattattgaaaatatggaatatgtgcgtacatatatatatacagttgcttttatcaacttaaaaatttttttaattttttaattttttgtagagatagggttttgctatgttgcccagattggtgttgaatttttggcttcaagcagtcctgcctctgcttcccaaactgctgggattacaggcgtcagccactgcacccagccaccatctaattttttttttttttttaatggagtctcactctgttgcccaggttggagtgcagtggcatgatctcggctcactgcaacctccgcctcccaggttcaagcgattctcctgtctcagccttctgagtagctgggatcacaggcacgcaccaccacgcctggctgaatcagtatttttagtagagacggggtttcaccatgttggccaggctggtcttgaactcctgacctcaagcgccaccatgcctggctgaatcagtatttttagtagagatggggtttcaccatgttggccaggctggtcttgaactcctgacctcaagtggtctgcctacctcggcctcccaaagtgctggaattacaggcgtgagcatcacgtctggcctaatttttttaatcraatttatttttgtaatgatagatgcttgtcttattcctagggaaatatttgaagtaattgagatgctgtcacctaaaataatcaaaaggctcctgattcagttaaaagaattcatttaagtacagagtgtaagcgagctacaccaaagaatggtgattagcgctcccagggtggggaaaaatgaggattgtttatataggcaaaatggaggtgccaaacagaattataacattttcrgaactaaggctcatttaaagatacaaatttgattggctactattgattrcacttgaagggatttgtttaacttccttttgtaaagaagtaacagtcataaggatctctcatctcccagtcatttagtctagttttgaataaagaatagggggtctggttaatatatacatctaaacacaaaagtcagaaagaataaaagtagtgatgttacaygagccagctgtcagtgcytaacttttccctttggcctaatgcatttggaaggtcctgaaattgtattttctttttacattgcctatgtatgtgtaagtcttcttcaggtcagttcacrctgttaaatatacgtgcgtatacatacatactatgtatgtgcgtttatgtgtgtctgtgtgttttttttttaacagacgaagcttcacaaaagatgtctaaggtaagatcatacttcatgtatctacagcataaggagaaattgctttatgttttcagactgttgacagtcgggacttatatgattcattatttttaatacaactgatacatttgattcattaacacaaagagttctaatttagttgtctttttttttttttttgagacgggagtcttgttctgtcaccaggctggagtgcagtggcatgatctcagctcactgcaacttctgcctcccacgttcaagcgattcccctggctcagcctccggagtagctgggactgcagacacgtgccaccacgctggctaattttttggattttagtaaattcggggtttcaccgtgttggccaggatggccttgatctgttgacctcgtgatccacccgctttggccccccgaagtgttgggattacaggtgtgagccaccgtgcctggcctaattgtcatcttaaaagcttggagctttctcttttttcaggcttctactttcttttctctacacacatcagtaacagtcctttggcccccttagttcattcccagcagaccagataatttagaattctgataatttattatgatgaamttgatggggctcttagacttgataaattggtttaaatcagcctttgcaagttagttcagagataaattagtgctaaagaacatattctgagaaaagcagaacttgtggttaacattgcaagattattatttctgttttttttttatctttgaatcctgtgggtgttcattactgtccaatgcaaaatcatcataccagtttttgcattttataccagtgttagcatggaacacagataagcaaaaaaaaaaagtcattatttcaccactcaggaataaccactgttaatatgttacatatattctttttcacctgtgtgtgcatttgactatacatttacaaaatgtaatcctaaaggaaatactattttgtatcttrcctttttcaattaataaattgatttttaaaatttcttctcattttcagtatgccactgtctagattctggttacttctgctattcttgccttctcatatctctgtcctctctctcatcagatacccttctgtcaaggaatattgatgcttcagtgtagtcatctatgatcttctcattctgtcttttctttcttggtctttgacactagatactcaacatcccacccctaatttgcctgcctcacccttgatgaaactctgttctatagagctagaagcacagcaagagagatgcttttttcctcgatacttttcagaaatgcattgcacctaatacctgggagaagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagtttttctttttttaatgctcctagttgaatactactggttttctgatagaagtatgacyttctggaagtgtttatactttttaaaaaatttgtgaaaamtgataacctatgtttgtttcatgtctaactgattatatcttaaaagcaactactaaggtgtttattagtttgtttgttttttaatcttatttagcaacagccaactcagtttataaatccagaaacacctggctatgttggatttgcaaacctccccaatcaagttcaccgaaaatcagtgaaaaaaggttttgagttcacactgatggtggtcggtaagaaattaatctatagtctccaacttactaaataaatatctcccctttccaatctctggagtatgataacgtgacctataaagaaagaggaaaatttggcagagtcaaataacttgagaatttgaacaaatatatgtgtattcattagaaaatttttctcaggagcaaaattatttttctgtcactttcttatttatatgtagtgaaagtttactcattgtgtcagctaggctccaaaatggcccccagtgattcttatctcctggtattcacaactttcttgtcccttcctgcattgaatagggttttacctgtgtagccagtaggacattgtggagatgaaagtgttgtcattttctaagactaggtcataaaaggcattatggccccccaccttgcctcttctcaaattactcactctggaggaagccagctgtcatgtcaagagaacactcaagcagccttacagggaagcccaccaagtaaggaaccaaggcctgccaatggctgtgtaagtgacccgtttcagaaatatcctccaggccaggcatggcggctcacacctgtaattttagcactttgggaggccgaggcaggcaggagtttaaaatcaggctgggcaacatggtgaaaccctgtctttacagaaaatatgaaaactagccaggcatggtggcatgtacctgtagttcctttcccctgagtccaggaggttgaggctgcagtaagctgagatcatgccactgcactcaagcctcaaaaaactgggtgaatgaaaccttgtctcaaaaaaaaaaaaaaaaaaaaaaaaaatccaggcatttacagtgtaacattcacaatgtctaatgtctaataraaaattgtgtggcatcaaagaaacaaaaactgtacataatcaggagaaaaagcaggcaatagaaacagatccagaaatgatagaaatggatctcgatggcaaagaagaactctattacttaaaggaaagcatgaatataataagataaaggaaagatacaacagaaaaccaagtggaacttctaaagattaagatacaaccgaaataagaaattttcatgataagcctgacagcacattatacactgcaggagaaaaagcacagtagaagcacagtaagggaaaagctggaaaaaaaaaagaaattgaatgtgccctcagtgtcctttggtacattgtgaacagtctaatatatggattatattcacagagaagacaggaaagcaaaaaaaaaaaacatgaaaaaataatgcctgggaattgtscaattttcagcaaagttgtaaatgcacagatccaagaagcttgacaaataccaggcaaaataaatataaagaaaactacaccaggacgcatcataacacgctaccagaaactactgatgagacaacaagcagaagaaataatagagaaaagcacaccaaagcctgtaataagcaaatagaccatagataaacagaaaggtctttaaaagtagccagatcaggcctggtgtggtggctcatgcctgtaatcctagcactttgggaggccaacatgggtggatcacttcagcccaggagttcaagaccagttcaagagcaacatggtgaaaccctgtctgtacaaaagatataaaaattagccagccttggtgggggatgccggtagtcacagctacttgagaggctgaggcaggaggatcacctcagcctgagacgtcaggcctatggtgagctgtcatcgtgccactgcgctccagtctgggtgacagagtgagaccttgtctcaagaaaagaaaaaagtagccagaacaaagaaatttattacatacaggggattgaagataagaggagtgaccactgaattgtcattaggaataacataactggtcgggcgtgatggctcatgcctgtaatcccagcactctgggaggccaragcgggtggatcatttgaggtcaggagtttgagaccagcctggccaacatggcaaaaccccatctctactaaaaatacaaaaacctgggcgtggtggtgcatgcctgtgacccagctacttgggaggctgaggccaggagtatcacttgaaccagggaggcagaggttgcagtgagccaagattgcgccacagcactttagtctggcgacagagcaagactccgtctcaaaaaataaaattaagtagaaattggctgggtgtggtggctcatgcctgtaatcacagcatcttgggaggctgaggtgggcagatcacctgaggttgggagttcaagaccagcctgaccaacatggagaaatcctgcctttactaaaaaaaaaaatactaaattagctgggcgtgttggcacatgcctgtaatcccagctactcgggaggctgaggccggagaatcacttgaacctaggaggtggaggttgcagtgagccgagatcccatcattgcactccagccggggcaacaagagagaaactccatctcaaaacacggtggctcacgcctgtaatcccagcacttgaggaggctaggcgggtggatcacctgaggtggcaagttcgagaccagcctgaccaacatggagaaaccccatctctagtaaaaatacaaaattagccgggcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgtaaatcttttgttgttgttgttgttttgtttgtgtgttttgtttttgagatggtttgagatggagcctcgctctgttgcccaggctggagtgcagtggcacgatcttggctcactgcaagctccacctcccgggttcacgccattctcccacctcagcctccaagtagctaagattacaggcacccgccaccacacctggctaattttgtttctgtatttttagtagagacggkgtttcaccgtgttagccatgatggtctcgatctcctgacttcgtgatccgcccgcctcggcctctcaaagcgctaggattaatataaatcttacacagacatcttcatgaaatagatgagtaggaaacacctaccagcctattttattaagccagcattatcctattacaaatgacaagaaaactacagactaatatatgttagaaatgcttgtttttcggtgccataaagaaatagtacttgaacataaattcagtttcctcagcaaggccatttttactttctacagaaagggtacactcgccagcagttttgtcaagagggtacaccgaacaaagaggatcatttgtaacctgggtcatttataacctgatgcgtctaccttactgctgtgtctggtttccactggctggaacggtacctcacattctgtatttgtcctgattggctagcaacttagaacttcttaaaagaggcaaaggcagaggagaacaaaggaaggaggaatgttgagaaaggtaaaatcaccttcaaataaggaagagcaacaggctatgacctaatgcttgcttggaccagcataagcatgccagggcaaatatttaggctgaattgtgcgagctaagaacataaagtactttgatttcctcattacggccagcagatatttaagaatgttagcacaggtctttgaataaattatgcttctaagagaagttagtattattcctaattagacggggagtaaagcctttaaagaggagcctctactttttacatatacacgagctagacatggacatcttaattaaatcttaccgagtccagcaatatatctaaataaaaagtcaatgcactgagtcctgctatgatgcaacccgtgtgtttctaaaaaaatcaccatgccatacagcatgatgaataaacaccacagggcttgtgcagaaaacagggacacaatactcagaaccttcatcagcgacacaatgggaaaaaagataggaacgtaagaattataccagtccacatgtaaatggttaaaaaataatgactgcaccatagaagccctgaggttggtttgtgcaagtggacatcaggagggttgcagcttgtgtgcttttgtgtagctgtggagggagggttttctaaagttggaaagtcataacactacgtgtaaatgggtgtggctcataacaggcagtgaagaaagatagctgatagatatttaggggtgtgtgttgggaatatccccaagtggtttgattctgttggatgcagaattaaacactgtcttctgtattctcctagtttctcaccaatgagatcatatataataagcaaatacgaaatttgtattactctgctattgttccgtaatgtatcaatcccattggaacaaattctcattttcaaattaggactgactaaacaaatggagtttatcttaggaatacatgatgcaacattcaaagtcattgtcatgcagtgtagttatcaaggaggaagatgatgttagctgaaaaacgaatttgtaaaaatccaggacccactaaagataagaaattaggctgagtgcagtggctaacacctgtaatcccagcactttgggagcccgaggctggcagatcacctgaggtcaggagtttaagaccagcccccccaacatggtaaaacttcatctctttagtacttttgtaaagtactgaaattagccggccgtgatggtgggtgcctgtaatttcagctatgctggaggctgaggcgggagaatcgcttgaatctgggagggggaggtttcagtgagccgaggtcatgccactgcactccagcctgcatgacagagcgagactccgtctcaaaaaaaacaaaagaaaaaaatcacaaacaagagtattaataattttaagacagtaccacttaacagtcacaaaaaatattgttcagagataaatttaacaaaacgtgcaagacctatacactgaaaactacaaaacagtgctgagagaaattaaaatctaaagttgttaagatctgccccatttgtggattggaactattatgccctttctcccccaaattgtcccatattttttctgagacagtcttgctctgtcatccaggctagagtgcaatggtatgattttggcaacctccacctcccaggtttaagtgattctcgtttctcagcctccccaagtagctgggactacaggcatgcgccaccacgcccatctaatttttgtatttttagtagaaatggcattttgtcatattggccaggctggtgttaaactcctagcctgaagtgatccacccttctcagcctcccaaagtacaaggattactactggcatgagccacagcgtccagctccaactttcagaaataaaaattaacaagctgattcggaagtttaaatgtaaatgtagagggcctagaacagacaaaaacagtttagaaaaagagcagagttggaggattacagtccctgatttcaagacttaacagcagtaatcaagacagtgtggtaagggtagatacacagatctactaaacagagcaacagccaagaagtagacccatcaatataataagttcaattgtttttttggtttcgttttttgagaaaaaagccaagttgattcagtgggggcaagtttagtctttttacagtctgtaacaactagatgattatgtgtgaaaaaatgaacttcaactcctgcttcacactgtatatcacaacctgaaattatagtagatttaaatgtaaagctataaaaactacaagaaaatgggcaaaaaaatttttatgactttgtagtaagcagatttcttaagacatgaagaatagaaattataaaaacaattgtgcattattaaaagtttgccttcttgaaaagacatcaataggaaaataaaacgtgaggaactcagaaagtattcatagtaccatatctgacaaaggatatgtgtccagaatatataaaaatattgcacagatcagtaagacgaatgacccacttacaaagagggggcaaaagatctgaatagacatttcactaaggaagataaacaaatagccaataaacccacataaaggtgtccacatctttggtggtcaggggaatacgcattgaaaccatgagatgccactacccagccactaagaggcaggcactccaggtgtcagcaaggatgtgaaacaactggaactcttactagtgagcatgtaaaaatgccacaaccagtatggaagccagtttggtacttccttaacagttaagacccagcaatactgcttgtatgtgtttacccacaagaaatgaaaacatgtccataaagatttgtatatgaatattcatagctacttttctcaaaatagccccaaactggggacagcagaggtatctagagagtggattaacaaattgtggtgtagccatacaatggaatattgccaagcactacaaagaaacgaactactcgtagatgcaacaacatgcatcagtctcagagctttgttgagcaaaagcagccagacacaaaacaggccatgttgtatgatgccatttaaaagttttagaataagcaaagctgatacatagtgacaaagtagattggtgtttgcctgcggtggggactggagagggtagacttcacagttacacaaagcaactctagggttatgaaaataatctttatcttgagtggagtttgattatctgagtatctacttttgtcaaaactgtacagtttaaatgggtgtattttagtatttgtaaatcgtgcctcaaagtggctttaaaataaaacaggtagggggttgagggtgagtagtgaaaagtaaaactagaaagccacaagaatcctcaacttttaaattgtagtattaatagctcaagaaaaatgggtgtatcaggaaaaccctaacacacctaattagtaaatgagagactattgaagaggaaaggcagtttttaaaattttgtcagacttctaaagaaacaggtaaaggggcattgcaccaccgtttattaaaaggatgacttaatgggataacaggcatttagtcaaatttttacactcatatttaggcatgttcaacacattgttttgttcttttcatgtgtgaaaattgcagttcacttaaaatgcagtcctaattttgtatgtctgcatgtttctttttgttttgttttgttttttgagatggagtctcgctcagtcgcccacgctggagtgcagtggtgcgatctcggctcactgcaagctccgcctcccgggttcacgccattctcctgcctcccgagtagctgggactacaggcgcccgccaccacgcccggctaattttttgtatttttagtagagacggggtttcaccatgttagccaggatggtcttgaactcctgacctcatgatccgcctgcctcggcctcccaaagtgctgggattacaggcgtgggccaccgcgcccggctgtgcgtctgcacattgcaaattcacttatttgttcttgattttcccagaattgttttattctgtaagggacagggtctcactctgtcacctaggctgaagtgcagtggcatgatcatagcctgctgtaatctctaactcctgggctcaagcaatccttctgccctagcctcccaagtagctgggactctaggtacaagccacaacacctggctaaggttttggggttttttttactttgttttggttttttgggagatgggggtctcactattttgcccaggcggggtcttgaattcttagcctcaagtgatcctccagccttggtctgctaaagtgctgggattataggtgtgagccactatgcccagccagaaataatttttcaaaagagatgtgtactccttcctcatgcttwgcagaacttaacagagggtggtttagggtacccagaggacagtccagcaccagtagtaccaagatcagaagcagttctccatgcagaattgagacctagatgatcatctgcaatgaagcagtgggatttgtgcttcccttcaaatgtaaaatttaatttttggtattttnnnnnnnnnnnnnnnnnnnnnnnnnnnnctgaaattagtcgtgtgaactcaacaaagtgagcgggaaagttgcccgacatatgacagttgccagtgctgggaaacggggatggatttaaagcaggaagaagacaaggtggcagaagggggaggttgcagagtgagggtgtgcatgtgagcccaccagaccacaggccctgtcctgctcacacgtttctgcagctcgggaagcacaagggttgttgacactatgggatagatatgttcagttttctgaaaatgtggtgagtttagtgactagcagaactgataattgaaaacctgctttgcattctatttgtcaaaaataaaaaccaacctctaaagtacattcctcacatttgtgaacagttatgtttctaattatatgatgttcaagttctgtagtctcatagacctggattcaaatcttggccctgctctggatagtactctgaccttgggcaaattagagtttctttgagtaccctcaaagatcatactgcaaacatagtagtactgtaggtactaaacacagaatgatgtttgtgaggtacttagcccagtaccaggccttatgtaaacacttaaccgattsaatggtgtcatatgaataaggtcatgacaaggtttttctttttatttaaaggtgaatcaggtctaggaaaatcgactctcataaacagcctattcctaactgatctgtacccagaaagagtcatacctggagcagcaggtaaaaacattcttatgttactgtaagtgtaattctacatgaaagatgctgaagactgcctaattaatattttatgtcttagctgtgtgttttgtttgttcttgttcagctttgaacacaaggaaaacacttttatggggtagrtgtgctgcacygaggtccttggatttgggttgtagactttctttgacacgtatccatggatccatcctctcttgagtttgtctgtaaaatgtaataagtagtttctgcctatattaaatatttgakggaaggattaagtgagaatgttttacatcaaaaatgctgtgtaactagaagattactaggatagatgttcgaattcatctactgtcagaaagttccagcacaggacaccagcatccacaaatgactgttgaatgaaataggcacacatagtgagagcctaagacttgggctgctgcaagaatatgtagccctttcagaatatttttgaattcagtttttaaatgaattcgtaaattgctttctttttcccaggaacagaaattataatttttaacatttgtgtttttaaccttccccagtagcacaataatcttagctttaaccttcccctttctgacttctctgggatctttttttcttaatccccatggtatctttggagaacctacctctgtagagaggcagtagactctgaagtcacctgtcgtaagaacgtgagctttcctcttcacatgctgcttatattccctattaagtttgtttcttttctagaaaaaattgaaagaactgtccagattgaggcttcaactgttgaaattgaagagcgaggggtcaagctacgcctgacagtggtagatacccctggctatggtgacgctatcaactgcagagattggtatgctcccccatgcccagggatctgcatttgtttasttaatatacttcataaatttatagatartgttaatgagtgattattaagtttgggattgctgtatataataaaacacctagacaatttaaagcgtgttaaatgttgactttttaaataaggaattttatagagagtaatttttttctggtactctactgtaatttgagatcgcaaagccagtcatccatagactgctagtataaatgaaacacctggatttgagccgtggttggtgaccgagatactgtagtacatcctttctatgtggaaggaagtgaaacctgttagagagtgggttgagtcgtagtgtctgtaaatgactgctcattggcatcattttcacaaataaggaaatgaagaagtagaagatagagcagtctgtcacctgtaccgtgcaaagaatgccacttttgttgtacaaactccctcctggttctattcctgtcaacataaagcatcaggtttccaccactagatgaaaaggggaaggttctgttatctttctcctacatttaggaatttctcccttcttacatgtgaaagtgctgtactgtttcccagctcagttaaatgctgtttcccagctcagataaacctgttcttgacccatgttctctaccaccctgttcctctgccccttttcacagtcacgttcctgaaaagaattggcagccctggctgggtgcgatggytcatgcctgtaatcccagcactttgggaggctgaggtgggctgatcacaaggtcaggagttcgagaccagcctggccaacatggtgaaaccctgtctctactaaaaatacaaaaattagccgggcgtrgtggcgtgtgcctataatcccagctacttgggaggctgaggcaggagaatcgcttgaaccctggaagcrgaggttgcagtgagccgagatcacgccactgcactccagcctgggcaacagtgcaagactcagtctcaaaaaaaaaaagaacgaattggcagccctgtctacactggccctctctcaggtgcatcataacctattccattcaggcttttgactctcagcacttaggggcagttatgcttggcatagtttccaaaaacttccatttgccaaatctaaaagtcagtcttctgttctcatcttgaaaatgaattattaaattatgtatatttgggcggaggcacttgttttccctttgaagtcagggaccccctgttttataccctatgattattgttaatgtttctgtttctctcagttttaagacaattatctcctatattgatgagcaatttgagaggtacctgcatgacgagagcggcttgaacaggcggcacatcattgataatagggtgcattgttgcttttactttatttcaccttttggacatgggtaagtaattgtttatcgtggagaaatgctttactacatgggtttgtaagttttacccaaactgtgtattttaatataagaattaagataatttgagrgagaagagttttgtatgtattttttttaaataagtgacaattctaaaattaattttagacttaagcccttagatgtggcrtttatgaaggcaatacacaacaaggtgaatattgtgcctgtcattgcaaaagctgacactctcaccctgaaggaacgggagcggctgaagaaaagggtgagtgaggctggcgtcctgccctccctctgggtgcgactcgggggcatggggatgaagaaaggagtgtgttcccacgctcagtctgctcaggtgtcgggaggcagggcgggagaatttttcctgcattttagtggtggttttcaaggagaacctgatggttacaaattttaatttttgccttcatgaaggtatcaaatttctattctttaaattctccttatatttaaaatgccctcgatgagtagcagttggttacacacaagtaccttccatgggagttaaatgactcaaatatagaaatgtgatctctccatgaagtttgttattttacctaaattctttactgcaaatgacccatacaaggatgtatctaagtagactggttctctgttctgtttggaaacatagcagttgtcagccagcgaagcgcctctcacccgccagcagctcctgtggtgtcccagttttagtgcctcttccgtgtatgtctgtaaagcctctttattgattctctgctatatatttttaaattgcttactttgttctgattatatgctccttaagaaagtccaaatagtttatatatgctaaactctaaaaatacaaatccctaactgaacataccggtacgtgcataaaaatacaaatccctaaatgaacataccgatctgtgcgtgtaatcacagttgctggggcagggtagggggatacagcagggggttcaggcaggaggatcacttgagcccagaagttggaggccaacctcagcaacatagcaatacgctgtctctaaaaaaawatatatatatattttatatatataatatataattaataaatatatataatatatattacatatatattatatctatattatttatattacatatgtaatatatattatatttatattatttatatattatatatattatattatttatatgtaatatatttatattggttatatatattatatttatattatttatatataatacatattatatttatattatttatatataatatatattatatttatattatttatatataatatatataataaatatataatatatataataatatataattaataaatatatataatatatattacatatatattatatctatattatttatattacatatgtaatatatattatatttatattatttatataatatattatatatattatattatttatatgtaatatatttatattgkttatatatattatatttatattatttatatataatacatattatatttatattatttatatataatatatataataaatatataatatatataaaaatatatatatttaatatatctataatatatattatatatattatatatawwatatataattgtacatatatttattatatatattatatatataatatatattataaatataatatataaatatatttataaatatatataaatattatatttatacattatatttatatacatattatatatacatttttatatattatatatatataaatataatatacatatattttttaaaataaaagagtttctaggccgagtgtggtggctcacrcctgtaatcccwgcactttggaaggctgaggcaggcacatcaccagaggtcaggaggtcgagaccagcctggccaacatggcaaaactccgtctctaaaaaattacaaaagttagccgggcgtggtggcgggcatctgtagtcccagccactcaggaggctgaagcaaaagaatcgcttcaacccaggaggcagaggttgtttgcagtccagcctgggtgacagagcaagactccgtctcaagaaaaaaaaaaaagaatttctgtaattacccacagaaagaacaactgttaagtatatatccttctagaacatagcttatgtttttggttttgcagaatgaaatcacatagtaatactattctgccatttgatttttctatttaaaaatatttggaagcatcctcatatatatactgtatcctaattcttcctggatgcacagcattccaccatatgaatatactctaacttgtccagtttcctgctgatgaatatttggcttactttttgttttactctggccccttttcttctttgaccaaatttactgtttctttgccccttgctcgctgcttttgctagtgataccctctgcctggaacagtcttccctcagatacctgtgtggggaactccctcactgagcccaacgctgcacacaagatttcacatctccatcccctgctctgctggtagcactccccccacactgcataaagtatttctctagcgtgttttttggcttctcctgacccctgaccccaggtcctgagatcaggaatctgctttgttcacttatgtattcccagagttccgaataatgtctggcacataatagatttgttgcataattgttgtaatgaacactggtgtacatctatcttttcacaattgtgtgagccaaacgaattcttaggaaataagtatacatttaaatttttgaaggatgactaaatttgctctaaagtaagtttgtaacaatttacatttccaaagtgtactcttctctccaccccctaaaactgtcctggttatgttgccagtttttgtaatgtgtttcctgtctgagaaattgtatctcatttgaatttgcctttccttgattgccgatgtgagtatctgtgctggtgttgatgccggttggtgtattctctcaggttgcagggacttggctcttgcttttttattgacttaacacatatacttatttttagatgttgactatcacgttgcagatgatttcacctggtttgactttcattttttcacatttttcttggtgcttttttccaaagcaatttttaagcagcatgtagtcatgtttggcagccttttcctaaattgtctcaagtgcctgccagttttttagaaagtatttgaacctttgaagaacccctggaagcgtagacgtttttatgctaataaatactttagyaattcctacttaagggaacttcaccttttgtactctgctatattaaatttctttgaggtagaaatgggggtggtgtcagggttagaatgctgtaattctaatctctaatcctgtatgcgaaacatttagtgctggattacaacatctgagatgaatcgaaatacttcgagcttttatcccttccttcttgggcctcattaatcacttctcttcctccagtttctccttgatgcctaccagtttgttcattctgccctatctacaagaacctcttgcctcctgccagcctctactagcttcttgccttcaccagcctttcttctagtcagacacttactggtagctgttatctgccctccccatgatcctgttcactcaggcttcctgtcatccacctgcaattgctctctcatgggcttggccaacagttcagttctcagatgtgggccccacctgtggggtttgtgtgattggcaattctacttctgaaacttcccttccttggctgctgaaccactgtgtttgcttttctatctgctgttttttaccaccttccttcctgatccctgaaggtcagtattccttagtattattttgatcacattatttctgtggcttctgatttgcccttccaggtatcttatttcttgttgtgaaccacatttacccacaggagtcctcttttgaccactgatggactcctgtccttccagctcccctgtctctttaaatggtcccacaattcttgaaatcatccagactgagaaatgtgtaaattattttttactcatcacttctgactcctctgctcacttttaaatagcttactaactgtttccgarctcttctctyctccaaagtgtaagctccatctttatgaggccagcataggacaaaagatgaggttagcatggatggatagtagaccaggaaaggggccgtaagatgaggacaggtgagcaagttcatgcttcttattgctcagtttctcccagagataagatggttcctcccatttaggaataaggatttatgaaaagactgaaggtcgagttacagagtaaaggatgtagagaggagggccttttctggagttctgaattagtgcagacattgtactaagaccaaatctctgaccattcaaggccctttttaggtcacattaaggctttccattcttaaaaaccagaaagcaaatccagtgcacagtttgaggtcgggatattttctgctcacgttgctcttgttctctcttccctgaatggctcaggtactgaggtgagaccaaacaaaactgtggcctgcctggtgcctgtgagaatgcccaccatgcaatgagcatttgagtgctagggttttaattgattgactgatgaatgcattcgtatttcaacttcagcccagttctttctcccctcaagccccatcccccacactactgcctgcttgataggwccgattgtgggatttcactgctgactgctggctgcctgttgaatgaaatacagatccccaggtcgctagcctggtgttgatggaactctccactttgtaattccaatttttgtttccttatccaactggatgtcttagattccaaccttttgaatttcttattctcaaaatgcaccccatgtgtcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacatcaaaatctatcacttacctgatgcagaatcagatgaagatgaagattttaaagagcagactagacttctcaaggtaagaactggcttcagatccacaacataaataactcctgtttactgttgtccatgttgaggtgagagagattgcctgggtatgttcagttacgagagtatttttgctttcaatatattttaagacctcatgcagtggctcatgcctataatcccagcactttgagaggccaaggcagatggatcagttgaggccaggagttccagaccatcctggccaacatggtgaaatctcatctccatcaaaaatacaaaaattaggtggatgtggtggtgcacacctgtagtcccagccactcgggaggctaaggcaggagaatcacttgaacccaggaggcagaggttgcagtgagccgagatcgcgcctctgcactctagcctggcgacagagcaagactctgtctcaaaaaaaaaaaaaatttgatacagctatcacctaaagcttagaawttttattgtaggtttaatttgttttcgtacaatttgtcccatgtagaaagtatctgacacttttcaagaaaatgttacatacccccagctttccaattcagttttgtagtcaayagcaatgtgttaagtctgtgctratgttctcgtgttgccagtgaactctggggttccctgtgtggagcctgtctactctgtgtgtctctttctaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatgtaagacatttggtgtgttccttctggcagaatttggcgtgaagaatatggatttcagacggggtgtacacttggcccccaagatagttgcagccagcagcttcattgccgccctcagtgtttctcacatcgcagaagtggtgtggggctgttgcagattggtgctgagaaccctcacccaggggccctctgtggcactactaaactagcgcttctgcctgtggcctgtagcctgcagtacctttccttcttgctaagatcttacatctttgatgttaaaaggagaaaaggagactagaacctaaactggggtctgagaggtccccagtgctggtaaggaaacagtcaggctgtataggcccctggtccactgctccaggctgagccacccctggtgccctgctcaccagtctgagactcattgtatggccctggttagctttttgtgtcttccatttattattaatagcaattacagacctgactacaaaaatagtcttctttaaaaatgaatttcatggctgggcgtggtggctcacacctgtaatcccagcactttgggaggctgaggcaggcagatcacgaggtcaggagttcaagaccagcctgaccaacatggtgaaaccccatctgtacttaaagtgcaaaaaataaattagccaagcgtggtggtgcgcacctgtaatcccagctactcaggagsctgaggcaggagaatcactgttgaaccaggaggcagaggttgcagtgagccaagattgcaccactgcactccagcctgggcgacagagcgagactctgtctcaaaaaaataataaattaaataaataaatttcacatattgtaacatgcayacattgcttttactcttgaaaaaagaggctgaggccgggtgcggtggctcatgcctgtactcctggcattttgggaggcccaggcgggcggatcacttgaggtcaggagtttgaaaccagcctggctgacatggtgaaaccagcctggccgacatggtgaaaccagcctggccaacatggtgaaaccctgtctctactaaaaatacaaaaaaattagccgagtgtggtggtgggtgcyggtattctcagctacttgggaggctgaggcaggagaatcgcctgaacctggaggtggaggttgcagtgagccgggattgcgccactgcactccagcctgggcaacaagagcaagacttcatctcaaaaaaaaaaaccaaaaagaacaggctgagagtattgcttaaactatacctctttaatcagaggacttcaaagaatgactgatgtggataaatcagtgttttgattagctgaaagtygctacatatttgccgcatgtctcacttagtttagcaatttgtagtgagttaaaataagtaagcatgttaccatccaagctgtgtcaaacacaatttaatggttgtgtaagaagttaagcgcactcagcccctccagggctgcatccttgtggctatcctgatccccattattgaggggrgtgtagaggctgaagacagggtttggggactttactttagtgtcagttgtgtgtttctcacaatgaggtagagtgagccactccttggctatctcaatccatttccctggatcctgaatcaataggaacgtgttacaatgtttgctcattcttgcctgcttttaagtattttgaataagctaggcaattaaaaaaaawtttttaagagtgcttcataagatgaatggaaggttaagttgctgactaatattcttggatccagaatattagtccttcactttatggtcttgtacatagcttaagctaaccaactcttttttctcatatgagagtaatatataaattttgagttataggaggcatgaatattttcattacattttccgtaagtccttttagaagagtgtcttctatttcagacattgttgacctgaaaatctcttaaaatctgtctgccatcctgtggtagtgatggcctcacacaggggtggcagtgcctctagcagaaatccccctgagagactcagtcgagacctgtgtttgtatatcatttattggggaagaaagggagagctacacctcactagacatttccacggccatactcattatcctgaaatcccagcagctttatgtacaatttaccaagtaattttaattactgctatttcttctaygtacttgatgggtggttttttttctcatgagaatgtcatgtgcrtgatgccaccttggtgcattcctcttctctttcagcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaaaaaaaaaaaaattaatttagccgggcatggtggcacacacctataatcccagctactcgggaggctgagttgggaggagcagttgagcctgggaggtgcagtgagccataattgcaccactgcactttatcctgggcaataaaacaagaccctgtctcaaaaaacaaacaaaaactttagatggaaaggccagaggcttgtgtcgagttctccttcaaaagcatcactctgtacgtgaggacaaacttgttgccattaggaaactgcagcacctgagttaagggtgaggccaggatgagtggcatccaagcagccagtggccgttgaagcagcagcttcgatcctcgcaaagtcctgcagccatcctcactcaccttttctttttaaccattctaatatgtttttatataagttttctgggaggccaaggcaagtggatcacttgaacccagtagtttgagaccggccctggcaacatagggagacctcgcctctataaaaattttttttaaattagccagatgtggtggtgcatgcctgtggtcccagctactagggggaggattccttgagcccagtaggtccaggctgcagtgagctatggtcgcaccaccacgctccagactgggcaacagagtgagaccctgtctcaacaacaaaagtttcctgtgttgtaattcattaaaattctcacattctaataatttgatggatttctagatacatatgttgtacacrttgaagtctaattatgagtttggaaatgagacattaagaaagattttagaggcagcaagaaaattccaccctctggaagctgagtaggcgctggccctgagatggagattagtgtgctttgcagagcacagttctcaggtgtgcttggggagcttaccctttgcccctcgttcactcacgcagatcctgctccttaaatgtggtgactacattcgcattaataaagaataacatctcaaagcaaattcttcagataatacctatttttgagtgggtaacagcaagtgttgtcgctcaagcttagagtaagaaaagtctcttgaatgttccatttcatgttgttcgaactttttaaaatcattctgttccctttttattcattatatctttaattagaaaaatgataggctgggcgtggtggctcatgcctgtattcccagcactttgggaggccaaggtgggcggatcacttgaggttcaacaccagcctggccaacgtggcaaaaccccatctctactaaacacaaaaaaaattagctgggcgtggtagcacgtgcctgtaatgccagttacccaggaggctaaggtgggagaattgcttgaacctaggaggtggaggttgcagtgagccaagatcatgccactacactccagcccgtgcgacagagtgagacaccatctcaatataaaaagagaaatgataaatacatgtcattttaaattttaaagtagaatttttkgggggggtagcaaataactatttgttgcagtgttatgattctgatttctttcgattcttaggaaagtggagaatgaggacatgaataaagaccagatcttgctggaaaaagaagctgaggtaagtaggaaagtactattggttggttggttggttggttgttttgtttgttttgagacagagttttgcaccattgcccaggctggagtgcagtggcgtgatctcggctcactgcaacctctgcctcccgggttcaagtgattctcctgcctcagcctcccgagtagctgggactacaggtgcccgccaccatgcctggctagttgtttttgtatttttagtagagacggggtttcatcatgttggccaggctggtctcgaactcctaacctcaggtgatctgcccaccttggcctcccaaagtgctgggattacaggtgtgagccaccgkgcccagccaaaaagtactattcttgtgactgaaggtgttttgtttacatccgtagatatcattggtaattaacttaaagtttatagttttttttttaatttgttgaggaggatacatataactactttattactatatatacacatctatatataataataaacatggatatttacatagcatacatgatgcttcatatatttagctgaaagactttggagacaatttagtaatgtcactgatatttgtaagtagatcataaatatggaaatatgctctgttgtaaaggtggcattcagatctgctggagttttggaaggcaaacacattattcagtaaacaataggatcataatgggctagccttttggaaacaaaaagaaaatacttctttggtcaaattaattcaatattgatcaaatatttaaatgttaaaaataaccacaaagtcacctgaagaaaatttaaatgttttataatactttcctggaggcatttctgaacacatacaaatcataatgataaggataaagatgaattaacatttactatttttggccaggcactgtgggttacacttatagtcccagcactttaggaggccaaggtgggagaatcacttcatgccaggagtttaagaccagctagggcaacagagtgagacccccctcgttctctagaaaaaaattaaaaaataattagccatgcatgtcggcatgcacctgtagtcccagctactcgggaggctgaggcagaaggatcccctgagcccaggagttcaaggatgcagtgagctatgattgtgccactgcagtctagcctaggtgaaagagcaagatcccatccctttaaaaaaaaaaawawatatatatatgtatatgtatgtatatatattatttttattgtgaggccttcattgccctccagaaaagctgattcattcccattcccctttactttgcatttctcactgtcatcagtctctttccctccttttaggttagaaaacttctcatattggccgggcgcggtggctcacgcttgtaatcccagcactttgggaggcggaggcgggtggatcacgaggtcaggagtttgagaccagcctgaccaaygtggtgaaaccccrtctctactgaaaatacaaaaatcagctgggcgtggtggtgtgtgcctgtaatcccagctactcaggaggctgaggcaggagaatcgcttgaacccgggaggcggaggtagcagtgagccgagattgcgccactgcactccagcctaggagacagagtgagactctgtcttaagaaaatttatcatattgtcttatctttctttggttattgtttctgtttggcttgcatattcgtatcatttacttgattttctctttagctgttgctttttttattgattggtaaaaagtctttatgtaataactcctgtcatattttgggaaggtgtagaagttgaaattttaggaatcacrgaacacccagaaataatgttcaaagacagcaaaccttgaaaacctataatgtgtgtgtgtgttcacagctccgccgcatgcaagagatgattgcaaggatgcaggcgcagatgcagatgcagatgcagggcggggatggcgatggcggggctctcgggcaccacgtgtaaggtgatgtgcacatatcaagaagtcagaggtaggccctgttgtcccttagcctggaagacaggcagttactaacattgtgtcagcttaaatatgacaggttcctccttaagcctcattaatattttgcattttgaagtaactccatcactaatcttaaacaaggagagattgctcctgaaaaacagaagccactactttgccacctactttctagtaaagatttttcatatttttgtctcttcttttttttttaaataatttcaacttttattttattggggtacatttgcaggttattttctaagcttgcaaataccaacattagaaggaaattatgtattaaagcacttttattagttgtattattggaaatttgttaattgttaaaacatctctttaaagggaataaaaacgtgttattaaaacagcttgtacagattaaaagtagagatggcacaaggaagaagaattatgtgaggtagataagggttccctggatggtgactgctgacctcctgttcctcagatagctttgtcccgactgatggtcattagtgaatagatctgtctggcatggtgtatgctggtctgcctgcttgaaaagaatctgcagactccagagactcaggaccaggaaaaggcagatgcccactcccctgtatcttatgtatcttatggacaggcaggctctctgaactgtccaggtggccactcccatcacttgccagaggaaaagcatgaaaggtaaagttaagtaatgacctaagagtccaaagaagagggtaggtcacatggagctggggtaaaggcaaacaaacctcatacaagagatctgattagagcttgaaagagagtttgagttggccaagatctgaggatgaaacgctgggaatttggtagaaggtctctactacaattcagggacctcattctggaagcatgagtgtgttcatgaaaacagggaggggacttgagccttcaacgacatacggcagggtgggttaggcagaaggcagggagtcttgaggcctccacagcatgtggacaggtggctgaggaaggacccagagtgacttgctggagccttagtcaccaaacgctcttgcagcttagtgggaaaggtgttcattgtaaaatacggtatttacacaaaatgcacaaaaatacgtatgtacagtttaataagttactgtaaggaaaacatccatgtcacccccaactgagtccaagttggttgctttagtttcatcatcacagtgacaccttagaatagtcctgagggtatgtgcttagttcacactttactgatgaggaaattgttgccgctccgagagtttaaaagtatttgctgatggtgccatgacttttaaacgatggcctgctgactctagaggctggtcctgcataaccagttaatggcatgtgactggggaagtgagggtacagtggaaagagacaaggatgcctcagcgatgcagctcatttgaagcaggaagcagtgacaggtgtttgcttattttctctgagcttcattttcaacctttatggaatgaaaattttacttttagatcgataamattttatttctgtatactttctagttttgcagcatttccagtttccaggagcctcatgaatggctttttggtttagttaactttgtggtcatgtaagccctgccttttgctcagtttatgacctttgttaaggagaaaagtagaactgttaataattaacgcagcagacattgcctcactcccacttaagtgtgttttgttttcttttttctagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttrccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcrtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcacttyagtgtattttctgtcactgtaggtatagaagatctgcctcccctgtggaaattggggtctgttggtgggcktgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttratctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctrtatkttatggcttattgtgtgaaggtaactaagaagtggtgttccatgacttcagagtacatccatgcggagtccattatwtgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacacygctacacttctgatcccmtttggttttactacccaaatctaaatagatasttttgataatagataactgctcttttactaagacatagtctctacctatagaaatgtattttgaaaacacktattttacacagcaattttgtatccatttaaactaaccttttatcaataaagcactattgtttagatattaaatgagtatttctcttggttatttgcaagggaaagttgtgaggttttctgggaaaattcaaagtcttgacaacatctttgtataaaatcaagaaaaattacttgaatcaatagtgtcagtactggacaagtttgtacgtattggagatccagcccaaaagaaagcacaaaagattggaaaggaattatttacaggtgatcagaacatctacttagaaagtacaagacatctggtgaaaattaacactaagaagtcagtgatatctattttctaattagaaaatgtagtgagaaaagaaatcgcattgataatagcaactactaaattactggaaatataagtgaatgattgaaatatatctaggaagaaatttctaacctataaattttcaagaataggctaaggcggctctgccacttgagtaaaggaaactggaaacctgaattgatctgggtggctggacacctacactccaaggcctctagccttcttcctgcccactggactgatcatcccaggaccaccttgggccccttttaccttgctatcagtgttttctgagcttccttatagacagacccctggatactgaaacttgctctctctagttcctcagctgacagctgccacgcctgctgccttccctccagactgccagcctcaggtcaccagcacrcaccctgcatcctaccaggggtcagtaccaccctctggccaggctctcacctgcactatccccacccggccctgcccgtctgcaggcagggatcctctgttctggggtgtgtgcaccactctgggcctggtggtgtcattgggggttggttaaaggaaaagccccagaggtgggtggcacatgaggggagcatcccgcacagctgagcccagtcttggtgtgcctgggtctcagaccccatagttgtctcaggagaaatggaggttcccctgagccagcmtttctcctgtctgggcttctgggaaacgaagggtcaggtttcactctggaatccacagcaccataggaggagtctcttaagtgcccgggtgtttcctgaagttaattattccctcaacagccacatggtgacagtgggtgacagggccgggctaggagagcacgatgggtagggtcttgaagaacacataggagttcaatgaacttctcaagagaagggaagtgtgccacagcaagtcagtcttccattctcgggtgggggtccctaggccagargaaggccgtcctggccgccaccacggagcagcctgtctcagccttagcacagcctcgcgcgatccttcgatgatccccttcggtccctgtagtcccacgagggatgcaatgcgttggaggaaggaggaggctggcagccagggactgagccaaagggtgcaaggacagccggcaaggcccgggccaagacctatccscgcccagcgagccaggcctcgcccagcacctatccgcgcccagcragcctaggcctcgcccagcacctatccgcgcccagcaagcctaggcctcgcccagcacctatccgcgcccagcgagcctagacctcgcccaagacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccacccaacgagccgactccccgcccaagatctagccccgcccagcgagccttggcttcgcctaggacattgcctcgctcagcaagccgacgccccgcccaacgagccgagcgctgcacagatttatatcctacgcmgctgcctgcctgctcccgccccttctccgtccgttcaccaatcagaactcgatcttgcgctttcaggccgcgggacgggaaggctccgccctggcgccccgcaggccaatcgactgcgcgtccgcgkcgcgggggcggggtcagggcggggcgcgctgcgcgggggctgccggcgggcagttgggagcaggcgacgccgacgcgagtctggcggctgctgcttgcgactgcggaggccgggcgaggccggtgaggacgcggcgggcgagcgagaggccgagggtgaggacgtgaagcggcctgggcgcgtggggcaggggtgggcctctccgggtgggcggcgaagcccgaggcccgaggcgagaggcccaggcggggggggcgctgaggccgcggtccaccagagatggtcccgcccggcctctgaaggccatcgtgaggcggctggagctcctaggcgggtccgggttagaggagcgtccgtctgtagggagcctgccgcgtgggggcaggcggggcggtgggccggggagtggcccgcgtggactcccgggttgaggggtgccgcgtggaggaggccggtggggctgtagaccggggagtgtcccgcgtggactcgcgggttgagttgtgccccgtggaggccggcagggccgtggsccggggagtgtcccatcccggaaggacaccccagagtggsccatagggacccgcagggtatgggcctggaggtgcctggtggaggcattttsagccgtttgcctttttagcatttctttaamttgtatcttaaaggtgggaatcaagtgttaggtgttaatatttttactccactaagggctagaaatactcataagccagtgggtagcctttgggaaacccatgaaaactggggaccagaatatggcccagtacattacacacccgrattacgggcaccttttccgtttacgctatggcagcaacccctggcctatcatgtgccattaatggatgtgaaaagcagaaattagaacaaggcatcattgaaggaaagattgtcaatacatagtgttaaaaagggatgggcaaatttaaaacccaaggccaaatctttaaagggtggtttttctctctgggtttttgtttttgttttgtttccgtgggatatttttgtctgggccactgtgtaaatgtttgataaccctgaggtggcagtgggttagcrtgttggtcttgtgtagactgccttataacaggcgacacagattttctcagtaccagagagatgggagaggacatttgaggtagggaagcatggagtaacctttacttgtaggccaaatataatttaaattttctacatctgcttgttgaaagttttgttttgttttgttttttgaggtccttaaaggtttaggaagcacttcatgctcgttatttattcagttttccaaaactcttcagagacatgaccaagttgcacagccccgttttaaagtagaggaaagggaggttgagagaggtggaatgaccagtttagggtcacacctagggtacttgcaaataccatctgtacttctcatgtgcyctatccttgttgcagattctcattaggtggttcactgttaacaaactaaatgctgatgatgcagtttcctggactgcagacgtttgctggcttatttacctataggactatcagtcgttagtaaatttccaggttccttgtatactaattcctttcccaaagaggaagttgatataaggtgtattcatttctctctgcctcaggttccttattcaaaaaatgagtttaaaatttacttggccaggcacagtggctgtaatcccagcactttgggaggccgaggcaggcagattgcatgagctcaggggttccagaccagcctgctcaacagggcgaaaccccatctctactaaaaatacaaaaattagctgggctggtggcgcacgcctgtaatcatagctacttgagaggctgaggcacgagaatcacttgaacccaggaggtggaggttgcattgagccaagattgtgccactgcacttcatcctgggcgacagagcgagactctgtctcaaaaaaataaaaaaataaataaaaaaagctgtgttaacaagatgcctggcacaaggtaagtgcttaataaatgttagccattattattatcaggtggacaaataatccgagtagaaagtagaacaagctaaccctggatatttacaaaaaacagtagagaaaaaattaggcaataattaagcaaatttatcctgtttagagggaatggtatgaactggattgccaaagcaaagatcaatgcatgggcaattccatgtgagctcatttaaatccatttggcccaaagaattcagttgcttccttcctttccaaacacccctgcttctagtcacatcaatacctcttctatattcggacagtaacagatttttcttactgctgcttgtcctttcagttttgttcttatttttccttcacccactttcatatcagcttgccagcttcccctttactcagtgcgtcatgagcttcataaacacagcatagtgctagatatacaggcaaaacyccattgtagtgttggatactgagctgaggtaattccggtcatgttctctgagatcagaatatagagtcctttgaccatagcgtatttgtcaatgccacagggagttgaaaagttgaggatcctacaaagcaatatgataaagcccagtctttggtgattttctggggagygtttagttgacagtgattctataaattggtctaatctttttggaaagtagcagtatgtggcaaagattttsattttggaatcacacttttcaaaacaatctgataaactttgttgtgtcagtagggtagagtactccatagcaagtaaacatgcttccacaagctgaatcccatcctcccatccaaggaaaatttgaaccattttgatccatggaaatatgctttaaaatgtgacttaactgaaaagttgaaatggtgtgtacacagcaatcatagtgttgtaaaaatacatgaggaggtgaacaggatcaggagggtagttagagtgttgtaagtggttttattttaagagtcatgaattgttttcccctaaactggtgttttagcttattgccattttaaaattcaaaaacaaaaaggccctataatgttgtaggatgcagtgatgaatcttgcttaatcccatctttccccttccccgcccatcctcctgattgcttcccaaaatgaaaatgtggtcatgtcctatcccagctgcaaaacctactttggtatgagattccaaccagttggcccactagagctcgcgcagcacaaccccaggccacctccccacctcccctcgggtgtctcagcccaactatactcatcctttcccagctgctcctgcagtttctatgtagtcctctgcctgtgcacacactatgtcctttgtccacctggtctcctgttcccctgtgaggaaagctgctccaggtcaggctagccagcggtgctgcctctttctttctgctctctctgtgactgcagtgggcaggtagtactggttactttctcagtcgtctccctttctgaattaaacttctgtatctttgtgtgctctgtgcacaccatgcaatcacgatggggttgaggccgcttgtggagctgagtgactgctaacaaatcactaacctttctgagcctgagttccttgatgccagctgcacatggttattgtgaggattaaatgagatgacataagcgaagggcttgacatgcatctccttgcagtggtggtcatacaggacacggtagctgttgtaatgtgtaccagtgcatttttgaggccttgtcttggaccttgtcctcttgatgaagcctcctccctgtctccctccagctgccaacttcctctctaccaccctcactttactcac

SEQ ID NO: 13444 - DNA, 29618 bp, Homo sapiens
aattgagtttggatctcttttacaaaatgtatgatttttaaaataaatcatttctactctttattcagtgtgtgcatttcctgacctttgttttcatttaagacaggacaacagttctgagagcagttctggatgtaagtctgttaagtaagatattaatctccttaattacggaaattacatagaaacctttatttttattttaaagtaatacacacatcatttattaattgttgtttccagatatattaattacaagcatggttttagacagcattggaaaagtatttatatggtaaataaaataacttctagttgtcaaggaaagtgaaaaacaggataagttcaagcaagacaagactcatgtctgtgtttcagaaccttcagatcagcctagaaccttctgagacaaggattctgaaaacttttagtctttatttgccattttatcttcaatgctgtttttaaaagctggttctcttgcaayccctggtcccccaacactgccctgataggccaattgtctaggcagcagttgtggcaacagctggaactgcctgcactttctgggcactagtgctggcataaggaccttgccaatcatgctgagcaggagtgcctagcttcccttcacgcgaccctcccaaaggtggctcagatctggaaggtccaaagcccatctcgtggcacattaggtatgaaccccaagtgtttatacctacttttgaagtaggttgttgtctacttttgaagyaggttgttgtctacttttgaagccttgcatttttacatggtccacacccatatccatagcaaaataatagttaatatcagatagctaacacttaccgagtgcttgctgcctgccaggcacaatccccacctgtgatttaatttccataactttgtggaggtgataatattgtaactcccatttaacagayaaggaaagtgaggcacagagagactcaattacacacataraggcacatgctcaggcaacacgtggccagtgcagataacaggaaaattyactgctcttccctctcataatacattttaatattatggaaatgtggtccttgaaaaagtggtcattgagcacttaccaggtgctayggatacaattcctctgcagcwtgcattctagtggggagagacaggaaacaaatgctaaaatgtgcaggrtgccaggagtggcccattccctgaaagaaaaggaaaggggagagtggttgtgtcaggagattctctctgatagggcagcatctgagcagagaccagasgatatgaggggagtgagcaacagggctatttgtgggggaagacagtaagtgcaaaggccctgaggyaggrgcgtgcctttgaaaagaaatggcaaggaatggctggaggacagcaagtgcagggaggctgggaggagacggaggaaagggcartgagatcctagagggccctggccacactgaaagaagctcctgtgaaacggagtctctcagaataggtyccttttaaagtcacctgaaaccaggtgtcagtgcctgcctgcctgccttccctccttctttcctttctttctttctttctttccttcttctttctttctytctctctctccttccttccttccatccttccttcctttctctctttcttctctttctcactttcttctctttctttctttcttctttgtttctttgtttgtttctttctttctctctctctcgcttgcttgcttgctttccttccttccttccttccttccttccttccttccttccttccttctttccttctttctttctttctttctttctttcyttctttcyttctttctttctttctttctttctttctttctttctttctttctttctttctttctttctttctttctttctttctttctttctttctttctttcttttctttctttcgaagtcttgccctgttgcccagactggagggcagtggcacgatcttggtttactgcaacctctgcctcctgggttcaggtgattctcctgcctcagtctcttgagtagctgggactacaagtgcccggcaccacacccggctaatttttgcatttttagtacagacagggtttcaccacattggccaggctggtcttgaactcctgacctcgtgatccacctgcctcagcctcccaaagtgttgggattacaagtgtgagccaccacgccyggccctagtgcctttcttacttccaaacacatgtttctgaactgcataaggagcctggaaggctgatggcagccaaggctaagtgccattgtgagcactgtgagactctagcagagttctggggtcctggtcgccccaggtgactctcgaatgggagcagctgccctccagttgcaatgctggtctctgagatgagtgactgtaatgaagagattgatgataaccccatgtcctcagaccttcattgtttctgcrgaagggaactgggaaagtcttccaccaaggaatcttttgtgaggcagtgagcttgccttcctgttttctgtaattcctcccattctcccatgtgcttgyggcgagaggaggacgtgaggattgtgttaaagggtgatgagagagcaggagtggttgcagttctggaaaaagatctaataaaacacttacctgcctgaaggcagtgtgctgaaatgaagaggcacattcaacagcattgtcatacattggacctgtgaggggtgtcattgaattgaccacttrggatgtttaaatgtttatttaaagttgcccttggctataaagcctgaagtgggtgttggagtagtcaacgactaacccaggatggatttgtgccaatacacaagtgacaacatctttcacagctgaagagtcggaggataaagccatgcccacagatcgttgtcacacaggtataaccttacattttccaaaatagtcttttaagtgccagcattgttgagtggcatgcactttttgaattatgtaatctgggcatattgtatacctttattttaaaaattttgtttaaaaatgccaatcacgtttattttactttatacmtataagtaacattttttctatcatatataatttaataaaatccaatctcactgtgaacactgtactgctgaaaattcatttttactrtaaaatagaattctgtaaattgctttaagaaagcatttattggctgggtgtggtggctcacacttgtaatcccagcactttgggaggccaaggygggtggatcatgaggtcaggagatggagaccatcctggctaacacggtgaaaccccgtctctactaaaaatacaaaaaattagctgggcgtggtggcaggcacttgtagtcccagctactcaggaggctgaggcaggagaatggcatgaaccagggaggcagaacttgcagtgagccaagatcgcgccactgcactccagcctgggtgacagagcgatattccatctcaaaaaaaaaaaaaaawttatttatatagtacttatatattatctatgtactttttcccagacacacacagtgaacaagtgatcactgggctcctttcccaggcacagtttttgtaagtaattgtgaatgcaggatacctaatatctttgatcatttaagtttttacataaaactaactctagtaggagaaaaacaaaggtgcgtaagtcacgttcacatatcttatgtagtcactttgattgtttccttggataatgatgctctgacagagtgctattgagttctcttagttccttccttccttccttccttccttccttccttccttccttccttccttcctttctctttctctctctctctctctctctctctctcacccaggctggagtgcagtggcatgatcttggctcactgcaacctccgcctcctgggttcaagagatcctcctgccttagcctcctaagtaactgggattacaggtgtgcaccaccacgcctggctaatttttgtatttttagtagagacggggttttgccatgttggctgggctggtctcaaactcctggcctcaagtgaccygcccgcctcagcctccaaaagttctggaattataggcgtgagccaccgctcctggcctcttagtgcttttgaatgaaataaaaacccgtaattattttaagaagtcttcttctatgtaaaaattagaactaggctgggtgtggtgactcacgcctgtaatcccagcactttgggaggccgaggtgggtggatcatctgaggtcaggagtttgagaccagactggtcaacatggcgaaaccccatctctactaaaaatacaaaaattaggcgggcatggtggtggcgtgtgcctgtagtcccagctactcgggaggctgagtcaggagaattgtttgtacctggaaggtggaggttgcagtgagccaagatcgccattgcactccagcctgggcaacaagagtgaaacttcrtctcaaaaaaaaaaaaaaaaraaagaaagaaagaaagaaaaaattagaactaaacaggtgttcttgtctgtccaacatagactggtagactcagagggagtattccaatgttcggaaactgaaaactttatttgaggtcaacagaaaagaagttgagatcaagtatcatgttttgtcctggagccaaatatgtagactttgctgttgagcctggcttgacactggacctttgattgatgttaactgtgactcaccctctcttgcctcctttcagtttccaaattctctctgcttgggtcaaaagtcattgyttgccagaagtttaatagtgtgtgcattgtgtgtatgtgtgtgcatgccaatatgtatgcaacccatacaatgcctggaacaccaatttagcttcatattttaacagaccatgattccaacatcatgtcaaagtcttatatgttaaaagttctgcatccacattagaaggtactatggatcactgtgtakcccatgccaaatggtacatgagctctctttctcctctgggtcctgatattttaaacaaagaaacagtgtgccattatgggcccttgattctgtgcaaagtcattgatcgttacccatccttgaggtttttttcttgaggcagagtcttgctctgttgcccaggctggagtgcaatggcgcgatctcagctcactgcaacctctgcctcccgtgttcaagcgattctcctccctcagcctcccragtagctgggattacaggcacctgccaccatgcctggctaatttttgtatttttagtagtgacagggtttcaccaygttggccaggctggtctcgaactcctgactttgtgatcyacctgccttggcttcccaaagtgytgggattacaggcgtgagccaccatacctggccccatccttgacttttaacatgtacagagcaaccaataacgagtccttcctcaaagtaaagtgaaatgaataataaatgtctaagactttgtggttaaacctaactccacactgaggtgggtcctgtccctgttgatctaaattttcctccactaggggtctaatttggagcttccctacagaggattgtgtgctgcatcctcagatccatggcgcaaggttttttccacgtgtgaaaagaagataacagatgggaaagagctatccagaattggtgtgggcgctggtaccaggcctggccatggagaggactcccccatatttaacctagggcatctrttttctgcagccttgctgcttaaaatggggtctgggaaccaaggtaccatgaggatcagcatcaactgagagcagcttgttaagacgcgaagtctcagccccactccagacctgcagcactgtaatctgcagtaggcaggattccaaggcaactcttgttcacatcagaatttgagaagcaactgttctagaatacactagggagccatatgagatctcaggrtcaagtgtagagtgacttgaggtttctccttggttgagagctcctcaaataagataggcctcccaggttaactaatttcagagcaatttttyagatttagaaaattggagtcaggcgcagtggctcacgcctgtaatcccagcactttgggaggccgaggcgggmagatcacctgaggtcaggagttcaagaccagcctggccaaaatggtgaagcgttttctctacyaaaaatacaaaaattagycaggagtggtggtgtgcrcctgtagtcccagctgaggcataagaattgtttgaaccagggaggaggaggctgcagtgagctgagatcttgccactgtattccagcctgggtgacagagtgagactctgtctcaaaaaaaaaaaaaaaaaaaraaraaaaraaaaagaaaaagaaaaaacaaaaattgggttcattttgggttttgttgcacaaatatacatatttaagcacctgttaggtgcaaggcattatggcctgaggggaggtggtttggatattcataatggaacgagattcctagaatatagaacaaagctgcaatgtttaaaccatttttctaaacttttgtgtaattcagcattgaatctcctttctcatctttacctattgtaagtccagttaaaatgagggtagacgtggatggtgaactgaaagtagcaaagtagacagatgcaatggtgrctacaaatcccactttctgatttgaaatgtgggattgacagcagttgaaaaataaggattaggtctataataaactgtctttattaatgarctatagtttragtaattaacacaaattcagaataagtagtaccatttaatgrgtttatgtttttaacaagtacadtaattagaaaggcctcatgcacacttcctgggaagctagaatagctgatcatattctgctaatgcggagggaggttcccccaagaacaacagggacaatggcatgggaaaggctggacgtccttcctggctgatgttttacacctttcttcttgggttgattgtttttttcctatgtagaagatttccttggacttggccttcagaaaacctaaatttaaagttcagctttatcaggggagcctgggmgaatggttacattaacctctttgtggcctttgaaacatacatagaaaatatcaagggatagwtgtaaaaatgaggataaaaacatctaaagtgctaagtagaaagtaactgagtagaatggaagcctgtagagcaaaaaattagattgtggtttgagtgagtggtttatgcctgtaatccgagaaatttgggaggccaagatgggaggattgcttgagyccagaagttcaagaccagcctgggcaattagcaagaccctgtctstataaaaaattaaaaattagctggatgtggtggtgtgcacctgtagtcccaacratttggtaagctgaagagagaggatagcttgagcccaggaagctgaggctgcagtgagccacatcactccagccaaggtgacagatggagatgctgcctcaaaaaaataaagttagattgtatttgcatgaagggcatgtagttagcctacaggtatgatgctagtgcttatttaattttctgaaatcttttagaagaaggctgcttgtgccacrtggggtacctgtgttcttttggctgtggagtttgcrcaggaagaggtttggagatccaggagcctgaagtcagatgacaggtgccttgacctctgtggcatgtctctttggactctgtgaaagttatttaattgctgtggttttcyagaagaatatgaagataattgtaaggtgccacatgcactgcttggactcttacagttctgacagttattcctgacaaatttcaaaaccaaagtctgtttctacttgtaggatatttctaagatatcccctgagaaattaatgacaatggagaagcctcttgtttgccagaatttattgtagaatggaaataaatacagagtgatgagtgaaccagaaactgtaattaccctagaaatacatattctttttcttttcttttcttttcttttctttttttttttttgagacagagtgttgctctgtggcctaggctggagtgcagtggcacgatcttggcttactgcaacctcygcctcctgggttcaagtgattctcctgcctcagcatcccaagtagctgggattacaggtgtgtaccaccatgcctggcttatttttgtatgtttagtagagatggggtttcactgtgttggccaggctggtctcgacctcctgacctcaagtgatctgcgagctttagcctcccaaaatgttgggattacagacgtaagccaccacgcctggcccagaaacacatattctawaaaccaacttgaattagcagcagagatgtatatcccttagatatggtattttctttctttctttmtctttctttctttmtcttttctttctttctttctttctttctttctttctttctttctttctttctytctytctytctctttctctttctttctttctctctctctttctttctcttttctctctctctcctttttttttttttgacagcattttgctgtaatgcccakgctggagtgcaatggsatgatcwtcactcactgcaacctctgcctcctgggttcaagcaattctcctgtctcagcctcccgagtagttgggactacaagtgcgtgccaccacgccyggctaatttttgtatttttagtagagacggggtttcaccatattggccaggctgttctcgaactcctgacctcaagtgatccacctgcctcagcctcccaaagtgctgggattacaagagtgagccaccgtgccrggccagatatggtattttcaatgtttcaaaatagtgcattgtgttctcacattttataatcctatttctgaaaaaacaatwgtttgttaaccttgtagcttattccaaagaagcagctttggaggatttgcagaagyggwgtcatgggagggcattttctgagctctatgggccctggtgattgtcagacactcagaggatcctttaaaagtttctaggactaggaatggaaagagagaggagccaggttaaggcaatcaggtggygatggcaatgcccagtgcagttaagtgctttgttcctgtatttcctccagacttgctgtcaaacctggacaggagccgaggaggtgggaggcaagggccagtgcatgtagtggggttcaaattccagttctacccyttcctagaggaggacttgggcaaatggagtagctcctctgaggttctctgtccataatatagtgataagagggctttctggggggaaggtggtattcagtgaggggagacaactaaactattagcttatttctgtaaatgttctccagttccaggttggagaatgattcaagttagcaaaaatgatgaggaggttggaaagctccaatgaaaccatggtcagtgggtgataagtgtgtgttgcagtttgataacatgaaagactgaaamtgagagagagttgaaaaataagtctttagaaaaatagagtttagggactggaagcctcaatgaggtagaaaaccagggtggagtaaggaggaactgaaagcaaaagaaaagcacgtgtgtgacttgagagtgagatttccaaagtcagtttcagttaccacccaagcaatcactaacccttctaaaktgtcattatttcgtatattgatatggtattttattaattaatacactttttttttcaagatagagtttttctctgtcacctagrttgaagtgcaatactgtgatcatggcttactacagcctcagcttcccaaacgatccttctaatctcagcctsctgagtagctgggaccacaggaatgtgccatcttgcttgtctaactaaaaaaaaattttttattttagacatggagtctcactattttgcccaggctggtgtcaaactcctgggcccaaggaatttacttgttttggcctcctaaatccycttggattataggtatgagccactgtgcccagwctaagtagaattttaaaaatctccttttctaaagaaaattgmatttgttgatagtaaagttttaaaattgggamgttatattgaaatgtrtctggtgcaaccagtggagtttaaattatttttgaccaaaatggattctgaagaaatggtatggatagaaaacaaagaatgtaagttttatcttgaataaaaactagttttcagggtggggtgagtggaactgagggtagaaaagggtgagaaagcaaatataataattgtctcatctctataacatttaaagatttgattaagtgaaacaaagccccagctgctggagcagaggttccactygggttccacagacacccacagcccaaatccctggaggtcagtggggctcacagtgagtgtggggatgcttctaatagtgggtgtgctcagctgggagtgggtttggtttggtttggtttggttcaaaggcagcagaagtctgcatcttagctgtcttaatgtgaatgtgggrtcttgtgacagggtctcttctgtatcctgggggtggatctgcactctgcctgatggcytagctactttgccagaccctgcctgcttggtcttcaccaggttgctcctgctgtgtatgattacagccttgrcatgggactgcatttcccttgtttaatgttggtgctgggaagccctcttgcaaccactcctttaatatcctcctttctcctgggagaagctggagagagctacaggtcmtgaggtcctcctctgggagaagggagatggagagaaacaccagatacacctccatctcctgcagctgttttgagtttgatttcttattctatttgaaggaaattttttagaataacagatacatgtataataaacacattttcgaacgtaaagagggaaagtagsaatgggatggaagtgagaccactgaaattcactggctccatgtgggagctcagggccatagtgtcatcatctacaaatggcactgaagtttctcctgccattgatacaagtttgcagcagatgttatttctgcatcatttgcattttcagttatgatacttcacctctttctcagtatcacacacaattcagtgttgactatgatattctgaaaagcacacaggccgggcatggtggctcatgtctgtaatcccaatgcttttggaaggagaagcaggtggaycctcggtgccaggagtttgacaccagcctgggcaacaaagggagacctcagttcttttttttttgaggtggagtcttgctctgtcacccaggctggagtgcaatggtgcaatctcatctcactgcaacctccgcctcccgggttcaagccattctcctgcctcagcctcctaagtagctgggattacaggcacgcaccaccaccccctgctaatttttttaatttttttgtatttttagtagagacggggtttcaccatgttggttaggctggtctggaactcctgacctcgtgatgcgcctgcctcggcctcccaaagtgctgggattataggcrtgagccactgcgcctggccgagaccccatttctataaaaatttttaaaaattagccaggcatggtggtgcgttcctgtggtytcagctacttgggaggctgagrtgggaggatagcttgagcctgggaggttaaggctgctgtgagccatgatggctgcagtgagtcatgatggtgccagtgcactccagcctgaatgacagagtgagactctgtctcaaaaaaaaaaaaaaaaaaagcaagcaagcaagcacacagatgagtttagtagatggacattaaaggagttttaaccaactcttttatttcttctctctcttaaaaaactatatgttgctgacaagaaattatatttcttctgtcatgtagaatttttattttgctccataaatgtaatgacattgggatatcatggatctgttttctgtacacctacttatcacttaaataacttttgaatcatttttcaacttgtttctattatatccatcaagttatatgtggacagatgatttggtaacaaccaatgctggcacagaatgagtgctgtgcacaggtcatccattgaagtctgtctcctgtcatgtctttgtctctcaaaaggaaactgttttggaactcagtcatgtttagaattctcagtctcagtttaagcataagcctctcctatggatgtggctgaattttactctagatactatcccattcaattagccagtttaaaacaggccagtttattcaaagctaaaattacagctgcataaagaggtagtttggactctctatgtcaggaattgggttgttttttgtggtattcattgctatgttcaaataaatgaacctgaaaggtgtgactttttcatcactgcagatgcctcagtaatagggatatttaactggtagcacccagaataacagatgttcttctacactgagtttcttggctgtttaaaaagctactttataatacctctggtttacttgtttagaatctattttaataatattttgcattgtaagatgcttctggtctctgctctttttttcaggcctaaggcaatagctaattgagactatgcatcactattaaggcatcttcactaaagggcgctgtggaaacgctgcctgagatgcagacacctgtcagaagggggctaaatttcaaacaaggaacgtggtgttgcatcacaataaagtaagtgtccagagggaacttctgcagtactgtgttttccaacgtgctgagtgatattgtaggagactattattttgctggaatttctatgaatacatctatgaatacatttaaaataaaaagtgttttttgtttttttttttgagatggagtttcactcttattgcccaggctggagtgcaatggcgctcccttggctcacacaacctctgcctcctcggttcatgctattctcctacctcagcctcccgagtagctgggattacaggcatgagccaccacgcccagaaaattttttgtacttttagtagagacggggtttctccatgttggtcaggctggtctcgaactcctgacttcaggtgatctgcccaccttggcctcccaaagtgctgggattacaggtgtgagctactgtgcccagccaaaatgtgtttttttaatatttaattttgtggccaggagtctcwcgcctgttatcccagcactttgggaggccgaggcgagtggatcacgaggtcaagagatcgagaccatcctggccaacatggtgaaaacctgtctctactaataatagaaaaattagctgggcatggtggcatgtgcctgtagtctcagctacttgggaggctgaggcaggagaatcrcttgaacctgagaggcggaggtggcagtgagctgagattgcgccactgcactccagcctgaagacagagcaagactacgcctccaaaaaaataaaaaaaagaaagaaaaaattgttttggtacatagtaggtgtatatatttatgggatatgtgagatattatgatacagaaatgcaatgtgaaataagcacttcatggagaatggggtatccatcccctcaagcgtttatccattgagttacaaacaatcaaattacactctttaagttattttaacatataccattaagttattactgactatagttaccctgttgtgctatcaaatagttggtcttattcattctttctaattattttcttggtagtcaaaataaaatgtttatttttatgacttctttttttttttttttttttttttgagatggagtctcgctctgttgcccaggctggaatgcagtggcgtgatctcggctcactgcaacctctgcctcccgggttcacaccattctcctgcctcagcctcccgagtagctggggctacaggcgccaccgctaccacgcccggctaattttttgtatttttagtagatacggggtttcacygtgttagccaggatggtctcsatctcctgacttcatgattcacatgcctcggcctcccaaagtgctgggattacaggtgagagtcactgcacccggcctccatataccagtgatagcagtgtttyatttacagtaattataggttttttttttttttgagacagagtttcactcttgttgcccaggctggagtgcaatggtgtgatctcagctcactgcaacctcygcctcctgggtttaagcgattctcctgcctcagcctcccaagtagctgggattacagaggtgcctgccaccatgcctggctaattttttgtatttttagtagggacggggtttcgcgatgttggccagcctggtctcgaactcctgacctcaagtawtctgcccgcctctgcctcccaaagtgctgggattacaggcgtgaaccaccacgcgcggcctcaaactcatatttgaaatttagagagattgccaagaccctagagttttgcatgttctcacaaattgatttcgttagttcaaatttcataccactttttctaactgatgattcttacaccttgacaggtgactgagttcaatatgattagagctgaaccatttcaaaaagcagcacaagtggcgactgccagtaaccgataataaccgagtttaatccccctcttctgctccttccctctgatggaattctcattttccctggcctcccccattgacattcatccaatgcccatgctgctggatcagtcttcctggagccatatctaacttagaaagatgaaggacttccaaccttttgggagatgacaatgtgttatcaaaatcaacaaactaatagattgacttcctttgcatatttttgcaatgttctgtgagatatcaagtcacttccctggtagtttcttattcagtatttcactgtactgctttaaaaaaaaaaaaaagtcaggcctcaaccctaacagagtcacttggagatcttgttaaaaagttgagtttagagtctgatacaggttttgagatggccctgagaacttaggttttttcataggctctctgggcaacttttatggggcagaggtttagaaagctaggagtaagctgccaggtatcaggaaaccactagatggcagggccatcccttggagccygttcttcaatcaagaaagtggtcagagaggaaagtggagtggggaagagtccaagtacacatgttaaatgcacgttaataagtggatggtgaagatgagcttaggtgttgggtcctagcgggagagtgggaaggattcctgtcacttctcacctctttctagctttatctccagtatttgaaatgcctggaggatccttaactgaaactctccactagtcaactgtgctgyactatagcacaaccactttaaaaaggtgaaagtaggaaaactagctcaatgagagggctaatatttttatggggccaatgatttgaattggtagacatatatgccytcctacatgatataggagatagagtgcaaaaatcaaaccaaagtgttttttcctaccctcactcaccacacactactcctcacatgccvagcaagcaagcaagcaatttttctgcagattctgcagtgcacaccagctgggtgtcctctaattcaactcaaytcttacactagctatctagagatactgtcagatcccacaggttaagggctcagtcccacaakactgtcccccacttcagaggccwgttataagactgaattgccagaacttctgatccactggctacaaattggggctcccaagaccctgcccaggggttcaattaatttgttacagtggctcacagagctcagggcaakactttacttacatttactggtttattagttagagatataataaaggatgcagatgaacagccagatggaaagatactcagggagctatctggaatggtcccagcactggagctcctgtccctgtggagttagggtgcacacactcccagcatgtggatgtatttgcaaacctggaacctctctgaaccctgtccttttggttttatagaagctttaatttgtaggcatgattgattacatcactggccgttagtgatcractccattttcagccctcctccctatctgctggttatggggtggagctgaaaatcctaactttccaatccagccttggtttttactgtgacccactcctaacctgaagctatccaggggccctcagctaccagtcacctcattaacatataaaggattatatgctaattatatagtatatattattatgttatataataatataatatatatatctataattacatgctatattatatatgctatctagtaatatagttagcatacactcctttatatgctaatatataattatgctatataattagcgtatacactctaaacactccttagattccaaggattttaggagctttatgccaggaaaagataaggaagaccaaatgtatatttcacaaaaatcacaccttctaagtgtatgacactttctaagaaattagcagacattacaaatcagatataaaacagatattaccatcccatgaggcttttttttgaaatgtgcatttccccctaaaaccaggaagtggcataatggagatgagagctcagatctcttgcttttctccttagtggtcactgaggtcactaagtgtcttggtgtgccactaacatttagataaagacaggtgtgtaagaccaaaactgtatctttctctttttaagccacttgaattatttttgatgtctgaatttttcaaaattccaacctaatttgtgctgtcttcaaaacagtcttattattggaactatcactgtgaatgaacattacactctaacagtggtatgttatatgaaatggtaccatttagtccttaaaattgattggaaaacagtgattggggarcatttaaatatattttaaaagtgagagaagtaacaattaatgctatactttttttaataaggagagtatattttcattgtaagtatctattaatgattgaaatgttcagaggaactactgaattcatcatctgtgtttagatgaagcaaagacgaaacccccttaacagttactcagttttttgattacccttgctggcgacttgaggaaagagtggataaaaactgccactgccagctgggtgcggtggctcactcctgtaatcccagcattttgggaggccaaggcgggcggatcatgaggtcaggagttcgaggccagcctggccaatatggcaaaaccctgtctcyactaaaaatacaaaaattagctgggcatggtggcaggcgcctgtaatcctagctatttgggaggttgagttaggagaatcgcttgaacccgggaggcggaggttgtagtgagctgagattgtgccattgcaaacaaaacaaaacaaaacaaaacctgccactgccaatctggagttggagttatcaaaactgatgatatctggaagagggcagaagatgttaccatctgcaagtttaggatgctgaagaagtggcaagaaaaggatcagagccttgccacagcccagaatttatgtaagtgcttgaaagacatcatctctcttgaagtccaagatgtgttggaaggtgagcagaaaattatatcttagttatttgtctggaatcaagctgtgtctttgggaatagytatagaacatgtggcttggttatttataagcttgggttcagagagttatgcaaatgcaaaagcargcaaggggctgctgtcctcttagtaaggatggtgtgtgcagctgagtcagaggaagggttggaagcccagccccagtgctgccctagctttgggactgtaagtaaaatctcaacctaacttgaagcctctctgttcccatctgtgaaatgggttcagaccctcctatgtcctgggctgtggtgagaatgaaaggagaccatgcatgtcaagatccaggcaggtggtctggctcagtaagggagcagtcatgtcaccctggtacttaaggcagggctggtagcattgagccttctgggccttctgtggcactgaagcaggggtcatgggggccactgggtggcgccagcaatattcaaccagcaaagagggcaagggagaaagcagagcccagggagggctggaggggatcgttcctggtgttgatccagaaaaccacagggttccttgtcttggttttcaagcacttctaattttgtatgtgtgtggatggatgtagcacattgtcataactgagctcaaatcaattcaagactttgattattatatgttgttactacaacgaatatagtgttttttttttctaagaatcctcagtaattcagagagaggttttatttaaaattctatttagatttttttattcctggccgggcgcggtggctcatgcctgtaatcccagcactttggaaggccgaggcaggcagaccacgaggtcaggagatcaagaccatcctggccaacatggtgaaaccccgtctctactaaaagtacaaaaattarctgggcatggtggcatgtgcctgtmaccccagctactcaggaggctgaggcaggagaatcgcttgamccagggagtcagaagttgcagtgagccgatatcacgccaccacactccagcctgatgacagagcgaggctccgtctcaaaaaaaataagtacataaacaccccagaaggttatatcagaagtcaaagtactatgatctctctgcatgcttttcagacatggtgagcgagcgttctgaacccycgggcccactttgcctggaggaccactgaggttttctactctctagtcttggggtgctgaagcctcaagagattagaaacaaatgcaattctctcccacctagcaatttgggatgcaagctcaaaggtgagctcctcatcccctggagaagtacaactggccamacactacttttcttggactttcacrgtggaattatttacttttcatggggaagaatgctactcagagatagctttcacagaaccaagggaaagmtgtcttcttttcttgaaaaagacttgcctcaggaaataatgggcctcattggctsctgctaattggtgaaatgtttttkttttttttttttggtctgtgtagatattgtcactacttcagcatcatgagtgtggtgggtgattaatattctggatatattttacattatttgatccataaattcataaatcatggatgatgagaagaaaaggaagtctgctttttgacactgctcttctttgtattatttacttacaggtcctgttttaaagcatcctattccttggytgtctttcctttggctctttggcaatagttggttttgatcccagctctttggctcctgggccaaggctgagtgagtgccagacagggtaaactagttcaccaggtgttcacacaggttcaggacaacctgcattgtccccacagcccttttgccacaggaataattatggttttctcccttccaaggatgggaaggtgtgtttttatttaaaaccaggcagattcctaatacttcctcatttgtgcatttctcttgacaagggatttttctgcacataatgactctcatttggtccttttgctgtattcctttcggggaaaagtttcctcccgctgctttttcatgagaaagcacgcttcactccattctctaaagagaacacagcagttgctgaatttttaatttgttcccatgagaatcgtggtttccagcagtcagcctaggccactacccgttttctggaagtccttcttagggtgaaccagcacactgcttgctgaagagcttgatcccagggattcactgctggaatcatgtgtttttggttgacaggtgttctcagcctccctgtctatatgtcaggatttgagaagtcctgatcctggctctgcagccgctgatgctaacacggaggccctggggttaaattctaggckctgagttttgagatttctcctgcttcttaagtgagacctccatttccaccctggagcccactgtagatttagacctaatttgttctggtcctgatgtaagtcctcagttaggaagtctagagttagtcagccacctttattctttgcaatcccattcttgctgttttctgtaacctctagcacaagtttccttttcagaagggaagacgctctatgcatttatagcagtgttttcttttcgagcaagcctggaaatcaacaggtggttccattataaaaacaactggagagaggggcttagagtaattcagcaagttttcatttttccttacccacgaaaaccttttgtgaaaggaaatcttacctggaacacgcactggtaaaatattcaaaagtggagctgctgtggtggggtcattgaggggagagggatttcgagggcttaccgaggagccctgcagggcctctgacttgctcctggyagggtagcttggaaaccagcagatcaggtcattatttggatttcttgaagctgtggtgcaggaatgtgtttctaagacatctgcaacctaatgggaagtaaaacactttcccacccctaggtgtggaatatttattggcacgttgtttctgaagcatagacatatactcagaccacaggtatttaaattatgttaactaaatcaaaacgtttatgaatttggatttttccccattatgaacatgtataattattttgaactaagtaagcatatgcattttcaattttttaactctttatttttataattgtgaataagtttctttcaaagactagagacttattttttaaattttatttttatttatgtattttttgagacggagtcttgctctgtcacccaggctggagtgcagtggcacgatctcagctcactgcaacctctgcctcctgggttcaagcaattccctgcctcagcctgctgagtagctgggactacaggcgcacaccaccacacctggctaatttttgtagttttagtagagacagggtttcaccatgttggccaggctggtctcgaactcctgacctcaggtggtccgcccacctcggccccccaaagtgctgggattacaggcatgagccaccacacctggctgagacttctttatttctatctagattaggaaaagacatgagaattgtgggggctcatgaagattccctttgtttctgtatcatttttaagttcctggggctgggaacacaaatacgtgggtaatactacattgcctatatctgaggttcccacagtttagcaagagagagaagggagatacataaataattgggatgatatttatatggttatagggaaagcattcccttgacttagacagtgacttcaacatgagcatagctgctggcacaggctgagaccaggccacttaaaatgttaattatgtgagcttacataatcttattatttattatttttattttttgtagagatggggattttgccatgttgcccaggctggtcttgaactcctgggctcaagcaatccttcatctcggccttccaaaatgctgggattacaggcatgagtcaccgcacctggtcaacttcaataattttcttcactttccacatccataaaaagggttattaggatggttatgtttatttgtggtaaactcttaggaacatgcctggcatttaggaagcacaaytgagcagttgctactactttttttttgtctaaaacagattccattaatatactgtttttgatattacatagatctaattcatactcatatttttaatgtaaaattgaaagatacataaatataactaaagtttttgtgcctgttctcaccacatatatttcaaaacatttatacgcatcctatttcacttttttaaataaaatatttcaagtacatagaattcaatttttggacaatgcggccatatttttttcttacttatcatattgtaatgcagtttgctttaaactaggaagccaaattatgctagccagaaccaaaagtattttttaatttttaatttttttttttagatggaatctcgctctgttgccaggctggagtgcagtggtgcgatatcggctcactgcaacctccgcctcctgggttcaagcaattctcctgcctcrgcctcctgagtagctgggactacaggcacacaccaccatgcccaactaatttttgtatttttagtagagacagggtttcactatgttggccaggatagtcttgatctcttgaccttgtgatccgcccgctttggcctcccaaagtgctaggattacaggtgtgagccaccgcrcccggcccaaaatgtttagtcctcaaataaggataataactgaatggcccagtgtgacacagagaagaggacttatgatggctgtgggtgctggcccccaacaaagctggtgttcttttctttttgtctgtagtttcttatcctcctttgggtgtctaagggtcttttacayctcttgagtttttcaatactyacctttggatgtctggccagaccatgtcctagaactgttctgtcttcccaaagtcctggacctttaatggggcagckgacaactaaatatttttcatgttaattctctgatttagtcattcttaggtgtgagatacactttcaaggtttagtttcttttgaataaagtagtttgttaatcaaacgaatctccaattgactggggggtatttttagggggatggtccttggttttgataagttactttgctcctggcctggctcagtggctcatgcctgcaatcccagcactttgagaggccgaggtgggtggatcacctgaggctaggagtttgagaccagcttagccagcatggtgaaaccctgtctctaaaaatacaaaaattatctaggtatggtggtggacacgtgtaatcccagctactcaggaggcggaggcaggagaatcgcttgaacctggagggtggaggttgcagtgagccgaatcgcgccactgcactctagcttgggtgacaagtgaaactccgtctcaaaaaaaaaaaaaagttactttgctctccaccctttgttcttggaaggcagagaccctgccttttgccctcatacttcacaccaggcagccgcttgtgccgaccacacttaatatgctgagtgccatgggggacagcacatcagcgggtgttckgatgtcttgtgagaactgtgacaaatttatgttgagtaataactaggtgytggcastgtattgtgtcatttaatcttcacaataacacagttaattaggtcccaccgttttctgaatttcatcaatgaggaaatagcagcaaagaggaggtaamaaattyggtgcaggtgcttagcccaaagactaataatacatttcaaaatgtgcttacatttattgtgcacttactatgtgccaggtgcaacgctagccctttgcacgagttgttccattttaccctttctctgatcctttkaggtagattctagtattaccttcctttttcagaagaggagaccaatggggagcattggaatgatttggttgcaagcatactacacwacttgtaaactgcagrcacaggcttaaaaaaagtgaaaaactaaccatgcaataaagaatggaatgaaccatgaagctgtttctgtggccagtcatgtttttgaagcatatcccatgctaatttctagaacagaagaaacacacgtgttcttgtgtgtaaacccagtccatggaagagaccgtctgcttgtccctcctgatctctgggcccagacaaccagtagtcaccattccaagtgaggggtggctgcaactctacagccccgttcgtctctcctcactgtcaaagctgctgagaccccagactcracacttgaaagaaacccatgtctgtgaagcacttgtggaccattcaagattgtggaagaatcactcaagagaaggagataggtgatgggatctagcttctgatggtttctattttattgaatgtctaatagggcaagaatttgaaaaacgagaatgtttgycatgcaggaggacctgggaaggagataacacatttacagggagaaagattgggattcagttgggaggagtaactgaggaaaggggtcactcaaaatattttgtattttaggtcctttttctattaaggaggaatggattrtcaaagccttaacattaaattgtaytgtgtcaggtgaattgctatggtttgaatgtggtgtgtccccctcccaaactcacattgaatttttttttttttttttgagacggagtctcgctctgttgcccaggctggagtgcagtggtgcgatctyggctcactacaagctctgcctcccgggttcaagagattctcctgcctcagcctcccgagtagctgggattacagatgttcgtcaccacacctggctaatttttgtatttttaatagagatggggtttcactatgttggctaggctggtctcaaactcccgacatcaggtgatccacccacctcggcctcccaaagtgctgggattagaggagtgagccactgcacccmgcctcacgttgaggtttaattgccattgtaacagtataaagatgtgggacctttacgaggtgattaggcaatgaggactctgccctcatgaatggattaatgctgttatcatgggagtggattccttataaagggacacgttcagcacccccttgctctctctctcaccttccgccatatgatgatggggcacaaaggccatcatcagatgttggccccttgttctygaacttcccaacctccagagcagtaaaaaaataaatcactgttctttacaaatggcccagtctcagatattctgttacagcagtacaaaatgaactaagtcatgaaacctaagatttacatgatttacagcagtggtccgcaaccttttgggcagcaggggctggttttgtggaagacaatttttccacagacccggggggcrgggggcaaagatagtttcgggatgaaactgttccacctcrtattatcaggcrttacttagattcttataaggagcatgcagcctagatcccttgcatgtgtagttcacaatagggttcacactcctatgagaatctaatgctgccactgatctgacaggaggcggagctcaggtggtaatacttgctcacckgccactcacctactgctgtggggcccactgcccaacaggccacagaccagtaccacwccatggcctggggatcggggactcctggtttagagaattaaaaagatggaatttaacatttagctcattaagagcacatctcttaagccaaagtaaggcaattatccatgtggttcaggcaaaagttctatacagttttaaacaaatggagagattttctggttgcaaattagagacaacttttctctcagagcccaaagggtcacaaaaattagaataattaggctagaaggcctcttagtgacattttttttctggttgaagaatactatgaagtatttttctaatgcacagcatacttttagtcttatgttgaacaaaaataataaaccctcaaaaaccatgactcacttggctgccttagtagtaaagcatatcttgtcttactagggtccctttaaaatgagatgaaagggactaggaaaggaataagaatattgtggcattctttccagagtaattttgttgaagtctcatcagagttttcaattttcccacaatgtrtattttaacacttaaaagtacattagaaaaattgcagaatcactttaattcaatacttttatttttagaacacttaaaaatatttttcaaatacacttgataaataatttaataaatataacataaataaatataagttagctcagatgctttcatgattaccaagttatataaataaatattttaaaataagttatgcttacatgtttgtttccacaaacactttggtacagaaatagcttataaatatttgcccttctattaaagtgaatgaaaaacaccttcaggatggatattttcccttcttagcaattcattcatgaaaacttaaaaacaatttatccacagtaaatgtcaaaaatacttgatcagaggtatyatgtggatgtaatrgtcccatccttctttycccctccctagttcttaatccacatcctatcaaagtttcctcatttcaaagttttataaaaatgacaacggtttggagggacctcgctttttaggaagcattcagatagctcrtcactctrtcaatagtcactgcccgaattctgaaagcatgaagaagtatgcagagcttgattttagttttataaaaatccggttcttcaagggaggatttttgtggcayagtctcactgttgaaattcagggcctaggagaatgaacagtaagcatgacttacatggtattccaaaattcaaatattcattcataaaaatgagtgaagccagtacatgtctcagagcctgcaactcrgtcccttatgccactcctaaacccaatccaaatctactctcagccagatcaccaggcagaatgagaaaagaaatactcattttccaagcacatscatcttcaatgagctctgaaaagacccttaaaactatttagaaaaaatcatcagtgggagttgtgtcttagaaagaaacagttcctttaaaatgacatctgctgcaatatctaattaattttatatatgttacattaaaaagcccacttctgtttagcacagggaggtgatggattgctattgatcagaactcactatcagtaacaggcctgtttactgaagacatgccatttgtgtcagataaacctggcaatgaatttcccaagtttagcactttgatttgataacagaatataaaaccttacatttgcacccytgatgaataaatactttcatatcttcctcacaaaaagtctaaaagaaagctagaataaagtcaccccattttatactggaggaaactgaggcacagagggkttaagtgacttgggaatagttgtctggttactggtagaattgattctagcacccaaatcacccaactcttggtcctaaaaatgaaatagcaactacagctctctagatgctaacattctttgatacttggatgaagctcattgcctttcaaacaagaaatctggcacatgcacacacacacacacacacacacacacacacamacamacacacgaaaagaataaaagtaaaacaattacttttcagacaatgatttctgccaccatatttttatcccatgtcctcgtcaccaaagcagtcaccctcrcttatataaatatttgttttatattagcatctgtgttatggtrattcagaacataacaaagcaagytcttgcctatgaataacattatagatgccccagatgataggtcattcttttatttggttcacattttggttcacaatgggtcataatcaggcaccaatcttgcttgtttcccagcaatatttgcagatatgcaaactggccccttgcakgcamatcctggagcacgtcctggagcctttagaggtgagtgagaaggtaagtgtagtgaaatcctcttgaaggattttaagaggcagagcctcagacaagtggtttaactctcctaaggtttggttccctcctttgtgcagatcccatatggttgytttgaggctgacataagaaaatgcacaaaaacatttgccgagtgtgggggataccacagagtgaatactttggagtctgcttttcataatgtgatctgctcacatttgtgctccctatagacggcaccctcaaggctgtcttcttgaaaatgtaggtctgtcaggcctttaaaaggcctccagacctctttttrtatctctttatcaaagaccctggctggttatctttagcatgaaaaaggtgctctcactgatagaatgaagtcttacctgcatcagctcatcaataactgccagcatgttttgatcyagaaagatctgcctcttaggatccatcagaagctttgcattcatggtcttgaactccacctggtacatcttcaagtcttcataaatactactaaggcacagggcctgggtgacatgacaagatggggaagtatccattgagatgggctaaaaacatttcccccattgcatttgaggaaagagctgtgtgtcttaccatcataaaagaggtctttctggaggccaggcaactcccattctagaggaaaaaataatcagacatcastgatatgaattcatcatacaggctgaaacttttcattttttgacttacagttatgaaagaggtctctctggaatttaggcaactctcattctagagggaaaaaatcatatatcaaagtattaattcttagtataaatctttctgactcttcaggtctcaaattttttttattatggtaaaaacacatatcataatatttagcatctgaactatttttaagtgttaagtgtattcacattgttgcaaawaaaaccattttttaaaaataatttttctcccaaatctaacttctgaagtaggaccagttaaaatcccataatgatggataccagaaaygtgaatttytagaagcaggtgagatttgatgcacagtttttaaccacactgcatgctctgggaggaaaatcctttataccttggttaattccaatggtaaacaggcctccactgtgctggttttatcttttgtgatatcttcatgatcaatctcttcagaagtgcaagggtaaaattctagagtttgtctggcctataaaaaatgaaggagaaactcagtttataacattgataatgcacctggcaccccacaaggctggtaagccagggtgccaggaaggctccggctggctgcccttgacctctgtcactttgacttgcaggaaattctggttcttcataatacaaaagaaaatagattccttacattctgtctctcaccctcctctccctaagcttggggcatgtttctctggattacatattttttcattatgtaaacacaataaatcatgtcaacagcctgtgctaaccagcctcyacacctcactgtgacacttgcttctggtgaaaattgtttcttcttttgctaaagtgactgtattctatgaatacctatttcaagtataacttctaaagggggaactgttaaggtcacagtytgatggatataacaaacatgcaaacccttaagacaagctgagatttaatttgcagtgcacasacrcacacacatacacagagatgtcatcttagtgtgttggaaagcaccgttgggtaaaattatgaaatgtatcttaggaagtaaaggactgtatgattgaagattacgatcatttttccattcaacagcctaatgggtggcaggcactccattaggtactaagaacatgacagagaagaggaccatgtataccctcctggattgcaagtttagctgctgagacagacaattgcccaaatgaccaggaggcatcagtaggtgagacatggtgagaagggcatgaagcttctgaggaggggcaggaagggaagcaaagcttcctag

SEQ ID NO: 13445 - DNA, 14082 bp, Homo sapiens
tacccacttggtcttgctcaccttctggccttacccactatgtctcccccacctgacttcgttaatcctacagccaaactcacctgctgtattcaactgcctggcatcagctagcatgacttaatctgctggcctcaaacccttctggtgttgaccacctggttttatccagctggtcttcacctccttgccttccctgcactgtcttacccacctacattagcctcaggtcatcatttggctggttttacaacttgcccttaatcctactgggcagttccccygttgatatcctggcctggggttgctcagtcttttcttcagctggatttaaacacctggttttaacaacctggctgcactcagcagaacttataagctcattgccttcatcaccttatcttgtcctcatggtattatgaacctggcattatctatctggccttattaaactcctgaccttactcacccagtmttaatttcctggcctaaaagtcctggccttaaccacctggtcaaaacttcctgccattatccacctgtacttatccacctggctttaatttgctggcctcaatctctggtcatgacccacctgatcttgcccacggggccttactcccctatccctcacacctggccttactcacctcttagggccctggccagaccctattagctttccccacctgtcctaaccctaagggccttaaccacatggccttaacaacttgtattagccacctagttttgctacctagtcttaaagaacatagttacctacatggccttcacacttggttgacacaactgtccttaaccttctggttttatctatcagacagtaaccctggatgtatagccctaggtttactcccctgccttacttcctatatgtacatgccctcttccccattgcttttcgatttaaacacctcccattaacgaactagacttatccatgtgtccttaacctcatggccttaccaacctggaatgccaatatagcttgtcaccctggcctttccacctggccttaaccttttgttcttactcacatggctttaacctcttggtctaatctgcatagctttaacctcttagcattacccagtaagagttggcctcctagctctattcaggaggcctgaacttactggccttatccacctggccttttaaattgcttggcttcctggcctggtcttaacctcatggttttaccaacgtcaatttactcacctgccttattagcctcctggccttgctcatccagtattacgccccaggctttatgcacctgcctacgcttctgaccttaccctactggcattaacctcatgttctyaccaacaggaattacccaactgatcttagctacccaacattaaccagttggtcttcataattagtcctaacttctggtcttacycagctctcccagccctgctggccttaacctagtgtcattatcctctgatcatcctcccctgccttacttttctgagcttcttctattgccttatccacctggccttagtaaacttagggccatacttaccggttgtattcatttacctggcttcagccagcatgacttaatttgctggctaggtgaagttaatcacctagctttgttcaactggccttcacctcctagccttccccttaccaccgggtattagcctcctgttattattggctggcttatcgacttggatttaacgctcttggttgtttccctttgattgacaggtctgttgttacccggatagtcttttattcaggtggatacacgcagctcgttttaacaacatggccttactcaacagacatgattaacctcattgtgttaatcaccttatcctgatggtattcttaaacaagcttcatccatgtggccctacgaaactcttggccttacygacccaggcttcatttcctggcttaaatgtcctggccttacccacctggccataacttcccatgattattcacctgytcttatccacctggatttaatttgctggcttcaatctgccatcaggacccacctgatcttacccatggaaccatactctccttcccttattcactggccttaccacctctttttactgccctggccagaccccatcagcctcatccacctgggcaaaccttatggkccataacctaatgggcttaacaacctgtattacctacctagttttaacattagttttacccaccatatgttacccacatggccttcacacttggttcttaactttctagttttatctaccaggccatactctcctggccttaccccgctaaaattacctccataggtttacttccctggacttatgcttctgcccttattccctggatttaccacctcctcccacccacttccccctagactcawacaccttgtattacccatctagattcacccatttggccttaacctcatggcctttaccaacctagattaccaacttacattacctacctggcattcccacctggccttagcctttcattctaactcacatgttttcttccgcccagtctccagtcacaaaccaaattatgaagagagtgtgtgtgcctgtgtgtatgtttgtgtgcgcaggcactggaatggttctttggaagacagtgggtgtggcacacacacgtggcatcagatcccagcctggagctgtctactacatacatggagtgtgtgtgtgcctgtgtcccarctggagtgcagtggcgcgatcttgagtcactgcaacctccacctcccgggttcaagcaattctcctgcgttagcctcccgcgtagctggattacaggcatgcgccaccgtgcccggctagtttttgtatttttaggagagacaggctttcaccatgttgaccaggctggtctcaagctcctgacgtcaactgatctgcccaacttggcctcccaaagtgctgggattacagaaatgagtgtgtgtgtgcctgtgtcccagctggagtgcagtggcactatcttgagtcactgcaacctcagaaatgagccaccgctcccagctgagactctgcatttctaacaagctcctatttgatgccactgctggcctgagggccctcactttgcacagcaaggtttcactcaatttgtttttggcttaaactaacactctgactgatatggcaaaaccccatatctttaaaaatacaaaaaaaaaaaattagctggggtgtggtggtgcatgcctgtagtcccagctacttgraaggctgaggagggagaattgcttgaacttgggaggtggaggttgcagtgagtcaagattgtcccactgcactccagcctgggtgacagagcaagaccccgtctcaaaaaaaaaaaagaaatgcagaatctctcatactggactagagcctaaagaaaaacttaattttaaaaaaagaaatgcagaattttatgcccacccagacctactgaatctgaatctacatttcgacacaaccctccagggatttgtatgattcatgtttgagaagaagtaattttaaagctactgggtagctcacagactctccagaaagccagagagccagatttgggactgttgccaccaggtacaacacccacatcactccatagaggggaggaacccagtgcctggatcaccaggccccgggcaagaactgaaggctgcaccgctaacagtggggagctgctttcacagcaaagccgccatctcctcctccctcaccctggagcccatgtgggcctgtcccttctcattctctagctttcaacccaaggcagatagagaaggttactgggccgaggccacagcccatccctcagcttaggggagaccaggagagggagtggcattttcagtttaagtaatgaggtaagtttaagtaagcagaggtgtgcctagggaggaaggggaggcttcaaaacacaagcaagggagttcagctgctgtgtggccaaagatttagcagactccactccctgcatatgtgggggcagaagagttgtggagtacagctgtgccactacctgcccagttacctttaccaaggacaggaatatcttataccctctgtttcctctgctttaatattacagtatttaaatatgatgcttgctgtatacacaaggctttacaatttgcaaagcattcccttgcatgtgttttcatttgagccacagtacgattctttgtgatagataaagaaggaatgtagtgtgatctccattttacagatgggaagagaaagaggctgggagtgaccagcctaagagtgctgaaattccaagtcttcaggctcttcacaatgcaaccctgtaaccacagtcaagtagttaatgtgtgtgaaagtaagttaaacactataatgtgttatttccctgaaaaggtgttgcttattgccctagtaatgctttataaatacatatctaacttaattgattcagccaccaagatgttgaccccagaatcagtaaagtaatcccctttcccttttagtggcatcctaaaactgttactaggaacagttaataattaatgtcagtggtgaggtacatattaatgccacagaaacccagatggaaggagctgattaaaatagtttccttcttaagagtcttctgtagaaagtaattgagagaatctcacgtgtttcttttgagctctttggaggaaataaaatggctatcatttcaatgaacttcttaagttctacaaaatccttcatccagttccaggaggtaaacggtagctaaaggacaaggacaatgacaagaccagaattcaggtcttctgttctcaagatcagtgtttattttgaggatttgttgttgttgttgttgtttgagatagcgtctggctctttaacccaggctgtagtgcagtggcgtaatctcgtctcagtgcaacctgtgcctcctgggctcaagtgatcctcccacctcagcctcccaagtagctaggactacattgcacgccaccacgcctggctaatttttgtattttttgtagagacagggttttgccatgttgccaaggctggtctcgaacttctggactcctggactccagcctcccaaagtgctggtattacaggcacgagccactgcaactgcccttgagtttcttaaataatgagtctcttctgcttttttctctagaaagatatacaaattttgtttcctcttctctctcttctaataataggtcacaccctatgggttgcatttttttttttaaatcatctgtcatgaatcctcggtctctagttttctgttattgttatgacataaagtgaaagcctcaacacagttttaaattcgggtctcagatcaaatatggttggcaaatcctgcccaatgaaataagttgtcagctgaagcagtgacaaaagaatgagtgcttttttttttttttaactgttatgacatccctgctctgtaagtaaatgatggtaaatattactacaatgaaatctaaactggaattattttattcatgttcattttatttgacttttttgcagggagaagaatcctttctgtttaaatatataagtgttggtacctatttaaccatttatggagtctctaccatacaagaagtactgtggtaagcattttaaatatagtatctcaaatcctctttggtgttatgaacattttatagtgaatgaatagctataataataataatacttgctactttgtacaaggtagccagcaataatgctagctaagccgattcacatatgctatcttgtttgccctaacatcttccttatgaggtagctactattgacattctcattttccaaataagaaaaaagacggattggagacgggcatcgcgccgcccggcgtgcgccgcacgcctgcctcgcggcgcggagtctcgcgggccccgctcccgccctccgctcgcctggcccggaccggaagcggcgccgcacggcctcggcctggcgcgggggacgggcaccggggcccggtcggacatgggcaagaagcacaagaagcacaagtcggacaaacacctccacgaggagtatgtagagaagccattgaagctggtcctcaaagtaggagggaacgaagtcaccgaactctccatgggcagctcgaggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagacctccagtgtcacgcccctgtgagattagacttgccccctgagaagcctctcacaagctctttagccaaacaagaagtagaacagacaccccttcaagaagctttgaatcaactgatgagacaattgtagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcagggatgaaaattcttagccaggaaagaattcagagcctgaagcagagcatagacttcatggctgacttgcagaaaactcgaaagcagaaagatggaacagacacctcacagagtggggaggacggaggctgctggcagagagagaggactctggagatgccgaagcacacgccttcaagagtcccagcaaagaaaaagaaaaagatacgcttgaagataagtttaaaagcaataatttagagagagagcagragcatcttgaccgcattgtgaaggaatctggaggaaaactgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacggttcttatgcaccgcattatgactccacatttgcgaatatcagcaaggatgattctgatttaatctattcaacctatggggaagactctgatcttccaagcgttttcagcatccatgagtttttggccacgtgccaagattatccatatgtcatggcagatagtttactggatgttttaacaaaaggagggcattccaggaccctacaagagatggagatgtcattgcctgaagatgaaggccatactaagacacttgacacagcaaaaaaaaatggagattacagaagtagagcccccagggcgtttggagtccaatactcaagacaggctcatagcgctgaaagcagtaacaaattttggcgttccagttgaagtttttgactctgaagaagctgaaatattccagaagaaatttggtgagaccaccagattgctcagggaactccaggaagcccagaatgaacgtttgagcaccagaccccctcccaacatgatctgtctcttgggtccctcatacagagaaatgcatcttgctgaacaagtgaccaataaccttaaagaacttgcacagcaagtaactccaggtgatatcgtaagcatgtatggagttcgaaaagcaatgggtatttccattccttcccccgtcatggaaaacaactttgtggatttgacagaagacactgaaaaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagtgaaaaaaaaaagaaaaaagacagattaagaaacttgcccatagttccttaattagtmaatgttggagcctatgtccaacctcatgtaggttcattgccaaagcctgctggcatcccragaacaggttacctctaagttttggtaaattcttcaaacactcttacctttgaaagcctaatacagcataggctctagcacctgaccaacctggctccaaatcctagtggatctgtttggcaattaccatcaacagggtttctcctgttcccataagcaagtcatctttgtagccagtgggaagaggagaaaagaacgaaagcacrtgccccttttttataagagcgtgaatgatctgttcccatcccattcatcagaactgagttttacagattatcctggggaggcttgggaatgctgatttcaaactaggcagttatgtgctcagcsaaaatttacagattttactaataagtaaagggaagaatagatgttggataaccaggcaaccaggagtcttttcctccctgagttttggtactctgtgaccttggacaagtttctgatcttgtctgagcttcagttttgacctgtgcaaaatagtatcatgcctgtaatcccagcaccttagaaggcccatgtaggcagattgcctgagcctgggagttggaaaccagcctggacaccatggtgaaatcctgtctctacaaaaaatccaaaaattaaccaggcaagatgtcatgtgtctgttgtcccagatactccagacgctgaggcgggaggatcatttatgcctaagaggttgaggctacagtaagctgtgatctcaccactgcactccagcctgggtgacagagcaagaccctgtctcaaaaaataaaaagaaaaaagagtctctgaaggaaggctatgtttgaatgggactcttcgcaacagccaactgtctgaattgcaagaagtgatggctgaatcaatattaggcccttaaaaatccatattctgactttggaagtatctgcaacttacatttctacagactgaagttaaaatgtgcataagtgggccggatgcagtggctcatgcttttaatcccaacactttgggaggttgaggagggcagatcacctgaggtcaggagtttgagaccagcctggccaacatggtgaaaccctgtctctactaaaaaaaaaaaaaaaaaaaaaaaaaaaaaaaaaaaaaaaaaaattagccwtgcatggtggcatgtgcctgtaatcccagctacttgggaggttgaggcataaraatcgcttgaacccaggaggtggaggttgcagtgagccaaratggtaccactgcactccagcctgggtgacagagtgagagtccgtctcaaaaaaaaaaaaaaagtgcgtaagtggtgcctgatggtgaccactggaactgggaaccagaaaatttccagatgtggcagtatagtacatgtcattattgtgttgctgttgtgctgctattttttgggcattaattgaaactgccccaataactgaaagacatatgataatcttaaaatctgatatacctatgatgtcttgggtgatgtcagagaaaaattctgataaggaagccattgaccagaagagctgactttgtaataaaatggaaatggtttatacaggaatatactactggaagaatgcaaggaggttctcatcgtatgcatgaatgggtagcctcatttcctctaggacacactttggaaccctctgagaaactaccagactgtataaccacctggtggttgggggggtccttataaacagcccttgattgatcaacaaaaagctgcttggtttacagataacagtttcacagtggatggtcagcatcctgtttggaaggctctgcactatgaccaaataatgcaaaaattctaattgaagaagttgagaacaaataagctcagtggcttgattgcctactggttttctcacmgtgatggaagaattgaacaattccccaaagtctgggtgcattccaactcatgggcattggccagtggatggctggctacatggtcaggaaaatgggcaatggaaaactggattcttaaaggaatgtccatatggatcatggccctatgaacatcagtaagaatttaaagaatgcaaccaggcatggtggctcatgcatgtaatcccagcactttgggaggccgaggcacgcggattgcctgaggtcaggagtttgagaccagcctagccaacattgtgaaaccccgtctctactaaaaatataaaaattagccacgtgtggtggtgggcgcctgtaatcccagctactcgggagactgaggcaggagaatcgcttgaagccaggaggcggaggttgtggtgagctgagattgcaccactgcactccagcctgggtgacagagygagactttgtctcaaaaaaaaaaaaaagaatttaagggatgcattaaataagacacatmaatgctcatgagaagaacctcttttccagcctgaaagtgattgcaactttaagtcaaaatcttgttgcacttacttgaggtggccaactgggtccatgaagtgagtggacatggggaagtggcagcaatgcagagaggggtaatcatagacacatattcctctgcaccctcagaagcacaaagtgccaggaactgtcctgtccgccagcaggaaacatgaacactgcagacagtaatggggcagatttcctcagggtaggtccctggtgcagagctgacagagaaactttattatgccatcagtgccagttgccttggaatgggtcctgacaggaatagacactccggaccacactttgcatacccagtggtggacgcaaatgctcaaaacaccataaaaggaatggagcaaaaatactacaccatgtaaaaccactgagttacatttctttaaaccaaagaatatactctatggcccataatgtccaacagtggaaaaagaggtatcacaccaaatggatacatcatgtttcttaccaccctcagaggaatagcttgatagagaattggtaggggcactggtaacatttattgtcccaaacataaggagataaggtatgcggggctggcttacacacattcatgcttgggtgctcagattcaacatgatgggggccaggggcaggtctccagtcagtagattcttctgcttttctggtggatttggggtaaaggggatgactagaatgctagtatgactgtacaattattcccacatcactttaacttcctcttttcctaactgatacagtgttcctgccagcagggctacaactctagtgccagaaacaggaatgaagtagggatgatctctaagcaaaaagtgtaactaagcctttaaatatctatgccagaattctgaagggcctaatgggttggatggtgccttcaccctaactggcataattggggttgacagtgaatgcagctatattgcatggtggttgagaaagcccactggtctataccctttattcctactctatatgaatactagtggtctaagaggtaggtacttgctagagtggtgttgctgcctgcagtctggaccagcacagtggttgaacttaatatctcttccacaggtggaaaagtctgggtaaaaatcaatgacaagtggagagaaggagcaatagtattgttggaaggaagagaataaaaaagtgggttatgcagcaagggaaattcaatattacaattgtgcctctagagaggcttagcgtaatagaaagatcctgtctcttagaacaattaaactagataccagaaagtacagctatatatttgccaagattatccctccttttggaaccctacaaggtcaaatggaaatctgcatacctgaatggcattgctctgggagacactttagccattagataaactgaatgaattgttagcgactgagtggaactctagtaatgttccagtattttttacttttatttttcatatcctacaacagagattattaagttaggaattttcaggaactgcatcctgctgggccactggggagatttgttttgtagcttaaacagatacagtattactaccttcacaccaggaatagatcagaataagacatatcatgtggaatacttagcaaggactgttagtatagttagcctaccttcagaactggccattggccagctcccaggagacaacctctaagcccttagaatattctgccggatgagagtgcttttgtatggctgaggtcttgggccatgctagactcatttaaccacataggtttatgctaataatgttatatgtagggaatgcctatttttgctctgggaaaagggctggtgtcttgtgtctgaggccagtcacacaggggctacatggctgatccgcaacaaaaaccccagtccaatgtctggatgtgcttccctggttgacaacacctctcacacgttgccacatattgttgctggaagagttaagcacactcttgtgcaactccagtgggaggggacagctggaagcttgtgcctggtgtcacctggactttgctccatgtgccttttccctttgctgattttaatgtatatcctttcactgtactaaaacatgtttcacaaactatatatatttagtaaactacaaccatgagtataacagcttttctgagtcccatgagtccaagtcaaagtcacatcaatamaaggayttttaactttaacggacatatgaggaagcaggtaggacggcctcccttgcttgctcccacagacccttggagtgccccaggccatggatgacacagcagtgtcatcagtggttttctctccacccagtggcttcttcagaaacactggggtccttgagaatagagatcgtctcttatctctgcttctgtagtttctggggcagcgcttgggatatagtagatactggaaatgtttatagtatgaatgctttacaaaaatatgcttcagtcttacttagtttgtgaatgttaatctcaaagagactgacacataactttataagataatactattttacctaaagaatgcttccagtcacaagtctgaagtgaagtacatacgggcagatgtaggatagttttcttagcactagcatgcaaggtagcactacaaaggtttattgtgtagtgcagtgacaaaagttatccaagtcactgttaattaaagacatatttttattagacgctgaaggcaacttcaaaattaaaatcccactttttattgggcaagcagtcaaggaaaggcaccctgtaaatttataaaacgggtccccaattaaactcactgtttttagagtctgagtccagaacattccttataaattcttgaacatatttgtgtgcaatttgatttctgtttttatgtccaaaacactaaagttctacacaaaccaragaagatttctttcataaaaggtacagtctcctgtatttcaactccagccccaaatatcttcatcatgggcttgggagtcagaaaggttcatcttatattaggcgttagactcttatgcagtccgtctgtttcagaagacccaaaccaacctcatccccctcacttcctgagctgctgcttaaattacagagttttattgggttgggaggaagacaggaagagttccaaaccatgaagtaaatggtaaacaataaaatattgatggcgccaaaaagaacctgagggaatcgcagagggctgacatttctcaatagccctgtggatcttataaaattgcttagccatatgtctaagagtaataaaacacaaataaactacacaaactccaattatgagagatgctaagtctttcaaacaataaaaaaattaaatcctttattttaaaatgttgccactttgacctgttaggagctataggcagataaattttaaaaatatttagatttgaaaataagtacctaaaaaaatccaaactcagaactgcacaccacaacacatagcctccaatgtatcatt

SEQ ID NO: 13446 - DNA, 13363 bp, Homo sapiens
tttaagcatataaattctttggcttctctttttaaatttgcttttgactgtttgttgctggcgaaaattatttaaagtaattaggaactcatcgtaaatattttgtacactactctaaaaatctaaytccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactastatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctrtatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcvtaaagtgctgggattacaggcttgagccactgcactcggcctgaagcattttatgatgctcactaccragtgttcataagcggtaaataaagcccttgggctaggtaatgtaagatccattgcaacctggagatgaagaactttgtaaaggggataattgttatcayccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaawcattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaacygtatataccattgaagatgttttgggtataaaagggaatttccataataattacatagtaatcttttakagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatrtcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacayagaaaccatctttgattttcaactcctaattgrgactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttsacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttagraagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgcygccttgccattgacaggtcttcacaatgctttcttaaacgacattctttggaactgtctttcatagtcaggcgacccgccagccaggccgccaggtaggtggaagggcggcttcgggaactagatccggctsgttctctgctaacatgtggtcctcgatgctctagcggattggccccaaacctcagcacacagagctttggtagggctggggatgcmggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacragggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgsaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcrgatgtggacaattcagatgataatttcctacttcaggtggactcatacacttgatatttttcaactctgatgggtaagaaaagtaagcaaagagtartgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctrtaatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttartacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagacyctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttcyttctttctttctttttttttgagatggagtttcgctcttgttgaccaggctggagtgcagtggtgcgatctcgactcactgcagcctccacctcccaggttcaagggattctcctgcctcagcctcccaagtwgctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatkttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataatraacttaggaactggtgttacaatayggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgaaattagtagatctaatttttrtgattgagtgaaatgtcttaaaccacataaatgatggagaagagtcttaaagttcttaaacttcaaacttcttaaacgtttgggcttagttttaaaaaattactgaatcgtttataaatttttctttggttattagaggcaacatttrttttgtagtcttttttttttttttttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaattttttttttttttttttttgkatttttagcagagacggggtttcaccatctcagccaggctgaccgggaactcttgacctcgtgarccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacmcagtgagttacagaaatagatgctggaccatccctgttctctgcattagaaaactatactgctaacacatakaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttmcttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaarttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatrtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaa

SEQ ID NO: 13447 - DNA, 23063 bp, Homo sapiens
  misc_feature (1)...(23063): n = A,T,C or G, or insertion/deletion polymorphism (see Tables 1-2)
cagactctgtggaggtggagctcaggttatcacataattttataaagctcctcaggtgattctaatgtgcatccagcattgagaacacctgccaacttgttgctcctcagtaatcacactttagtatgcgcaagaatcacctggagaactctgaatgtagatgccagggccccacgcccagaaagtctggrtcaatacctctgatgggggctcaagatcctgcttttctaacaagctctccagaggttcagatgcaggtagcatttggaatattaagagacacttccattgcccttctgtctgctcccttcccaggagactcagctaattagatgagttccttagatcaatgatcctcaatctttgatgaatataagaatcatctagggagcttactaaaaatacagttgcccagacaccagtccagtttgtttaaccagatcctacataaccagctgccccaggtgttaggatgcatcctgaagtttgagaatcaacacctagaagagtggtcctcaaacctgagcaggcaatgtaatcccctggggagcttgttaaaacacagattgctaggccccacctctagaatttctgattcagtctatctggggtggggcctgagaatttgcaactcctaacaagtgccaggtaatacagaattgctaatttggggaccctaattgctttagattratgttctaggccaggtgcggtggctcacacctataatcccagcactttgggaggccaaggtgggcagatcacttgaggtcaggagttcgagaccagcctggccaacatggcaaaacccccgtctgtactaaaaatacaaaaatttagctgggcatggtggtgcacacctgtaatcccagctacttgggcggctaaggcagaagaatcgcttgaactaggaggcagaggttgcagcgaaccaagatcgtgccactgcactccagcctgggtgacagagcaagactctgtctcaaaaaaacaaagattgatgttctaagcaaagtgtttatcccactctgtctccagttcatcatttctcctcattccctcagccagcacagaattcagttgaggagacagaaagggcagagggaagcactcaaagaggtcttgacttgaagggactttcagagaaggacttctggtgagctcaccactagggaaactggcaaaattctagtaactctctacagccaaagatggtggccaaattccagtgggaaatagaagtaacctgatcaatagctgttaacttcacagatacgtccagttccaatgggactcaagagcttagagcttccctggcagaatctctcagcctgtggtggtgaggagtgtgtaggtatagtgagaaatcagagaaagtttgaggctggggggccgggcacggtggcttatgcctgtaatcccagcactttgggaggccgaggcgggcagaacacgagatcaggagtttgagaccagcctggccaatatggtgaaaccccgtctctactaaaaatacaaaaattgtctgggcgtggtggcgtgcgcctgtagtcccagctactcgggaggctgaggcagaagaatcgcttgaacccgggaggcggaggttgcrgtgagccgagatcatgccactgcactctagcctgggtgacacagcaagactccatctcaaaaaagaaaagaaaaggaaaaggggctgacacttgttacattcgttcattcattcattcatttagaaataaggtctcactatgttgcccaggctggtcttgaactcctggcctctagcaatcctcacccctgagcctcccaagtaggtgggattacaggcatgcaccaccatggctggcttcaccaagacaattaaatggaaaaaccaagctggagctagagagtcctccctccaatggcattaaccccagcttgtacaatactctggagagagagctaaaaagacagtagggtgaggatgggaagagccaggtgagggagaaagtcattttcttccctttatatgaaaagagaatgagaaattaagggcaactggagaaccaccaaaaagagggaaggagagactgggctaggaagcccaccagctggagtccttacaaaatctgctccatctccacaacctcgtgccagaacttggtgatgtgctaagggcatgtgatctgttgaaacaccagaagtcacatttttaggaagtcagaaggcagacggctagatccagcatctgctgatttccttatacatgccaccgacctatccactaactcattgccagtgcatcacatgaccagcaggttcaggagaaattccaggtgttagaaccacagtcacagggctgaacaggcctggggtatttcagaaacaagcatcaccctatgcaggcttggatatcagcactgcgtggtgattatggtgatagggaagttctccagttgggtggacagagttaaggaggtaattagcagaactagctgccctgaggtattgatccccaaggttctacaagtggtaactctagcttggtcagctacctactataaatcacttacagcctcagtttctcacctgtaaaattatgctgttgccttatctacccgaaggcaggagactaaaccaagtgatatctccttttcttcccgcccccagccaggcaccaagtctattctatccccaccaatctcccatatttgtatcctctgctcacatcccattgccatagccctggctcagacacttttcagctcctacctcgctgattgcaatagtctccaaactggttttccctgctggtagtctcacccaggcccaagaatcttcctttgatcaatttttcacactgctccaaaatctttaacaattccacatcacaagaaagttcaaagtccttcatgtgtcaggcagagtcctctaggcccgtaggttccagctcttgccaatccctccagtcaaatcacttcaatgccagcccctaccccagcggctggaaccacctgcagtccctccggtgccctgggcttcctccctcctcttcacgtttgcatgtgctgtttcctctgctcagagaagcatttcttcctcctgtatttgcccttcaagattctccccaaggtcacctcctccaccttgctgtcttagccatccctgcccatcttgtaaatcttcctcaccctgtactctattcatttgcaatgtgtctcttccccaacttgacccttatctcactggggttgagactggggctctcatctttatacccaatacacagcacaatgccaggcccatggccgactcccaataagtgtttgctatattaatgagtgaaggatgaatcagtgaataaatgaaacttttgggttctcttctagcccctaatcctcaccaacctgtgctaagaatgcccttcttaggccagccatggtggcttatgcctataatctcagcacactggaaggccaaggcaggaggatcacttgagcccaggagtttgagaccagccagcctgggcaacatggtaagaccctgtctctacaaaagaattaaaaaaaaaaattagccaggtgtggtggcacatacctgtggttccagttacttggaaggctgaggcaggaggatcatttaaacccaggaggtcaaggctgcagtgaactaggattgtgccactgcactccagcctgggcaacagagcaagaccctgcttcaaaaaagaaaaaaagagtgctcttcttttagtggtcctttggtcctttttttttttttttcctgagactgagttttgctcttgtcgcccaggctgtagtgcagtggcaccaaactgggaagctattgtagggtagactgggctcaactaatggtgatggtggggagggagagaaatggacgacttcaagagatatcagtcaaatccccaggatttggtgatggaggggatgaaggaaaccaggagagaagcatcaggatggccccaggtttctggctttcataattgaatggatgtggtgcyatcatctgagacagaaagtgatgggagatgtctccacactggggcatgaagactcggccagtttggggcaggttgactttgaggtcccctgtgagtgacaaccaaaaggggtgtcaagtagacaacagaaaataagagtctggagtgcagaagagaggtctggctagagatcagctttgtaagccatctgtttattggtggtcatttaagcctgggtgctaacaagatcctaagggagaaagcttagggtgggaataggaagtttaagatcaggctttaggaatcctaacatttaagaccgagtaaaagaggttgagattacaaaggaacccaagaagccagagatgttaacaatggctgtggaatgctatgaaagtattttacatttgtagctacttttacaattgaataaaaatgtttagtttaaaaagccaatttttttatggcttctagaacttaattcactttctggattttgaaaaatagtgcctgagggcaagaggtgatagtcaaaatatttaactatcaagataccccagtaggacactttcgcctgagccagctggaggagggaggatctcagaggcctttgctgtgccacaggcattaaccctgtggttgctggatcatgaagaagtggagagaggctgatggcaggggccacgcngagaggatctcaggacagcatctgtttagtcaytgagcagaaccagtgcctgctgctgagaatcagtcctgcagcagggtcatcaccagctggatcccaccagatccttccccaccatctccacctactcattgccccccagagttctccaccacaatggactattcctcatttccttagaacacctcaccttttcatgcctccatgaacttccctacgcctacaatgcctttcttctagtttggcaaatttctgtgtgtatttgaatgtccagrtaaaatatcacctcttctgtaaagtcgtcattgacttcaccaggcagaatcaattgcttcttcattatttttccatgcattttatgcagacttagtatagcactttgcaaagtggtgagctccttgaggactaggactgcctcatttgtatctaaaataatgtcctgtgtatgggtactttaaaaaaatgacaaagggccgggcgcagtggctcatgcctgtaatcccagcactttgggaggccgaagcaggtggatcatgaggtcaggaatttaagatcggcctggccaagacggtgaaacctcgtctctactaaaaatagaaaaaaattagtggggcatggtggcaggcacctgtaatcccagctactcgggaggctgaggcagagaattgcttgaacctgggaggcagagattgcagtaagccgagattgcgccactgcactccagcctgggcgacagagcgagattccatctcaaaaaaaaaaagaaagaaagaaagaaatgacaaagattgttgaatgaatctcaatgtgactgaaacctcaaaaagagacctagaacatcctttttttttttttttttttttttgagatggggcctctttatgttgcccaggctgttctggaactcctgaactcaagggatcctcccactttggtatcccaaagtgctggaatttacagatgtgagccactgcacctcgcctagaccatcttttccctcaatttgttattaaaactcagcaacctcactgacacatgctatgccatggataaaacttgaaaacatcatgttaagagtgaaagaggccagtcacaaagaaccacatattataggattctattgatatgaaatgcccagaattggcaaacccacagagaggacagaaagtagtaaattagtgattgcctagggctgagggggttggggagaaaaamggagtgattgtgagtgggtacaggatttctttgtgaggtgatgaagtgttctaaaattgattgtgatgtctcacaattctgtgaatctactaaaaaccattgcattgtacacttcaaatggtgccagacgtggtggtatgagcctgtaattccagccactcaggaggctgaggtgggaggatcactctggcctaggagtttgagatcagcctgggtgacagagcaagaccctgtctctagaaaagagaaagaataaatgggtaagttgtatgatatatgaattatatctcaataaaactgattttttttctttagagacagggtcttgctctgtcacccaggctggagtgcagtagtgcaatcatagctcactgcagcctcgagctcctgggctcaagcaatcctcccgtctaggcctcccacagtattaggattacaggtgtgagccattgcacctagcccagaattgattttyaaaaaacacctcagcaactcctcttacttcatctaattcaaagggagggcttaaatgtttccttcttggaaggaaggtggacccaatgggagtgagtatggaggggtataggcaggggtgctgctgtggtcagcttgggaaagatagggcatacgtggaaagcaggctgagtgctgttaatataatgggctgagaatacttcagaaagaggggttctggtgaaaacggaaaccacttcaatgaaaccagattgcagcagaaaggctgaggttactgtgagaacagtgaagttttactttgaaaccaatggctgagtgtggtctcctcatctggcctgggaatcttctaggaggaaagaattgttatctaggagaggattaaaattctgatagatgaggctgggcgcagtggctcacgcctgtaatcccagcactttgggaggccgaggtgggtgaaccacgaggtcaggagtttgagaccagcctggccaacatggtgaaacccccgtctctactaaaaatacaaaaattagccgggtgtggtggtgcacgcctgtaatcccagctactcaggaggctgaggcaggataatagcttgaacctgggaagcagaggttgcagtgagccgagatgggccactgcactccaacctgggcgacagagcaagactgtgtatggaaaaaaaaaaaaaaattctgggctgggcgggtggcttacaactgtaatcccagcactttgggagcccaaagcgggtggatcacaaggtcaagagaccgagaccatcctggccaacatggtgaaaccccgtctctactaaaaatacaaaaattagccgggcgtggtggcatgtgcctgtaatctcagctactcaggaggctgaggcaggaggatcacttgaacccgggaggcggaggttgcagtgagccaggattacgccactgcactccagcctggcaacagagtgagactccgtctcaaaaaaaaaaaaaaaattctgatagctgttgcctagaaacccagcaaccataaagtagaaagcttgaaaggggggctgctctccttttgccctagttggactctcctgagaggtgataaatcctagtaccgcgcatgaggactctggagatggctgcctgggttcgaaccctgactctttgcatttggagctgcattgcctcgtgcaagtcactcaatctgtctgtgcctccattttctctactgttaaatggggctagtgatactaccttcctcataggattcttgggaggattaactcagacaacacatgaataatttagcacagtgttggtctggcatggtggctcatgcttgtaatcccagcactttgggaggctgaggcgggttgatcacttgaggttaggagtttgagaccaacccggccaacatggtgaaaccccatctctattgaaagtacaaaaaattagccaggcgtagtggcgggcgcctgtaatctcagctactcgggaggctgaggcaggagaactgcttgaacccgggaggcaaaggttgcacagtgagctgagattgagccactacactccaaactgggggacagagcaagactccatctcaaacaaaaaaaaaaaggccgggcacggtggctcacgcctgtaatcccaacattctgggaggccgaggcaggcggatcacgaagtcaggaaatcaagaccatcctggccaacatggtgaaaccccatctctactaaaaacaatacaaaaagtagccgggcgtggtggtgggcgcctgtaatcccagctactcgggaggctgaggcaggagaatcgcttgaacctgggaggcggaggttgcagtgagccgagatcacaccactgcactccagcctgggcgacagagcgatactccatctcaaaaaaaaaaaaaamaaaaaaaacaaaagcaaaaacagaaaaagcacagtgcttgatcrtggaggcactaataggaggcagtctctggagtgagaatctggaactgtgaaactggttgctggagaagcggctgatgcctgctagcctggggtgagatctaatattaggcaaagagacagcagctggctgggggtcagggtgttggctgggaaatggcctgaaaattgttaacagcctcctggcttaaccctgccagtagggctcatacttcctgttttcagtgtctctgagccctgatgctggagctgctcaagtttgaacaagatctttcttggcccctgaggggaaggcagaaactgaacagccactcggcttgggcagcttcctagcaggtttccactcccgcaaaatagtgcagttctgaggtgggagagggcaragggttcccatctgatctgatgctacaataatttacttagctttgtaataataaccaccgtttttatgcttttattaggtgccagtattatgctaaaggacttatgaactcatgaatcctttctgttgttgttgttgttgttgagacgaagtcttgctctctgttgcccaggatagagtgcagtggtgtgatctcggctcactgcaaattccacctcccagtttcaagcaattctcgtgcctcagactcccgagtagctgggattacaggcatatgccaccacgcctggctaatttttgtatttttttttttttagtggagacagggtttcaccttgttggtcaggctggtctcgaattcctggcctcaggtgatccgcccaccttggcctcccgaagcactgggattacaggctgagccactgtgtctggccttcatgaatccttataacaacccagggaggtagattgtatcatctcttttgtacagatgaggaaactgaggtgcagagaggctaataacctttctcaagtcacacagctggtgttagattctagttcaggccaccggactcgaaaatccatgctctaaaccactgcatcaacctgtgtaaaacagcacactagatgatggggatcaaaagccgaatactaatcccagtactttgggagaccaagggaggcagatcacctgaggtcgggagttcgagaccagcctggccaacagggtgaaaccccatctctaccaaaaacacaaaaatgagccgggtagtggtagtgcatgcttgtaatcccagctacttgggaggctgaggcaggagaatcgcttgaacctgggaggcagaagctgcagtgagctaagattgygccactgcactccagcctgggtgacagagtgagaccctgcctcaaaaaaaagaaaaagccaaatacttggagttcttgccctctagggaagcacggtccagaaagcctttaaccaggaaatccaggagaccttgtgccaccaaaccccactcagaaaactggctgttcatgcagagaactcatgctgaccatatcttgaatttttctgggcacttcatatattctgaccaattgtccccaaaggctgtcaatcagtggtgcatgttagtaacacygagggagcttttctaaaaccacragacctggagccagccctgacctgaatcacaatctctacaggtggagtgtaggtgtgcatattttaaaaggtcctcagatgactcgattaagaaacactgccccaacccattaacacagcttggcaattctaatttttgatacccaattatctcccaacctgccttctacaccccagcttttcagaacttgatgttttgttcaaaatatatagtcacccccattaggacatcatccagctttgagattctgggccccctaatcataggcatagcaatggctggtcacaagctctgttaacacactgagaaaattccagcatcagtcccacacacagatgatgggaaattatgktttttgtttcctgaatgccacagagtcaagctggcattctggataagcaattttctttmtttmtttwtttttttatttatttgaggcgaagtcttccctctgtcgcccaggctggagtgcagtggtgcgatctcggctcactgcaacctctgcctcccgggttcaaatgattctcctgcctcagcctcccgagtagctgggattacaggcacccacccccacacccggctaatttttttgtatttttagtagagatggggtttcactatgttggtcaggctggtctcaaactcctgacctcaggtgatccacacacctcggcttcccaaagtgctggattacaggcgtgagccactgagcctggccagcaattttcacttacaggtcttcttcttcttyttcttcttytttttttttttttgagacagggtcttgctctgtcacctaggctggagtgcagtggcacaatcagctgactgtaaacttgaactccttggcttakgatcctcctgcctcagcctcccaagtagctaggactacagacatgtgctaccacacctgrctaatttttttattttttgcagagacagggtctcactaagtttcccaggctggtctcaaactcctgggctcaagcgattctcccacctcagcctctcaaaatgttaggattacaggcatgagccactacacctggccacaggtgttcttcttggttgaggtcagctcaaggattgttgggggcagagtgaagagactgttgtggagttaaccctaaagaagaccaccatgtacagctgtacaagatgtgcactgcacaaaggcatcaggttaaggaggcaattgggagctgacactaagcctgtacactacttacacagccatgggattgtggtttggggaaactttgtatacattaagtgctgtggtggccctgccctacagctctcctaacctctacctcccaaagctccattaagtccagagatgcagtcccataagaaactctagggtgcagtccacctttgttattttctcctttttatgtactccaactccttcccatacaagcaccagggagatttgtcatcagaaaaatcacattttattgatcacttttatttaaaattacaaaaatataaataaaaatagtgaaatataaatattcagtgtaaggagtggtcctcaccccacccagtgaggattggatgaactaggctaaaaggaagggataactggccaagaaagggacatctatgtgaaagtgaaactgagacagtgctggtcacaggtcatgctgcagaataatacattcccaggcactgtcacgtgggggacccaagaggccccaggagtgacctataacctctccagaaagaccactctgtgtggcatcacagtccacacagtttaaggaaatatttagacttaacaatcagacaccagctcttactcacacttacactcacagcccacacacaagtgtgcaaacatacacamacatatatatttcctgatacattcatggaatatcagagccctgccctgaagtcgttagtgtctctgctccccaaaccgctgctcccacattggctaagctccctcaagagacctcagctgttacacttcctaattgggaaattattcatttctcaaccatgggcctcacaaatgcccaccgtcgggggagctggctctcccttcacccatgcacaggagatgccctgccctttttaactcctgcaggcttcagtccagaaaaagacaagttgctggtcagtaacatgttgagtcaggaccacccctccatcctggccagaggggtctgggcagccagcacccaggcctatgcctgagggtaaagctattgtcgttcrccctggtgggtgscacaggcaaatccatctgtgcagagcctatcttcccagtctcttcttacagctgatggagatgactctactgcaaaaatgacaaccagcaagaaagcgggtggtgcccgtttcctccctggggaccctcagagggccaggccattctcttccttggtgtgactgcggatccagggtaagaagtgtgagactctcgtgtagacgcctggcttgtccttcagggcacatccamggccccagctcacaattccagtcaaagtcatgcggccttggagggaacagacgaggggtccccctgagtctccctgtgacgccaaagatacaaaagatgagccctagagaagtgaggaggggatttctgatcccatcacccaaccataccagagagagggaagagtttcccagtcaaagtccttagcgacttcccattttctttctttttttcggggggaggacagaatctcgctctgtcgcccaggctggcgtgcaatgacgtgatctcagctcactgcaaacttgcctcctgtgctcaagcgattcccatgtctcagcctcctgattagctgggattacaggcaggcaccaccacacctggctaatttttttttgcatttttagtagacacagggtttcaccatgttggccaggccggtctcaaactcctggcctcaagtgatccatccacctcggcctcccaaagtgctgggattacaggcatgagccactgtgcctsacgcagccccattttctaccacatcaagtttaaaatcccctgcttggctttaaaagccctgtcatctgccactattccatccacactcccagaccctagttctcctccccacccggaatatgccagcctccttctcagttttgtatctttcaactgaaacaccttcctttcttccctctgcctcttcaaatgcctatcaagtcacatttcctttaaagcctcccctccctgaccctcaggttggcactcacctccctctcctgaacacctgatcatttatagttcacaacacaccctgggcactgagttacattgtcttttactgtttcctctttctaggatctcgtgcccccagtctgaagtgactagcgcagagctgggatttttttggtaatgtctggcaaacacataaggactggtttaaaccctcaaagacctgagctcctgattctggctacttagggctttggctagagagagacacccttaagctggctggracaagcccaggagctctggggagatatggaagaggtggagagagatgcttggaacactcacctggcaggaatctgttttccactgtgggtcagcagcacayagcattttggtggtgacttcagagccgtagtagtggggctgctgacactcccggtgggaaatcagcttcacaacagtcattttcagctgctccggatagagatagtcggctaggtggagaaaacagggaggcgtttgcatcaagatttatctgtccactgggagtctgccagagaggggaaccataaagtatctctaccagggaaggcccttattctcttccatgcaaatctgagcctttactccacctatagcccctaccatctatttacctttgcagcccatcgctccctaaacaacactcttcatccatccctggacccatctgccaccgcytcagtgctcccacctctaactctgcagtcttcccttgatcacrctgggctcattttcaggtcaaaacactcctcaggaccttctaagtcagtcgcaattgtcacttactagaattctcttttccaaagccagtgatctcacagcttgtgccaaactggggatcgttatacatcgagggcaggcagatggtctgtatagtccgggatggctgcgcacacctgccctccttggaayggatcttcagcaaggctgggggaggacagagggtcagaggagaaagatcactactggttaggcggtccccatctgtcccctccaagtgccgaggaagtagctatgcctatccctaggtcagtcatccagggaggtctgctggtcgcttatcacctggaaacctcccctgccccatgccccaagggctttgttccaggtgttgaaaaaggcttggatgkccagagccactgcatacagctgtacaggtygtttctgcaaaaactcccagctgaggtagttaggctggaatccatcccraggctccattctccaagttctatatcctagcacagacagaggctgcatcccacaaaggaaggtgtgtctttttctaattcatataaacagggccttcccagcccaagccatatacccacagggctgtttccactcgcaagaggctacttgttggggaaattcagggtctctccagaggagcaccaggcccctcagacttcatggaactcttccctgccactccctttgtcatgtatatcgaggcttcaaggtccctcgccccacccctgccccaccgggcagcttcaacctcagctccagtctctccctgggtcccactctccccaagccattatggccacagtagtcgcggggttccccctcaccaatgtcrttgtggtgagcaagcgtgtcagcgctgtagtccttgtgtaggatgaggttttccacctcaaacttcatctccccttgcgtgttggagttaagccttgagcgacccaggtagacgatgtagtcctccttctktgggtaatcactgtggragaagatacccatcaaacagcttagtcccatgaaatctgccacttcttccttccctccctagaggcctcaaagcacgacttgtccccaaggccatgggctgcatggacaggggcagatgagggagaaatgaggcrgaacactttgctgggaaggagaaagggatgtgcttggggtggggcagaagagtcgaagaggagaaacccagggccgtacatgaagcagtgtgtggcgctgatcacccagcaagggctsatgaggctgcctccacacacgtaggtgacagagcccccccggtgcctcctgtagatggccgcaaaccagggctggttctcgatggtggtgaattctcccccaataatcttaaagcggggcctcagagtcttttggccacactgaaattttaattcttctggaggagaggagggcttttttcctggaggacaaacagagggatgtcttagggaggcaggtaggagaaagcatccctctcgggcaccccccacctcctcagtcctcctgtgatggaataaggggacatgtaagtttgtccccttccaycccactgtcatcagcaggtcagtgatgctcaccatctgcgcagtcatgcaccatgcactcttggacaagcrgctttaggcccacctgcacatagcaccagggtcgcctccggttgtctgggttcctggcaacacagaaagataggggatgtcattccaayccagagggccttccctgcctcctcccctcagggaagactcaaccagaggcygcacttctcttgtgctatggccagccctctgggagaaggggatggtaacaaggtttctgggaagctgtagggagggcttttggtccttgttgcccccacytcacctgcagtaattatgtttycccaggcccagctgaagagcatcagatctgtgggcatggtacgtttgctgaaggacagtggcagagttccagggcaggcagggccggcccatggtgtcagtgctggcctttcctcggtaaaagtgaccattcccctcatagcaggtttttgacttatctacaaggggacaggaggatgagagaatatgagaaagagaagaacattccaactaacttttwttttttttttttgagatggagtcttgctctgtcgyccagttggagtgcagtggtgtgatctcagctcactgagatctctgcctcccaggttcaagcaattctcctgcctcagcctcccaagtagctgggactacaggcatccacyaccatgccaggctgatttttgcatttttagtagaggcagggttacaccatgttgtccaggctggtcttgaactcctgacctcaaatgatccactcammcttgacctctcaaaatgctgggattacaagcgtgagccaccatgcccggctgccaacggacattttaaagatgtcgtttcagacctgccagaagactggacagggtctccttccaaccccacctcacatttgtgtggccactgtttcrtgagcgtgtgtgtgtgtttatgcttgtcacatagggatgaagatgtcacccaccctacctccagctcctaactcctgcctgctcttgcctcccacccatccctccctgtccccaaatttctctcccagttgcagtggagatccccatacctatttcacagtgctgccctccgaatttctttgggcagttgcaccagtgaatgttggagaagtacttgttggacacacatgttcctccatttagacagtcacagttcgctggagagaacaaaggtggggtaagcgagggggagtggaagtggtaaggggtggcgcagccctgcagcagagggcagggaggggatgtcccctgaagycttcccaayttgtctgtgcagccaactgttgtaggggtggatactcacatggaacttgatgaagttcattgctgccctgraagagattcgggaggaggcttcatcaaaggtcccatgctccagggactccagggtgagggtaaactggccccaatcccaaaacccactcttccctctccctctcgcctcaccctgttcgtatctagttctcaaatggaagaccatgggtttccagccaggagaaatggattgacccaagcaagcttcatctaccagatgcccgcaggctggggcagtcccggcggcctcttcctcccttgccagccagtgccaacccccgtggttctcaagcctccgctgccaccctgtcccatttcctggggagagtctggccctgctgtrgatggaatccggaggaccccagctccctgagcagcccctcctctcccctggtgctgatcagaggtccttgggcakcatcagtcaaagcaagagcgcactcactttggagtcgctcamgaccaggacgcagagaagcaggcgcgccagcagggctctcatggtggcgaggtcggggckctagacrgcggctctgcaaaggaaggagaagtcagggcaagaggcggaggaaygggaaggcmggccaggcgggcgactgcagcgcaggggagatgcccgcggtgaccaggctccccagctgtctctctcctctmtgggctccggactccgggcagcctggatcggcacccgcgggggacgcccgggacggggcgccttgactccgtgcagccgccggggagcccagggagcccgggcagcccagggcgggggaggcagacgctcgggagctggggccgccgcgcatccggcccggggatctcaggaccgcggcactcaccggtggctgcggcaggagggcgcgagccggcgctgcggggacaggtggaccctggcccgggctccggggctgcggtctccgcactgtgctgcgacccgcggcgcctgctctatatcagggcccgccccggcgccgcccctccctctcccgcccggctccctcccctgtcttgcagcgctcagcgacccggaccccgcgtgcttccgcaacgctcacaaagatttgggggaagcgcgatctccagcggaggggacccaacagcgtctggactgaggaatcgagaggcttgtaaattctccgtgcttcctcccatgcacctggccgggggcctgccccagtgcaaggagtccccgaattgcagagaggagagaaggcgcacaggagactctctacctcgcccagctctgaagcctcctggggtcctctaatcagttcttctgcaacttctccccgctgggccccaacttgcctaagactgcctcagacccccttgcccgcagctgatggagctgtgaagtcttcatcaacgcgacaaatgtacgagacatactctcccagaagcacagacagaaaaacccctgcctgtaggggctccctctgtgcgtctgttcagtggcagtccccagatatcaccaacacaaccagtggatggaacaaagccgggcttattgctttcggcagtaagggggtttgtttgatggtgctatcagagggggaaaggcaaggccagattactgaaaatttgcagcttggtttaaagtccgtttttgacagggcttgataaggattgggttaggtgtcgtgatatgatgttacaggattgtgggaacaaagtcctagggcataaactgttggtgcttcctaytgaagtgttaacgggtcttttgggaagtttccataatgagcaattcatttatttgtgcaggcaagaataaaagtaaagacaatggaaacatgtagacagttctaactgtggaggttctggagggtgtggaagttctgttctcacctctgagtagaggaattgggagackggaggacaaaataagaggaagatttatttttcactgtttgtccttttacactcttaacattttaaaaagcacatctctgtatagcccattccaaaaagataattatgcattttttaatgcatgtgtatttagtgttttacttcatcatagagccttgtttattctattcagatagaaacaattgtttatcaaataaaattgtcctccagaaaaacagaccatgtgtaaatgactgcatccacccttcctgcctgaggataagcagacatttgtgtatacacacacacacacacacgcatctctgggcacacttggaggaacatagcagggattctgtgattctgtcacccccatctctttcccctagtgtcaggaaccagggcttggggtcattttgaacccagtaggactcgctctcttagtgggaaggaggaggctgagtcccagcaatccactagcggctttgggccctttcccagcctaggcctgcagcattttcctgccttgcaaatctggaccttgggtctgggtccacctgagagtgacagaaggaaggcagggagagtgccaggaaggtaggaaggaggaaggctcctttgctctgccccagccgagggctcaggrtgccagctgcctgctggggaaagtacaagttagcctttcagcttttgggaggcaggtgacccactgtcttctggagagacttctgtgcttgctgagctgccagccttccaggggacagactgagtcagmgatgctataggcttcagagccaaccttgctacttcctctagaagactgtggtcagttttgtttggatttgagaacccattaattgtaaataaacgtgaccagaacataaacagagatgctgcagcctgaggacttaccccgaaactcccaggttarttatcaggaaattcccagggrccgtcatgattcatgttgctcccctagcagctytcatgactccagattacttggctggaggctgtcatgctgattgctgagagcagatgacttcatttcctcctggacaaagaggtttggagaccgttatgaagcgtgacaccctttctccccttccgccccctcctcccccgtgccacctcttcacctagcacttcaactcttcacagaacttccttatccatgcgctaatctttagcactctctgaaatctttgtgcacagttcttttttttttttaaagacaaggttttgctgggcttctgggttcaaggggtcctcccacctcatccttccaaagtgctgggattacaggcatgagccaccacgcccagccatattttttttttttttttttgagacggagtctcggtctgtcacccaggctggagtgcagtggcacaatctcggctcactgcaagctccgcctcccgggttcacgccattctcctgcctcagcctaccgactagctgggactacaggcgcctgccaccacacccggctaattttttgtatttttagtagagatggggtttcaccgtgttagccaggatggtctcgatctcctgaccttgtgatccgcccacctcggcctcccaaagtgctgggattacaggcgtgagccaccgtgcccggccccagccatattttttatattgtatttctgtcttgtgcttcaaggcacattaatgtaaaccatttctctttaaactcataactgccttatgatatagactggtattgttgttcccattttgcagatatggaaaatgaagtggagagaagatacacagttgatgagcagcaaagccagcactaaaacccagcgtcttctgatccttgttcctatgcgctatacctcactgtctccataaaagacagaacgctgtgaagggaggggccagtgagctaagatgatccagctcaggggagccctcctcctgactttggagacctccttccagaaagactgctcggactatggactctgagctcttaagttgcacccgctgtaatacaaattagttgtttgcctgaattccaagaactgtctctgtggtctaggctgtctgaaatttctgttgagggtaagagaataaggaactgaatgtgtatgatttcattcttttcctgactcctagggtgaagccaccaacccctgcctctgtgtctcaagggtacagagctcctgagtcagatgtggcaacacagactgctggagaagccctttccaggagattctcataaaagggaaggcagatgccagatgcgcagggaggggcagggtatccaaacctggccctgagactaagtccaggaaactcagcccctaaggactattttctgacccaaaaggaagttcccatggagtcataggatgcaattctgtgttgtatatgaagaatgctcagcatggcactatagaaagaccacagtgcctagccttcagtctgctacatcaaagttgaatgatcttaggcaagttgcttaactcttttttttttttttttttttttgacgtggagtctcgctcttgtcacccaggctggagtgcaatggtacaatcttggctctctgcaccctccaccttctgggttcaagcaattctcctgcctcagcctcccaagtagctgggattacaggtgtctgccaccatgccggtctaattttatatttttagtagagatggggtttcaccatgttgtccaggctggtcttgaacccctgacctcaggtgatccacctgtccagcctgtgcctcactctgcagattggctgagatcatgcttgcatgtaaaagtattcattcattccatatttatcatggacctactgtgtgctgggcgcagttctggatgctagagataggaagaggaactgtgtaaactgtaattcctacatcgagtgcctgcctcccctttttgactgtggctggattgactcagaagaccaagtcaggctggagtccattccaggattccaggccaatggggatgctgtatccttggccagcagttcccagcaatcaggcagctggacccacagctgcatgtgctgttcactcccacattgcctatgcttactccctctccctcttgtctgtgtccctgtgtggcctgaagcgcctctttccctcctacacatggggcagacggactcttcaacagttctgggaaggaggtacggaatgctggtcacatagcttccttgagtctaaggaccccttcttcctgagtgtctagtgtgaagggtgaagccagctggcaacggcaggcactgaaagccgcttctgggcatgtaacatgatagggggattgctggagctgcaggcccccagcaggctgtggaaggggtggagggaggcagcattcttgcttccttactcatggaaagcaaagagcccaggggctgaaccctgaggttacactgtcgtcagtagcaccatgaaaggggaactaaagctggtccctccagcatcaggctatgacccccctaaccttcctcactctttttstgccttaccagctctggcctgcttcctaggcctacccaggccactcagctcagacttctgcatgtatgtcatgagtcttggccaaatttttctttgtccctccctgacccaaacccasttattacctaagtcaggaacttactgctttaaagtagtttgccaggtgtggtggctcacgcctgtaatcccagcactttgggatgctgaggcggctggatcacttgaggtcaggagttcgagactggcctggccaacatggtgaaaccccgtctctactaaaaatacaaacattagccagtgtggtgtcacacgcctgtaatcccagctcctcaggaggctgaggcagaagactcgcttgaacccgggaggcagagggtgcagtgagccgagatcgggccactgcactccagcctgggtgacaaagcgagactccattaaaaaaaaaaaaaaagtagtgttggtcatggcttaccagaccttctggattctgagcccctcaccaggaaccaaagttaggccctggtcctaaaacttctgctcagagttctggttaccatgttgggtggcaatagatgcttaactagaagcaaaggggcatgcccaggaacaaaggactgggatgactaaccagcaaatggtgggcttgctgaagactgccaaaaaatcaataatatttagggatatatgttcagccagaagctgaaatactgaaaaaatcctattcagaagaaaactaacataatattcataacccatatgatgtctaattccacatgctcatggctctcccaagctggattctatgtgctggattctatatgcatctctgtcttcaaagcaagcacttccccttccattacacagagaggaaaatagaggctaatgaagggaagtgaatcatctgagttcattcactaaaaatgatgagattcaggattcacagattttgaggaacttcatgacacattt

SEQ ID NO: 13448 - DNA, 117431 bp, Homo sapiens
gatgctcctccatcagtctaactacctgtattttttccatagcaattatcatagtttgtaatgctatatttaattgtatgcttattggattagattgcttttcattgttctcaccaggatgtatgctacctggtagtaaggcctacacctagaacaatgcctataatatagcaataacccttgaaatattttttagtgaatgaatgaatggataaatgaagtggctaagctataactggaaaacatttaattgccctgatctaaaaaattataaaatattatttcatgcataaaaaattatatataatacatacggatattttaagcataacaataaaataaacactcatgttacatcaattcaaaaggtaacacattacctatgccctctgtgtgtccctccctgatcacgtcttaatcctagagctaaacaataggttgcattttgtgtgtatcattcctcttctttttttggtcattttaaccaagtatagatattatatattattgtttcagaatattgtgtcaatggtgtcatatgtagataaactttggcaatttgcatttgttgttcaacatgtttctgagatttgtcttcactgaattatgtagttgtggtatattttcactgacagttttccattgattgagtaaaatgcaattagtgaaagtatttaaatgtccgtaaatgtttgagttctttccaggcctttgctattgcaatatgtactgctatgaaatttcttgtgcatagctcttcgtgcaaatgtgcaagagtttctctagtgttttacaagttaatgccaaattattttccaaagtggttgcaccagtttacactccacaagcagtatgtaagtctgcctcttgacatttgcgaaacatttgatgtgatcagatgtttaaaattttgcctgtttgatgggtgtgtaaatttgcctttccacttttattagtgagggttgagcttaattattattaaggttatgttaattattcttaattaaggattattgagattgagctccttttcatattgatgattcttctgtaaaatcactgcctgtttatatattttgcccatttttctatttagttgtcttctgattttttcgaagttcttgattctggacagtaattcttctatgattaattggttgtcaatatgttttcccagtttatagtttgtcttgtcatggtctttgtggtattttttgataaatacaagttcttaattttaaagtagttagagttttttcttttttcgagatagggtctgactctgtcacccaggctggagttaaagtagtttgatttatcgatcttttattttatggcttatgctttggttttaagaamattttccctattcagatgtcataaaatgactctcatattttcttccaaaagtttgaaagatttgcctttcatatttcagctttttattcacctaaaattgttttttgtgtatgatataattgtattagtttcctatggctgctataactaattaccaccaacctagcagcttaaaacaacataratttattatcttacagttatggaagctagaagtctgaaatagttttcactgggctaaaatcaagatgtcagcagagctgcattcctagaggagaatttttaagttttttttttttttccaagttctatagggtgctggcttatggccccatttyatattgaaagccagcagtcagccaggtgtggtagctcatgcctgtaatcccagcactttgggaggctgaggttgtccttgagtctaggagttccagatcaccctgggcaacatggtgagatctcgttccaacaacgacaacaacaaaaattagctggcacacagctgtagtcctagttactcaggaggctgaggcaggaggatcacttgaacctggaaggtcaagggtggagtgagattctagctcaaaaaaaaaaaaagtggctggttgcatccttgcatggcatcactctgacactgaacttctgcttccctttttcacgtagaaggtcccttgtgattacaccgagcccacggaggtaaacgaggataatctccctacttcaatatccttaaattagttgcatcaaaatcctttaggccatgtaaggtaacatgcccatatgttcagggaattaggatgtggacgtctttggggaaacattattttgcttcccattataatcaattgattcagcacaacttcttgactctgttctgaacctgggttcagagggacactggtctggtgacaatgataatagtaacaacaaacacttgtgccaagaatgtttctaagcattgtatgcatattatctcatttaattttcacaacactttgtactaagtgctactattattcctagcttagcgatgagtgaagtgaggagcagagaggtgaaatactttgctgaagatagggagcagcagagtttgactcaaccccaagtacctgagcttcgaagtccatgtgcttagttagcaccatgctatttttttttttaattttattttttgacagggtctcattctgtcgctcaggcaagagtgtagtgatgcaatcttgacctcctgggctccagtgatcctcctgcctcagcctcccaagtagctgtgactacaggtgtgcaccaccatacctagctaattttgttattttttgtagagacgctatattgccagggctggtcttgagcccctgggctcaagcaatcctcccacctcagcctccctagtagctgtgactacaggtgtgtgctaccacgctcggctaatttttgtattttttgtagagacagggtttcaccatgttgcccaggctggtctcgaactcctgagctcaagcaatccacttgcctcagcctcctaaagtgttgagattacaggcgtgagacactgtgcccggcctaccatgctatttttaaatgaataaacaaagtggataaatctagtttcagttagctgtgtgttcatgactaagtcacataaattctctgagcctcaatttcattatttgtaaaattagaatagtgatgcagcttttctgcattccacagggatgatttgagggcacgttgagacaacatgcatgaaagcagttcagataaggaaaacagagatccaagagtcattctgccacatgtcactggcagagccaggacagggactcaggtttcctggcagccaggctgggcaggctacttccaccacagagtggtaattagagcagttacaaattccagtcatcaaattgaacattttcccttcatcaccctcctgccctggaacggccaacattaaagccgtatctgtatattcaatcaattgttcattaagaacgccctccagttttagaagatactgttacaaaatccaaatgtgagataatacttcttagctggaacagggtaaagttgacaggtaatattttgtatcatttacaaatcaaaaggcagagaatttcagaaattgacagaaaggggaggctgtaagatatctgcttaagaaaaccacctcctcatgtgtttgcctcttttccatcctcatcctatgtttctgtcctcttctacttcccttcacttttccttagtaaagcagggattagaaaacctgaattttagctgtgggcatcattattgaccattttgctttgaatttcaaaggcaaaattgaagaacaaaagagccaagagtgggagattcactctaccagatcttaggatgtataattaagccacagcaataaaatcagcacagcactagcataggaacagatctagatcaatagaatagccacaagagctcagagacagacgtgtgtgtctctagggacttggcatacgatacagacgccatcatgcatctgaggggaaaagatggattgtttggtgggtgctgctgggaaaactggctcactaaatagagttaataatactgtattcctgctcaaactgtatgcaaggtgaaccccaggtggattaagacctgtgacaggtaaaagtatgaagccaactaggggaaaatgtaggagaatattttgcgactaacaggtgggaaaagattcttaaacaagaccccaagaccacactgcacaaggctaaaatttgatgcattaggctaaatgaaaattaaggatttctcctccattgcagcatagcaaagaccaagcaaacaggatgcatgaaagattgagagaaatatttgcagtgtttttctaaaactgacaaaagattaatatttagaacatataagaaactcaactgcttcaattcattcagaaaaaataataaaatccagcagaaaataggtaaaggatgtaaatagataattcacagaaggaaaacaatctcgatggttcttaagtatatggaaaaatggttaacaccaccaatcaaaaaaatacaaatcgaaattacaatgtgatactactttactgatttcagattgacataaattaggacatcggataataccaaatgttagcatataaaatgggaaacgggtaccttcctaccttcatgtgccattggtgggtgtgaatggcaaagccatctggaggccaacatgacagagtgaaaccaaacactgtggacttcatgacccagcgactcaatttcttatgttctgtaagggacacgtctaacatccattccagcatggtctgtggtagtaaggaactgctggcgacctaactagccgttatttgaggaattgataagtagaatatgatagacacacaaatcaaatattattattagtcattattaatgaactcttgttgtatagtgtcacatggatagatctctaagacactgagagaaaaacaaggaacagaatgagttctcatcacaatgccgttcatatatgttaaaaacagacacaaaccatgtatcttttgaggctgtatacggtgcatgaactgggacataccttaatagaggagagggtgcatatggcgggtagaagaatgggtgtggagaaggaacgagtaaaaaataaaaacaaaaaagaaaagggccttgctgactgacgagctgaacagtacgaacttgtccccaaggtccaaaaaaatcgccccaatcccccttccatctcgtcccattcttaacagaaccaagtgcaagggactcagcgtggctgtccagagcagggcttttcttcatcaaggacctaggtcctcttccttccacccacctcgccacgccctcggtgcccgagccccgagctstacttcgacggcacttttcaaacacaaccaaacacasccaggcttcaaccccggaccggcttgcttttattatttctcttgggaaagccttatcggtcgctaagattcagtttaagtgactcttctctgggaggccttttccgaatgctgcccttgaccaaaagccagcccctccagggctgtattcccacagccccctcccccgtcagccgggcaccccgcgtcctaactgcttattttgggcactcagcgctcccctcagggctggagttgtgctggggggggtctctgggttcacggcccgccagctggggtgggcggtcctgggaataactggacagttaagtcagcaggtacagccgcagcccagccagctccctctcctctgcttccgctctcattggctcagcctccccgccccccagcccccgccccccagcccccctccccagcgcccgcccccagcgcccgccctcagccggctgcgggaggcaaaaggctctgcgcacgcgctgtggggtggggcacacttggttgggggcggacgggggwttaggagracggcgaggagcgggcgcagaagggtggcggggccgccgggtcgttgcgcggcagttgcgtccggcctcttgcgcgcggcgcccgggaaggggcggggccgaggcgggcaaggtggcgggcccccgcccctggccccgcccccgcagcccgcccgcgagcctcgccccgcctcctcgccgggcccgccccgccccctcgccgggccgtgctcttgctcccgccgcctggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaaggtgcgccccggggagaggacctgccctcacggcgtccggccgcctgccccgcgcggtcccgcgctgatctctgccccacgccaccaccctcccctcctccgggccgccgggaccctctcagtcgggccggcccctcctcctccacccctcttgccgtgtcgccctaagccagttccctctcggacccttcctcagagcggaccgggtcctctctagtctggacccccatccccaagggacgggtccctgccccagccccggaccggcgccagccccgcggcccttgcccctcctgaggcgtccgaatccccccggcccacccccaggaacggccgagctccagccctcggggcagccccagcgtcctccgtcgcggacccccttccttccgccccccccccccaaaggagctgcccctcgaggccgcagcccacttctccccggtcctctcctgggctccccaacctctggtccgctgacgccgcccgggttctggccccaggcccacccatcggtccacacattcccaactcctccccccacctctcccggagacaccaccccgcgtcccgtcccctcacccccagcccaagtcagatcaagctcgggtccttctgccctcgaggtagcccggcctcccctcgcttcccagccagcactctttctcagtgtcgtcctggtccctgtctacaagccctcgcgaccctttgccgccatcctgagtcaccgctcatcctttcctcccatcccctccaggactgtagctgggacccagctccccaatccccttgagggggtcaagcttcagcttgctccccccacccctactggctctcccaccccgcagagtcatcttcctcccggcggctccaacctttagcgccagcaaacctagtttacggaccggacccctttcccctggccattgcttaattagctgccttagckcctctcactcccacctgccgcaatatctcaaatctctggtttttttccagccccggagtttatttccttccctcccccactccagatcttgtccttttcatgcctactcggctgcagtcttcatccatctcccttttagcatttcttggggtggaaaatgctggagaaatagccttgaagtattagagataaaaagtgtgtgtattcgttttataacatgcgtatgaaatggatttcagccaaggttctgaagccacgatgtgattttcaagctgcagtccaggagctagaaggataaaaacagaaaaatacagccccctccccaaactccccaaaccacccaattagagacctccgtgattgatgtcgcctggtatcctcagctccttgattagttttcattgttaatgcttaattgtgaaactttttcattcgtttatcctcatagagggtcactgggaggttggggggcaagactgaaccaatatttgtggtgcataaatgtgtattttacccttgacagacaccggaagaaatagaaagattgacrgtcgatgaagacctcagtgatattgaaagggctgtttatctgctcaggtatttcctagtctttctgtgaaattgctcttcttttttccctgtgcagcagagatgaatgctttctaaaatgtatgttcgcgttatgttcagatttacttagccacttgaacagagtacttttgtgtgcatagtacttaactatattataaattagatttggctatggacttatgactttgagaatttaaataaaatacctaatttatagaatgttgcttggaggagcaagagcagatggttggagttgaacctcatcctttttttcttttctggctttggtttttctcgcgtaagattcagtaagtttacatgagacttgagtatacagtgattagttttaagttcattgtagagtaggaacattatacgggatctactatacggaaaaaaatccacaaatatggtagttcattttgctgttcaggatatcctgtttgtattacttttgccgtgcaagctttatgattttgtctgaggggttttagaaatttggtygagcctactgtcatttcaatttcaaaccatctcacaggctctacagaattgcttaaggcaaatggttattgcaaatatttacaagatttttctgaactatttaaaacattgtcttgtagattgagcatcttaaaaactaatacagtgaacatgaatgatgttttaattaattgattaaaatcctttagaaacaaatttcctacagcattttgcgtttatttaaaattgttcattagcttacacaacatatttttcccttttggcaaattagtcactctttttttttccagaatcaggttttgaaaactgatgtaatttacctcctaggatatttgtcacccttgtttccttagttcagcgccagtttcaggtactggcaagtttctcgttctcctttcttgtttacagatcatgttccagtcccatgttactcattgaatgattctgtaaaaaaaaaaaatccctctccaggtcttcaattttcttaattacttttttagccttctaaaagtggcatcatgagtttctgttgtaactttagtcagaatatcagcatatttaccatgtagaccattccctctgataattgtatcatttagaaatgtttctgcatcttagactttatgttgatgttattttcccccctctttggggtatctgtggtagcatgctctcatcatttctatttacttcaaagaaaacttctatttatgtgtgaattcaacggtatgtgttttgggtgtttacttagagaataatccaacttttaacccattttcatattgtgttatatttggaatactttattccttaacaattaacatgtttattatgatgaacaatagatgtcaacatttgccttttcccacagttcttttactcaaagtaggtagaaaattgatgaaagtgtggacaaatgtgttttaatctacaacagttaatgatttgaaataaactcctgtttattcctactgaattcttttctttagtataaacactggcttagaattaggaaatggagagtcttgctctatttacttgtgatagaagacaccgtattctaaatatcagtgataaggcttctttttaaggaaagcttatttgttttctattttgcttttattgtttgttagcaaactaggttgtctgagttgtctttatttctcagactcaacatcagtttcgctcagttctggaatttacaaagcccttaaagagacagatgggccctctcattcttggacaagagaattttaaaagagattcaatatctcctttagtttcttgtggctcacctaccttgaaggaggtttgcaaggtgactcacaaggggaacactggtttggttatgtatggattctccaactgagttcttcttttgtatccctaccatcttaccacctcctgggggaatgtgggatttcaccttagtccagctttgggagggatgatgccaagaatgcctgaragggtctttcttccctgggattcaggggaggggacaggattgtttcatagagatgttctgaactttgcctctgtttaggccttctcatcttctctcatgtattgagcctgctattgtagatgtaatttattcctttttttctagtttgtactttgctgagtccttttttccgtctgtcattgattttcaggtttatttttgagcactttaccttttcctctgcattgaatattatataaatgtataatatataacatgttatatatatattttctctctrcttttatgtgtcaggtttgtttctttagttcttttattttgtgtattgaaactattttggagtattatgttaaattagaattcaaagtcagatgtgtaagcatcagtaagcaatgctttatattagtggggttctgatagcatttagattgaatccagtatctgaaaaaagcattttatatatagagtactgtcatcgataaaaaacaaattatactgttcattgtcttaccctgaaatatgacatgtcagttattaatgacattttcacaattaagtttagaatattacagtcttcaaagatttgacacagatgaatttgtggttttgcatacgtgcgatactgatatacccatctgtggcatttagcactgaagcaaaacaactttcctaatagtcacagcttgtgtcttagtcaaaatcatatcttatctttttcctgttttttctcttctttgtgattttgcgtatatttttggaatgtacttaaaacatgtgagtgattttattatagaagaatcctaagtatgtatactgtgctttcattaggtaaatctttacttgtatatttctgattgtctaccagataaagtgtagaccctgaaggctggcattcagaatactccataggtgactctatcttagctgtgcaatgtgatgtcccaccagtccctcacttttaaaaatggctttactgagatataattcatagtccttgtagttcacccatttaaactgtacagttaagtgagttttagtatattcacagaattgtgcaaccatcactgcaatcaattttagaacatttycatcacccccaaaagaaaccttgtactattagcagttgctcctcagtaccaaccctctcagcctttgggaaccactattctgctttctgtatctatggatttgcctattctggagattcctaaacacggaatcatacagtatatggccttttgtgactgacttctttcacttagcataakgtgttcaaggttcacccatgttgtagcagctatcagtagtttattcctttttattgcagtgtagtattctacwgtatggatatagcgcttttgtttagccattcatcagttgatggatattgggttgtttccacttaattcttcactttttgattcagtcatgctggccttttcactgttactcagtttcattgtgtttatccttaatttttgcttttcctcatcctggagtactctttcaatatatccttatccaacatacaccatctctaggatccagctgtaatcttacatctttcataaagtcttctctaactgcttaaaccacatggatcccaggcttctttgagctccgttatcacttagtggcgctttcttcaattggccattaatcactgatttacattccttaactgtgtgtgcatgttttcttcagtagattgtaaggtcctggaggacaagcttttagaggacaagggcaagctttcttgttgttgttctttcttgttcttcgctgtgatataaatatatgcctcttaatggaataaagagtatttaagatgaccatactgccagatgaattaaggaaytgatatttttgattttaggtattatgagtcatatcttgttccacaatttattatctatgtgacagtggtgaagttagttatggttttcgagccctgcttttcatttgtaaagtggaaataatcattcccttttcccagtgtggttgaagcacctggcacataataggcatcccgttactgttaattcccttctgtctccttttccctttccctacttccttgctacttaggtgctcaagttacatttaaaactttaaaagaggataatggtattaattttgccttccaataatttaataaacggacaaagtataccaactgaagtttgtgatagatatccattaacttcgtttgctaatagtatttatcagaaattagaatcttcacaaatcataattaagcatttttaactgagtaatagtaaggtcagcctgttgatttatattttcttaccaaatgaccctaagtaatatttgctattatgcattaaatgtattgattggttaatgtactgagactagcttttatgttgcttacttttaaagtcacttgtgactttaaaaatatttttcactttgtgctgtgacttttaaagcattttgaactttgctttcccagggcagtcagataaagagctttgcttttttttttttttttttcttttttcttttttaaagacagggtctcactgtgtttcccaggctggagtgcagtggctattmacaggcacggtcacagtgctctaactcctgggctaaaatgatcctcccacctcagctttctgaatagctgggactacagaaggcacacaccacctccacagccactgcccccgatcataaagtgcatctttatttggaacttttttttttaactttctcttcctattttttaaagagtaagtgctccccctagtgatatgaaagagtgagatttctgcagtcaaatcagtggaaataaacaagtgttgtaccatgtgagaactctggcgtacttcttcttgggttmaagactaggatagggtagcaatgagacagtaaggaagaactccagtgattaaagctttgctacycacctagcttttggttgtttttcttttaaaatacctatcttatttgctatcccaaagtggaaagttgtgtgaaaaactcctttgaatgccctcctttttatgacgtgtgtccccacatttactttcattattgtcttgatttctgtttttgatgcttgcttcctttcagtattgttttagtgaggcatggtttgtgtgtgtgtgtatgtgtgtgtgtgagagagagaaararagaggaagagagagagatcacatttgtgttgtgcatgcatgtgtatatgtgtatataggtggtcttgagtgaccagtattgcttgctcagttttctttagtgatacacaggagaggacttttgcattcttcacaattaagatagatagttggttagttaatacaaacaattggctagaatcataaaatcacaaatgttacatattttcaacatcaaattttaatgtaaactataaatatattttcatttgccaatcttttgatgtgaagtcatgatcttttctttgagtatgggtctgctgattaaagtttgaaattctccttctttcataaatcaccccataatgcatttacaatatcaagttcagttttctttaaagttgaacaagaatttaaatttgcttatgaagcagtctgaaagcatggttctaggtttttatgattttctacttgtgttttaaaagttttgttcttccatactttagtagcaattttctttgacaacttatgtttattgaatttagtttttctaaaacttttaacttaatttgatagaaacaaatatatgtgttcatatatttaggtaatatttaattaaattatgtaattgcaacagcaagtgaaatttgaaataaactagtttgagaacatacttagctgactcttaattacaactcaattagtgagagtggaattctgtgggctttccagagagtagcctattagcgacgagctttcagcttgcagttgcaagggagtagagagtattgcttaatcaggtcttttaacatcttgtcacatctcaaacayctttgtttgagagagatacataccatctcctttccaagtgtgctctgtgatgatcttgcttcattcttgatattcctctcctgtctctctgttgtatttgttcccatggtctggtttgttctttgtttgcctttatagatttaaaaaagtaatgaatttggaatatcagttaaagaagtactttcataagcttatattttattttttaacgcgaactttgaatgtatgcagaaatgtgcacaaatcataatacagcttgttgaattttcacaagtgaacacacccatgtacccagtatccagrttaaagcatagaacattatcatgttagcttagtagcttcctttgtattcctgtcccagtgccctgtacttcctgcaaagggtagctactctactgacttctaacactatacattgatttacctgattttgcactttatatagtaggaagcactctgtgtaccttttgtgtatagctgcttttgctcaatattttaaaaaagagatttatccatattgttgcatggagcaacagattgttcattctcattgctgtatactattccattatgtgaatataccacaatttattcattccactgctgatggacatttggcttagttttcagtttggggcttttatgaataatgctgttataatcattcatgtacaagtctcttggtgaatacatgtgtgcatttcttttaggtatcattatagaagccgaattgttggtcatagcatatgcctatgtccagcttaaaagatattgctaaacagttttccagtgtgctttgaccagtttgtacttctgccagcagtgtctgagtggtcccagcctatatatttttaggaaacaaaagtgacaaacttctagtacataatttctagcatatcaataatgaacttcctagttaatagcctttagatgtttcgtttctctgtgcatgacttacaccatctaactttttttctttccctacaagaaggggagttctataaggttttacttggctacactgttggttagaagactctcagttattagattgtctcttaggagatgaggcatgttgtgtgattagtttttcttagaaaaagagaaacaaagtggatattggagtctacctgcttatgggagtgctattctcagtccctgtgcttttaatgattctaagaggtcctcattaaaaaaattgcccacgttgtcatcctctgtgaagatgatgtacaaatgacttgcctttctacatggaaattgcaggcatcttcatttgtattttttaggacagagggatcactgtttaatatattaagagcagtatataatggattccagctgtataccttccattattgctaaggccaaattactgaagtctttggcaaaccttgaattccctgttttggaaaagtackaggtctgtgaatataaagggtttggagattgtttcccatctctgtttccttgtcttttgttatgagaacaaccatgggaggcatctgtgtcttttttcctacttaccaaacactcagaaaggtttctttgtgacatctgtagaaagcagaatgctctcatgggatctataggaaaagcttgaaaataaaaagtgaaatattttcatcaatgtaaaagtgacccatataatgtcattgaaaagacctctgaaagcgtaataacataatgtgatgtgagagaattgagcaaagttttcatcttgtaagcatagtgttttattactttaaaaaagcctatacaattctgtagtacaaaataatttcataatatagaataataaaatacattaaaattaatctataaaataagataatatataaagcaatataaaataaatgagtatacatatttgaataatgtgtcaagttatgtaactatcaatgtaatcatattataacatatgtatatcataaatgtatatgcatgtgtgtgtatatgtttattttcatgagcaattaattcatcccaacgctccctcttgagaagtagctaagtgagacacagggacataggaagattgagttctatcataaattataactaattagttcccagtaaaaagtgggagttgtactgcttggttcccagtcttgtaatgttgaattgtgcagtagtttcttagtattgacattaagaattagagggctcaccataccaagtggtaaaattcatagctttcttttttttttgagacacggtcttgctctgttcccaggctggagtgcagtggtgcgatcacagctcacaataaccttgaacttctgggctcaagtgttcctcctgcctcaacctcctgagtagctgagactacagsmactagccaccatgcctagctaattaagttttttttgtagagttaggrgtcttgctctattgcccagtcttgtcttgaactcctggcctcaagtgatccacctgcctcaaccccgcaaggtgctgggattataggtatgagtcaccaggcctgtcttccttcttaaaattaagattgcatgaagggaattaaagcactgaataaggtccaatgaacttttaaatctgtacgtctttcagtttgatattttgggtattatagtgtctttcattgactatgttggctatcaaatgtggaaagcatagagaaagtgtttagggttcttcatagtcatcacttttggcttatccttatactggtataatattggtatatggtaatcatgttagtaataattacaaaatctattatacccttagaatgtaattttccctccaatcagaaatgttaataatggaaaagatttgtaatgcaactaatagttgctttacagtatcttattaatttaagttaaaacatatatctgagtacttatgtgctaggcatctcctggggaatgaaggtcattatactagcagatacttgtattcaaggagatagtttaaggaagsaaatgcatttttcttaaatttcagtagaatagaggttatccccaattaacaggtactgggagtcagtgtgttgtattggaaatagtttaagacagacccagatttattcttggaggctgaggcttgctcatttacttactgagagaccttgggtaagttgcttatcttctgtgagcccaagtyccctaatgtaaaatgggaataaataggctgggcatagtggctttcacacttgtaatcccagcagtttgagaggtcaaggcaggaagatcagttgagcccaggaattcgagactagcctgggcaatatagcgagaccctgtctctacaaaaaaatttaagaaattatccaggaatggtggcttgtgcctgttttttggctacctgggaggctgaggtgggaggatcgcttgcgctcaggagtttgagcctgcaggaagccacgagtgtgccactgaactccagcctgggcaacagtgtgagaccctgtctcaaaacaaacaaaaaaaataaaatgaaaataataatatcttcattgcaggattgttgagaagatgagaggaaatgtatgtatagggcacagtgcttggtacagggtagtgttcagtaaaggatagttgttgctgcccttttaaatcatctgtttgggattaggaacatattttactttggatatataggaaacatcccatttggaaacatcccatttagaaacttcttgtgttacaaagtttcctctctagatcagttttctagattgggcaccaaattcccccatctccatttttggaaaataactttattgaagtataatttaaataaactaagtttatagtttgatgagttttgacaaatgggtacacctgtgtaactagcacaaamtatagaacattttcatcacccccacaaaagccactggtatctctttgcagttaatgccacaccctaaccctaagcaaccattaatctgctttttgtcactgtggaataattttgcctgttctggaatctagccatagttttttatatctcttggataaatgcctaagaatgtttgttgggtcatatgctgactatatatttttttcattttttgaagctttttgaggtataattcacatccaataaatcacatgtatttaaaccatgtaatttaatgatttttgacatatgtatacacgattcagatattgaacatatccgtcactcccaaacactacttgtgtgcttagattatctctctctccctcccgtgagccccttccattccaggcaaccactgatgtgctttccgttactataaattagtttccaatttctagaattttatagaaatggatcatacagtctactcttttgtctggcttctttcaatctaattattttgtagattatctttgatgttgcctatatcgttaatttactgctttttattattgataatgattccgtttaatgggtataacacatcttgtttatccattcatcagttgatggacatttgggtaattttcagttttcagctattacaaacttagtgactatacacattcatttataaatctttatgtagacatgtgctttccttcctctctggtaaacatcgaattgctggaccatatagtaaatatatgtttatacctttaagaaactgctaaactgtttctaaggtgatggtaccattttacatttccaccagcagtatatgagcgtttgagttgctccttatactctataacacttgatatgatcagtctttttaattttaagtcattctagtggtgtgtagtgttatttcattgtgtttatgatttgttctattgattacagagagtattgaagtctccaactgtaattgcaggtttgtctagtcctcctttaaaatatataattttttactagtagtttagtattttgaaactgtgtggtgaaatgcacawaaaattaggattattatgttttcttgaattgacccctttatcattatgtaatgtttattctttgaaatatactttgttaggccgrgcgtggtggctcacacctgcaatcccagcactttgggagkccraggtggrcagatcacaaggcaggagtttgagaccagcctgrccaacatggwgaaaccctgtctctactaaaaatacaaaaattacctgggtgtgttggtgggcacctgtaatcccagctactcgggaggctgaggcaagagaattgccccggaggcagaggttgcagtgagccaagatcgcgccactgtactccagcctggatgacagagcaagactctgtctcggaaaaaaaagaaaaaaaatatgttgttctgaaatctactttaatattcacatattcattccaactttcttttggctagcatttacaaagtatatctttttctstccttttaattaattttttaaatttcagaataattttaaattttcacaaacattgcaaagttagtatagaaagttcctatatatcttccaccagtgtcccctaatgctaacatgttattaatacataatcatggtacatctttcaaaaattcagaaattaacattgatacatcactccaaaytaaacttcagactttatttggatttcactagttttttcacttttttttttttctgtttcaagatcaactccaggaaactgcattgtatttagttgtcatgtctccttagtcttctcttggctgtgacgctttcttcacttttccttatttttcatgatcttgatagttttgaagaatactggtcaggtatttcatagactgtccctcaagttgggtttgtgtgatgttatttctcatcattagattggggttatgtgcttttaggaagagtaccatggtggtgaaatgcctttcttatttcatcatatcagggggttcatgctatcaccgtggatttatcatcagttatgttaatttaggtcattcagttaaggaaatacctgccaggtttctccactgtrggagtggtgagagatgacttgcagcctttcctcatcttaggagaaagcattctgtctcttaccattaactatatataatgtggtggtacttttttttatagataccattaggttaagtttcctctattcctaatttgctaagttttatcatgaacgggtattgaatcttgtagaattttttttctgtatctattgatatggtatatggcttttcttattttgtcttttagtatagtgaagtacgttgattaatttttgaatgatgaaccaacctctcattcttggaataaatcctacctgttcattatgtattagtctttttatatgtttctagactctatttgctaatattttgtggaggattttgtcatttatattaatgagaggattaatcttcagttttcttataatgtcttattttgattgtattttatgaagatgaccctacaatcaaaatgccttgtattctgttacactgcttagtttcttcattattactacataaatagcatatggacctagtctttggacaacatattgaaatcttgacagggatatgtctatcttgcctaatatatatatatgtgtgtatacacacacacacacttatataaacatttatatcttgatatagtacctaaattatttgctgttgaattacatatgttgtaattaataattatatttccttagacatttgtatagttgaaatttgctaagagagtagatcttaagtattctcaccacaaaaagtcagtatgtgaggtgatggacatgttgattagctttactgtagtaatcattttmcaatgtatacatatagcaaaatatcataatcactttgtagcctgtaaatacataatttattttttctcaatttacaattaaaaagggttaaaaaatcccatcacattgtatatcttgaatatgcagcatttttgtcagttatgcctcaataaaactcaaaaaattattttagaataactagaggactgataattcatatattgttgaatgataagtatgtctaaaacaattaccataagagaaatcagggagaaaattgactttttttctcttagagaagaaaatatacatatgtaaaatttatttaaatgaatagttatttaggaacccatgagagagattataggatcaatagtttttaaaaatttgctcttgctttgtggagatgacattttgaccctgatagtaactagctggttgacctaagttccataatctctgtagatgttggtttcttcattgtcacaatgtgaaggagatgtattttatttccaagacccccttttagtttgaacatttcattgtattctatcttatcctgtccttattattagagaacagaaataattatttcacgtagcttttacagattgattttggattgactgatgagtttttaaatattataattgatttgtttgtattacatttcttctgattcagtgccccatttacagtgataatcagtcaaatgaacagacaggagccactgtatattatttgggactctctttctgggtcagattatrcactctggatttcagtcatcatttccatggcatgatttccaaatgtggctgtagccttggcctttccttctcaactttggatcatttctgtttgctgggcacctccaccagggtgtctccaccagaatgtcttgstggcttttcaaactcaatgtgctcgaaactgcatttatcactttttatctaaatatgcctctgcttgttattgaagcctgaccatctttctatatcatactggagggaaacctgggagtaattttatactctttttctctcagtactcttgacagtctttattgtctgacacattctgtgctaggcataaagcattattggattgtgttggagaatccagaaccagtgcctggcacccagcagttcctgaatgattgaacatgtcactttacctatttaggttagttaattgggtctcttctccttcctgtaatacttgtcaccccttcttcctgtaggtgccagggatttggcttgcttttatctttttttttttttttgagatagggtcttgctatattgcccagctggtctcaaactcctggcctcaagcaatcttcctgacttagcctctctagtagctgggattacaggcagtgtgccaccacacctggtttgtttgtttgtttatttttaataactgtcggctactattctgttttctgagtttgtcttactggctgggttggcagtatgttatcttagctagcccttttcccctgctatgtcttaacatatctrtatatttttaaaaagtattttaggctgggatggtggctcacgcctgtaatcctggcactctgggaggcagaggtgggtggatcacttgaggtcaggagtttgagaccagcctggccaatatagtgaaaccctgtctttactaaaaaattagccaggtgtggtggygtgtgcctgtagccccagctactcaggaggctgaggcaggagaattgcttgaccccgggaggcagaggttgcagtgagccaagattgtgtcattgcacttaagcctgggcgatgcagggagactctgtctcaaaaacataaataaataaataaataaaatagaaagtattttaaaggaatttttwctgctatttgttaatgaggaaatagaaaggctggttaaaaaaattaacaggagggagcttacaatgttcccagaactcttccaagtttatgtagttattcctgaactaatgttttgcatacctttcaatattcctgctatagctcatatatttaggacagactttgataatattcccttttactctatgcaaaatactgtagagcagtgatttccaacttttttttttttttttactatgaccttatcatgtaaggaatacatttcaaactgtgaccctacatrtacagacacrtttgtgtgcatgtgtattaatatagataactgaaactaaaatttaacaattattcttccatgtataatacaataaaacatatcaaagttaatatcaaatgtaatctttgtattgcagtataatatggaacaaatccaagataaacaatacaaaaaaccaaggatttattaatgccacaggtgtacttgcaccttaataagttcttttcactccagaacaattgggagtcatacacatcttgttatactgttttgaaatgtgctgtggggtgtgaggagaaagggaaggttgaaataattctaaactgtatcctaaggaatcagagggctgtttgtaccctygttggtataaagagggaggggaaaaataagctcatctgtttttttcaggcaaattttgagcctttatttattttttcgtttaagttgacatgtartaattgtatgtatttatgggatacagagcatatttcaatacatgtatgcagtgtgtaatgatcaaatcagagtagttagcattcatcaccttgaacatttatcattcctttgtgttgtgaacattcagaattctctcttctagctatttgaaaatatacactaaattgttgttaatcgtattcaccttacactggtacagaacagcagaacttattcctcctatcttgctgtataaattgttgaagagccactcaaaaggcagtgttctctatatcattgatgataaaggtttaagctaaagaggagtttatctcttcgcaaggaacatgaaactttcgtatrctgttttgacatggcattgataataaaggatacatagtggactttattagtaaaataccttattgtaacataaatattaaatcatgaacataactcttacaaaattatcaacttagaaatccttttaggctgtcatttcagccagttcttatgatgggactatgacctgagatggtatgatggctataggctatggactgagaaatcataggttggaatactagctctaatctttactagtcacatgactttgggtgaatcccattttttttcctgagcatcagtaaggatagaaatataccgctcatatattgtgatgattaatgtgattatgtatgtaaagtgccttgtatagcacatagtaggcccttaaatgttaacttttctgttactctttctttggtcctactaaaaaatattatttgtttctctatggtcttaagcatgaagactataatcaggtttgaatggttttctacataaaccttttaaggcaatgttttaaagatttaacattattaagaatttcattttacaggactaacatatggaaatatgctatatttgaaaaattactgatgttagggattggtattcaatatcttctgcttaagcttcttgtgtccctctatcagtcatctttgccttacaagaaggttttgtctttcttggaaggttaattctctaaggtaatcatttaatttattttgttctattcattaaaacaaactgtttaataatttaatttgagtaaggaaataattaactatcaactatgtaaagtttagtttttattgtgaactcaaagcaaggytttgtggcatctgctttattgttataaattcaagcacagtatcagcagcttatgagttatattttggattttaagtgagagctgctaggagtaggatcactggctctctataactacaaacatttgatatcctgcacatagttgaacagtagcaaagctggagttctcagatatagtactgactgattatgtcacgtcatcrtttttggatagcatctgctcatctcctctctcttgtctaagtggtttaggattaaacaaattatgagggtgtccaggctaggaaaagaggactttgtgctatgtagycaaaatttttagtgtgtgaatctatcttccttattagattttaagttcttagaggtaggagcaaggtacaagaatagatgaagataatattgttagtacctggatttattctaacatgtggcttattcttcgtggaggagggcaaggatttcataaactagcacaggtagcctcattttgagagatcaaagatgtttctgaaaatgctttaggcaatatcgtaaactaagaatttctggttcctttcttgattgcaacaaattggttatcattttgtgtttttgtctagcatcattgatcattgaggacaaacttttttttttaaccatatgttttttaaaagcattaagcagcaaagttacacagttttctctagcagtgctgcatagcttaggagcaggagtgggataggaaaagctgatagatgtgtttggtattgtctggatgcacagtttggacaggagtcagtgtagtatagtggttggtatgagttttggagtagtacaggctgcataactttaggcaagtaccttaatttctctaagctctaatttccccatctacaacatgggataataataatatctacctaccttataaaattagtatgataattaaataagatgartgcaagtaaggtgcttatttattagcacaatgcctggcttatagtatattagatgctatttttattttgttgtgattagaaggaggttattaaagtaaggttattggcgagaatctaattgaaataatagggaggttcaggctggcaaggaggaaagtgaaactaggaagaatgttaggtactggagaataagaaggttaataggttagaaatgtgatgagggtgaaatgtaggcttagcaatagaaaagtagaaaaataagagttaatggccaataagtgagatcacagcttgagattctagagatggaatatttccagataatatccagcctttgacaaaaggaatgggttgctgatatgaagtgaagatgaattcattttaacaaatatttatgaagcctttaccgtgtgctgctttgctaggcattggggaatgtcacatttgggtaaaacatccttggattacaggaaatcagaaaccagctgttggtcactcacctgaatgaaaaagtttaccatgacaatggcagaagctgggacaacaagaaagactataaaacttattgtatctaagaatacttcagtggattgacttgtttttcattggcataagattttactataaatggctctaaaataggtgcatctcccagtagggataaaataattagtaacattaatttagagtttaaaagataggtgtcctaaattcatttatttaactagtcttgtttttttcagctttcctttttagccactagtgtacagattagatgattaacccaattctttttagttttagaggaatggtttgttgagtgggcttgtgttcattttgtttctgagtaagtatcctagaaaaggagcatgtcccaaagaatagcacaactggggcaaaaaggagcagctcaagttgtaaccatgatgattgtttcctgtgccggcttttcaataggaagttgtagattttaaaatctgggaagctgggaagcttactttgaaacaaaaagaataatgttgatcaaatatttaaaaattacatgtgtgctataaagcagcaagaaagtgaaatcctgtatgccatttttttgggtttcttctagtcagtgatggtagcatagatccacacatacttgttttttttgttttcttttgtttgtttttttcttaagagatagagtctggctgtgctggtcaggctggacttgaatgcctgggcctgagctggagtgatcttcctctcttagtctcttgactagctgggactataggcgcagtaccccacaccgggcaatacttggttyatttatactgattatgactaaagtcagcagaacaaaacaacatgttcacagccccaagaaattcccaggcatgcaagttaagaactcccattttaatgcaagccaagtctagtcagtgacccttttgtctgatacacaaccttttcacaaactccttatacttttctctaatgtacatttaagtagacttacatgttattccatctctgctattttttttccatattacttttaacatcattatgaggagcccagtagccaggactaacagaagttgtgaacatatgcagtctactgtcagatggaccttccgcttcatttgggcaaactgctactgtgcacttggctcatttcactcacatctaaaaaatgttaagattctgcagtctccttttcctcttttttgtttttgactgtccttctaccatagtgactctcactgtgtgatccccagtagtatcacctggaaacttcttagaaacttcttagaaatcaagttcccaggcctaaacaagaccaactgaaccagaatctctgggggtgggacccagttttaacaagccctgtacaagtggattccgacacatgctgaagtttgagaaccgctgctctagcatgttgtagttaccaacctgtatacattttcttgatgtcactgacttaatatatttctgctaagctcaacatatatgttgaactgtggccagtaattaatgttggtggtttcatgtggctcaactaatatttgctttgtctaaaccaggatttcttagacatattttgttgagatattgacattctttgttgtaggcagctgtcttgtgcattgtaggatgtttagtgtcatctctggcttctacctactagattacagtagtatttcctaaatgatgattaaaaaaaaatgtccctagaccatgagtagaggggaggggaagggggagatcactcctggktgagaaccactagctaacccagtttcttttccttcaaactcataatacccaatgtactacccataatgtatcagtttttctccctgggtaggaaaagggccagatataaattaattatagaaattaaagattatggtgattataattttttataattttacaaaatttatatttctttttatgttttttcatgtcctatttatagtgagcaatatcaccctatagactagtattatttgctttccttgtatcttattgctgtgaaagtctaatgataatttgcttttctttttgttcctaagtaacttgcttattttgcttggatgcccaaaggatttttctttttctttaagattcaacagtaaatctcagtattggttatattggattgattttctcargtttgtggtatgtgcttttgaatctttttttttttttttgacttaaaaaaaattccttcccttgctttggttttggttttcttcttcaggaactcctattgaaagttgttagatcttctttgtctatcttatatattactttctctcaagcctgtattactttctttcaaaggtttttttttttttttttttggagacagaatttcattctgtcgtccaggctggagtgcagtggcacaatcttggctcactgcaacctccacccgccaggttcaagtgattcctcctgcctcagcctcccaagtggctgggattacagatgtttgccaccayacccagctaatttttgtatttttagtagagacggggtttcaccatgttggtcaagctggtcttgaactcctgacctcaggtgatctgcctgcgtcggcctcccaaagtgctgggattacaggcatgagccactgtgcctggcctcaaatcttttttatttaaaaatttttcttcttttcaccttttatttctcttgaagtattattgtgtttattcatctttttcttctttctartttagtcttttttgaaatattttcttctaattctttcctgagttctatcacttcatttctgagttttcataattacgattcatgtgttttttcatatcttacacattaaaaatttctttgcttgtggagaaatagtaggttatagttacctgtagtttgcgtatgtctttcatggtctttgggaatattagtctgctccttattctctctttaaaaattaactatccgtgtaatttaatcatgatccttatttttcatttttatgtgaaattagttttcataaaccttaggaggtgtggttcaggatagcttttctaatttcagggctctagagctcccttttttgttgttttgtatagtgttcgaattaggataccttactttgtgaggtttctcggttctgtttctctcctgtacttttatgtggaccttcttgttgttcctctgctgctcaatttggattctgtttcccagaatttttcttcatcttgggtctttgttctagaagttttgaaagttcatggggataagactgcttggtcctctcagatgttactatggacttgaattcatcagctgttggaggatacaaaaccatttgcagttttagctgccattcacacgtggcatgcatttttggtttgtgtgggaaatcttatcacgtagttatggtgtagatgttatgcatggtttattttatttattttgkttaattttattatttttgtcctagttgctctgtttttaatgagggattcaggaaattttaaaaaatgatgtgttcactgctgccatcttcataggggtactttcatcagtctttttgtatttatatactttattttgcaccagtttattgaggtattgatgtacagtaaactacatatatttaaaatggggaatttgatgacttttcacatatgtgtattcccatgaaaccctcaccatgatcaagataataagcatatccacctccgaaaatttccccatgtcccttttgtaacccagctttcattctcctttcctcattcccaggcaaaaactgctttctgccactatagttcagtttgtattttctgtgattttctgtaagtgaaaacatacagtagtattattttttttgtatggcttctttcattcagtgtaattgttttgaagtttatccatgattttgttcatttctttttattgctatatggatatatcactgtatggaatataataatttgattatccacttgttagtgaacatctggattgttttatgtattacaaacaaagctgctataaatatttacattaaagtgtttatgtgaacatatgctgttatttcccttggataaatgtctaagtatggaatatctgggtggtttggtaggtgtatgtgtatcctttaaagaaattgtcaaacttttccaaaatgatcgtattattttatattccatcagtagtatgtgaaaggaccattactcctcatccttgccaacatttggcacgttgagtccttataattttagttattttagtgaatgtgtagtgatatctcattgtggttgtaatgtaattttacctaacrattaaaattttgttgagcattttaagatgtatttatttgccatttttatattttctttggtgaggtgttcaaatcttttgtctgctttttattggatgttcttactcttgtagttaagaattctstatatattctagatacaagttgtttgctaaatatttattttgcaaatattttatgccagtctatggcttacattttcatttttgtaacagtgcctttgaaaaacaaacatttttaattgtgatgaagtttatttggttgatttttaaattttttatactttaccttttgtgttttcttcaagaaatcttgtcaaacccaaggtcactaagattttctgctgttttcttctagaagttttacattattggctcttaaattcaggcctgtgatccactttgaattaaattctgtttattgtttcaggttgaggagagactcattgtgtttgtatacggctatttaattgtcccaccaccacttgttgaaaagattatcatctcctcattgagttgtcgtttcacctttttaaaaactcaattgcgcatttatgtttgggtctatttctggactttctgttcttttccattgatcatatgccagtattgcacgacattgtctgttgtagctctactgttgtagctctgtgataggttttaaaatcaaacctgctagtattagccctacaactttgtttttgtcagatttgttttagctattctatatcctttgcatttccatatagattttagaataagcttgttcatttctgcagaaagcctactgggttttagaaggggatcatattgaatctgtcttcaatttgtgagattgacatcttaacagtattgagtctttgatacttgaatatatttagttcttctttatttctctcagcatgttctgtaatttttggtctacaaatcttaaacatcttttgtcaagttttctaaatatatttcatattgaaataggaaaagttccccagaccgctcgcagggcgtgcagtgggggagtggcgtgcttctttggtgccccactgctcaaacctctagggggagcatgcagaygggcaggttgtggggctctgaccccatggcagtgtctagaggtagatgtttagagctcccgaagtcccagtgggcatgtgttacagggtgctctttcagttttgctgtccgtaggcggcttgtgttagtcagctcaattagacccttgccttattgcaaggtcagagggctttctgtatctcggggtttcttgccttggtgtactggaagaatcggatcacacgtggacttggagaataagtgcaaggttgtattgagtagaagtagctctcagcagatgggggagccagaagagagacagagtggaaaggtagttttcccctggagtcgggctgcttagcagcccgcgctctcctctgactgccccagccaaactccacctcattccgggggttgatggcttgcggacctgccagtgcctgttattgtgctcttatgcggatgcgctcctcttgacggcctcttaacatctagctgcgtgtgttttcttccgctggagtgttcctttccacgtccagccacttgcrtctctgcctgctagggtcttggggtttttataggcacaggatgagggtgtggtgggccagggtggtcttgggaaatggcagaatttggacgtgaaggcaggagttcctgtcctcacctaggtccgtgggcacaggcccaggggtggtaccctagtcagggaacagccyttcccttcccggcacttccctgcaccccctcccatatcaatattgttatgttaatgtaaattagattacttttaaaattataatttatatttcttttctattatatggagaatataatatataaaagtagagatacttttatrtattgaccttgtattctgcatactgctagactcacttattctagccattttgtagattatttaggatattcaccatagacaactatgttgtttgtgaataaagataattaaacttctaatctgtaagtcctttatttccttttcttgccttattgcactggctcagagctccaacacagtgttggatagtggtaatggcctagtttcaataggttggtaccaattcttctttgaatgtctgatagaattcagctgtgaatctgtctagtcctggatttctctttgttggcaatttttaaattacaatttcaatcttgctgcttgttattggtctgttcagagtttctatttcttcctggtttaatctaggagggttgtatacttccaagaatgtatccatcttctctaggttttctactttgtgtgcataaaggtgttcccagtagccttgaatgatcttttgtatttctgtggtattggttgtgatatctcccgtttcatttctaattgagcttatttggatcttctctcttcttggttaatctcgctagtggtctatcaatgttgtttatcttttcaaagaaccagctttttgtttcacttatcttttktwttttttttttgtttccctttcatttagtcctgttctgatctttgttacttcttttcttctgctgggtttgggtttggtttgttgtttctctagttccttgaggtgcgacctcagctagtctatttgtgctctttcrgactttttgatgtrgacatttaatgctatgaactctcctcttagcaccgcttttgctctatcccagtgattttggtaagttgtgtcactattattcagttgaaagaattttttaatttccatcttgatttcattgttgactcaatgatcattcaggaacacattattaaatttccatgtatttgcatggttttgagggttccttttggagttgatttccaattttattccactgtggtctcagagagtacttaatgtaattttgattttcttaaatttattgagacttgttttgtggcctatcatatggtctttcttggagaatattccatgtgctgatgaatagaaagtgtgttcttcagttgttgggtagcatgttctgtagatcatctgttaagttcatttgttctagggtatagtttaagtccattgttgccttgttgactttmtgtcttgatgacctttctagtactgtcagtgaggtattgaagtcccccactattattgtgctgctgtcttaggtctagtagtaattgttttataaatttgggagctccagtgttaggtgtatatatatttaggattgtgatatttcactgttggacaagtcctttttatcattatgtaatgcccctctttgtctttttaaactgctgttgctttaaagtttgttttgtctgatgtaagaatagctactcctgctcacttttggtgaccgtttgcatggaatatctttttytacccctttaccttaagtttatgtgagtccttatgtgtgtttggtgagtctcttgaagacagcagctggttggtgaattcttatccattctgtgattctgtacctactaggtgtctacccagaggaaaagaagtcattatatgaaaaagatgcttgcaaatgcatgtttgtagcagtacaatttgcagttgctaaaatatggaaccagcccaaatgcccatcagtcaatgagtagataaagaaaatgtgtgtgtgtatatatataaatatatatatatacatatatatacacactcaccataaaaaggaacaaaatattggcatttgcagcaaccttgatggagactattattctaagtgaagtaactcaggaatggaaaagcaaacatcgtatgttctcacttataagcaggagctaagctatgaggacgcaaaggcataagaatgatacagtggactttggggaccctggggaaagggtgtgaggggtgtgaggggtaaaagactacacactgggtacagtgtacactgcttgggtgataggtgcaccaaaatctcagaaatcaccgctgaagaacttattcatataaccaaacaccacctgttccccaaaaacctatagaaataaagtgcttagatacgaatctaagaaaatgtgtgtaagatctgtttgttaaaaattacataaaactgaataaattattcaaagatataaataaacaaagataaatattgtgtttatggattaaaataaagaagtggtaatggtcaacatccctgccttgttcctgacttgggggaaagtattctttctttcaccattaagtatgatgctagctctaagtttgtcgtagatattctttatctggttgaagaagttcccttctatttgtagtttgctgatagttttaaatcatgggtacatactggatttctcagatttccacatgcagtgaggtatccatgtgttttttgaaaattctgttacattaactgatttcaaaaattaacccttttggcctggtgtggtggctcacgcctgtaatcccagcactttgggaggctgaagcaggtggatcatgaggtcaagagatcgagaccatcctggccaacatggtgaaaccctgtctctactaaaaaataaaaacaaaatattggccgggcgtggtggcacgtgcctgtaatcccagctactcgggaggctgaggcaggagaatagcttgaaccagggagtcagaggttgcagtgagccgagattgcaccactgcactccagcctggtgacagagccagactccatctcaaaaaaaaaaaaaaatctttttattttgagaaaactatagattcacatacagttgtaagaaataatacagaaatacccatgttctctttatccagttttcccctatagtaacatcttgacaggatgttgacattgataaaatcaggatacataagatttcyatcaccatgggatctctcacattacacttgtgtagtcacacctatttccctcctgctcctgtatctctccttagcccctggaattcactaacctgttctctatttgcataactttgtcatttcaagaatgctatataagtggaatcatacggtatgtaaccttttgggattgaatttttttcacttagcataatttctggagattcttcaggtggatacacatataaatagttctttttttttcctttttattgctgagtagcattccacagtatggtgtactacagttcatttatccgtttcttcacttaaggacatatcattgttttcatatcttttttttgttgttgttttgttcaaataaaggtgttataaacattcatccacaagtttttatgtgaacagaaatttttatttctttgggataaatgccccagagtacaattgctggcttgtatggtgttgcatatttaatattttaagaaacttccaaagtgttttccagagtggctataccggcttacattcctagcagcaatgagtcatccagtttttttgcttttggtagtgtttttaaaattttagccattctgataagtgtgtagtgatatctcattgtccttttactttgtgtttgcctgatggttaatgaattaarcatcttttagtgggcttatttgcaatctgtatatcatcctcagtaaaatgttccctcatgtcttttacccatttttgaattggattgtgtattttattactattgagttttgagagttctttatatggtctcgacactagccctttttcaaacattcatttgcaaatattttctcccagtctgtggcttgtcttttcatccttttacagggtctttcacaatgcaaaagttttaaattttgatgaagtctaacttttctttcttgtggatcatgcttttactgtcaagtttaagaattctttgtctagccctagatctagaagctatttgcccatgtttttcctgacaggtctattgttatatgtttcacacttgatcttagtgaaaaggttgagaagtgattagttttatgttttaagtataagtctgtgatttactttgagttagtgtgaggcataggtcatgtcagtttttttttgtttttaattttaaacacctgtggatatctagttgcttcagtgccgtttgatgaaaaggctgtcttttgtctactggattgtctctgcactgttgccaaaaatcagttgggcatatgtgtgggggtctatttctgggttctctcttctgttctgtggatctgtgtctctctccttccaccaatactgtgcagtgttggttactatagctatataataagtcttaacagtgggtggacacaattcctcctacttcattcctctttttcaaaattgtttcagctatgctcattcctttggtttttcatacaaatttagaaaaaatataatctatgtctccygaaatcttgttggtattttgataggaattgtgttaaagctgtataccactttggggagaatcgccatatttaccatgctgaatttccyagtgtgtgcctctctgattgcttagatatcctttgatttctttcagcattgtgtattttcagcctacaacttctgtacatattttgttagttttttggagtgattataaattatattgaatttgtaatttcagtgttcatgtgttgacttttgtcacatgttttttctgaattggtatgatcatgtgatatttttcttctttagcctgttaatgtgatggagtacattgatttttaatattgaaccagcgttgcatccctgcaataaacttcatttgatcatggtatataattcttgctaaaattttgttaaatatttttgtatctatatatatgaggtatactgctttgcagtttttcttcatgaagtgatttaggaagtgccacctcctcttctcttttctggaagagattgtgtagaatagtgttaatttttcattaaatggtagtattctccattgaaaccatctgggcctggacaattttttaagactttgaaaatattaattcaatttctctaatagttgtaggagcattcagattatctctttcatattggataagttgtgactatgtttatcaaagaattggaccattttgtctaagttttcaaatttatatgtatagaagtattcatagcattcacttattatccttttgatttctgcagtctgtagagatacctaccgtttcaatcctgttgttggtaattcatgtcttgtcttgttcttttgtcattcttgctgagattagttgatttttatcgatctttaaaacaactaggtctttgtttccttccttttattttttctatttttattattaatctcatctctttgtttcttctgcttgtattgtgattattttgttctaggttcttgaagtggaaagttagattattgatttgagatgttccatttttttctaatggttacatttccctctttgaatatgttacctgtatcycacaaatgttgattttttattttcattagttcagtgtattttttgatttcccgtgagacctttctctttgattcatgggaaaatacagaagtttgttgtttagtttccaagagttgggagatttttctgttacctttcttttactaacttctagtttgattccattgtggttagagaaaattctgtattatttaaattttcaaaaatttgttgaggtttgttttgtggtctgtcttgatatatattcttcgggcacttgartggaatgtgtattctgctgttggatagagtgttctataaatgtctactaaatcttggttgatggtattcttragttcttctatatctttgctgattccctgtgtagttctgtcagttgttgagagatgggttctgaaatctccagctgcacctgtgtatttttgtctgtttttcttttcagtctcatcagtttttgcatcacatattttgcaactcagtttgttgtatacacacttaggtttgctatttcttggtggattcatctcttttatcattttataatgtccctgtctgtctctggtgattttctcttctctgagatttactttacttgataytcatatagccactcctgctttcttttgattcacatttctatgatacattattttccattctttattttcaaccactgatactgttatatttgaagtgagtktcttgtagacagtatatagtcgaatcatttttaaaatccactctgccaattccggtcttaaattgatatatttagaccacttatatttaatgtaattgttgatattttaaggctaaagtgtatcattttattttttatttgttctttttttgcttctgttttctttttcttgccttcctgtgaaaagttttgttttcacctccatgaggtattagagattatacccttttttatcttaattgcaaattagtgaataaaattcactgaacattcaatatttaatgttcctgacatctgttcatctagttagccatctattcattcatgttttcaagagatatttattgaacctctaccctgggccaggcattgtcattttctttttctttcagattattctctttcagttctttagcagtgtagtaaatttatttcctctggttgktgtaacaaattaccgcaaaccaggtggcttaaaaataatagaaatttattctgtcacagttctagaaaacagaagtctgaagtcaagatgtcagcagggatctagaggagaatccattcttgcctattccaacttttggtggttgtcaccattccctgacttgtggctgtattgctcaaatttctgcatctgtggtcaaatggccatctattgtgttttattctctgagtttttcttttaaggacacttgctattggatttagggcctagatagtttggataacccaggataatctctttatctcaagagccctttaaaaattaagacaataatcgcaggttctaggattaagatgtagacatatcttttagggggccaccattcagttcactacaaatagtatttttctgtgcaactttgatttctctttttttgatcctctctccatttggcatgggttctctatttcacaccctttgctattccttctgaattttgtytattaaargattctcctagagagtgatgagaacagtggaatgattatgatgtcctgtatttcatagcttaccgtatagcaacagaaaaagcctttcttcatgrcagggcagcttcatttagaatcagaatatgtttctttctaatagaacttactctaaagcaaaaataatattattttaaaaactatgtaaaacaygtattaaagtcttatgtacgtataactacaaatccatttgaagagataagtaaaaataattctaatcaataagtaaatattatggaatcagctatcaatatttaaattggtgtcagttaagaacaggtggaatttccctctgaggtgatgccatgtttattagcatctttttgatatatatatctatatctatctatctatmtatatatatgtatatttcaagtactttcagaacttaggccactttggttatatttgaaaacagttttttgctgtttgtggaaatggtttttttgggaagaatctgaacatttttttcaaggtatttaggccactagagtattgctgagattattttgataactccttaatgaatgttaatttaaaaaggagttatgtaaatataccctgctgatctttaagagtattgagtgtatctttaagaagtttctgacatggagtcaaatctagtgtaacaagtgatttcactgtaccaagagaaagttgtatgattttgctgtagttgattttattgctgtccctgttgctatgactattaatgttttaccgtaataaaatgttaccatttatatatttttataaastatggcaaactggcaggtcacaggaaaaaatgaggtagaattaaaaaatatgtatttaataatagtctcgaaacttytagacttaagacatataaaacaatagacaatcttgtttcagcacaagcataattaatatcttcatgtatttgttataagatttgcttaataaaatttcagttttggttttaattttatatctaaatgatgtatttctggcttaaaacttagaagtctgagtgcttaacattcaaagcagtyatttttccaattagtccatactttttatarctgtgcagaggaattcagcttataattataaattttaaatttgtgttttctttgtaagtkctggtcaagatgtccaaggaacaagtgtgattgcaaatctcccatttttgatgcgacagaatcccactgagacgcttcggagagtgttgccaaaagtcagagtaagttggtatgaaataagattggagtttcccattttttcccagtagcatgttgtyattgttgaaaggattttggagctttgatggctgatcttttgcacctwaaaattgagtkgaggaagtkttattatatacattttgaattataatgaaaatatttagggaaattagctgatggaaatggagaaatccagatcttaagttgtaaaatttctttagtcattttctcagtagagacattttactaaaggtagtttttagtagctcaaaaacacctcttaattattcttaaaaaaaagtatttagtattctgttgacttaaatctatattaatagtatttgtataacattgataatataattgagctgatattcctrataattgaccctatgatgacttctgaagaatcatcagataaagattgaattatagccatcacaattttagatgtgtatgtaatttattgctttataaatttcttcagaattagtttttctgctatgaacaaaaatgtttgatctattacattctttcttctgactaatatttattgattattaawataaaattaaataatttcaactattaaatatttagtaattatttatttgtacttatgtgcaaagtgcttttctttataagaacttgaatgaataaaacagacaccagtgtgtgtgtcctccaagagtttacctactaatggggtcagtgaggttacatactaatgaggattatgtttgctaatagaggttggtagattttgctttgttttttwatttggatatagctcttgtcataatttttaatttatgtgtttaaaatactgaagttattattgagtccttgagttttatttttaggcatgtgtagcatggttctagttactgtgatttagatcagggacataccatgttattttcatgagatgcccacctatgcaggcactgtgaacattttgactgattacaatggtgaattaagatgatatttattttggcattgcatgtgattcaaaagtaaatcaagcttttttatatctgtttttcccagaatcatgccatgtttcaaaggaattaggcccacacagaccaggtttatttttacgttcaatttcagtgatactaactgacytacacttgtcagcatgacacctggaagtgccagttaaacaatagcagaaaggaacaggtatttaggtcctcttggctacagagttaatgtaagtaagcaaattagatttatagctaagaatactgcatgctgcacactttgcattgagcaggtaaaatctggtccacagaaagcatattagatatccaaagtttcatatgcaagaataaaagatgaaagagagcagtgaactttagaggtctctaaattactttgcaaaattccttttgttgagttcacaataaaggaagttaagtaacagctcccccaaaaccttaatttcatgggagtatataaagaatattatacacttttttttattttcttactttctatttaaaatattctaaagaaaattttatacaaattttcattacttttaaagcttattaaaaccatatcttctataactcaggcataccttacagtttcaaaagatacatttgattctttgtataaatatgctatatatatgagtgtataatacaaagaatcaaatgtatcatatttatacaaagaatcaaagtgtataaagaatattatacactcatgtataacatatttatacaaagaatcaaagtgtataaagaatattatacactcatatgtatagcgtatttatacaaagaatcaaatgtatcttttgaaactgtaaggtatgcctgagttttagaagatatggttttaataagctttaaaagtaatgaaaattaatccataatacagagtatattaactgaataatggatacaaaggtagtatatactaatgaacatgtactaaggaaacctttatttatatgtgaatgatttcactcatttattttactaatcaacatgcaaccatttatttaggaccatcgtcttgctgtactccgtttaaaagagatgccgaaaaggtagaagagtccagattagactgtatattaggaaggtctagtgaccatggaaaacaatgagagaacaagtataatagagtattgtgtgcttgtgacttgatgtaaaaatgctgaagaataaggcaaatgagaagggctttatgggggtaactccagtaataatgacttttatygatagtctaatatataatgtagacagccaaacatttaatcactcccatttcaaatgataaaatctgtgtttctgtgcatattattttaaattcattgtattcagattttgttatgacttaytggtactcctggttagcacctttgtcaattccacctcacttctgtgagtgtctactttccagtgatgaaatgctgacagcatctcgggtaactgctttatttacttttgcttggccatgatttctcaattttttaaaagaaagtaatcttgagcatttagtaataatggcattctcattcattcataaatatttactgagtccttttataaggcaggcactgttcgaagcactgggaaaatagaagtgaacaaaagatgggggacttgccctcaaggaggaggctacagtccagatggagaaacagacattaaacaagtaaatccctcctcacccaagaaaggtataatggtcatttgtgataagcactctgagtgtacagaacatgagttgatgagataaagtaatatagtaacgagggcacctgctgtgcattgggatggcaaggaatgcctttctgaggagcagaaaactgaagggatggaaagaagcagccatttgagagtcaggaccaagtagttcaggtggagagaacggtarttagccctaaggtgaaagagctgggtgggactgagagagacaggtgtgttttggacccagtggatggkgtggggtgtgattgagaagaggttagagaaatggttgatgaaagagcatgcaaatgttggttttcattcttaggacagtgaaaagtcgttgaagtctttaaagcaggcagtgacttaattgtgtttctatttcacagtgatcattttggttattgtatggagaatagattggagtgggatagttaggaagcttcagttctggccctcatagctagtatgaggacaactaattaagacagtagagagcagtagacatatctgagatacatgggttaaggtagaatgagcagaatttcgtaacagattgggtttgtgaagtgagagatgacttccagatttctggcttgaccatgcatatggttctgctggttttcagttatagttgatagtctgttaaattcataaggaaaataatttgtgtacttgataatactagtcttttgtgaatgatttacttttagataatttaaagatatgaacaatacatattttatgcaagaagttaatcaataccaagatttttaccacatttataacagtggtgtgtgcagcttttagagctcactttttaccttgtctttacctttaagaatatcagatgaagtaatggagattttgctggccttatgtattataaactttcaccagtgatatttttgttttattgcatttgcattttgttcttatgataatggattaattgaaaagtgatttaaaaaataggttgctttcactgttttagagataaaggaatttaatgtttaaaaataaaatgtcagaaacagagttagtgttacaattgagctaatccatcagattgaggttgctgtctagaataactaacaaagaagaaaaatagaaagtaagaaaaatagaattaagccaatccatagtatttccccaatttattttctaaattgtgtgctaagtgggcaatgaatggtagtgcagttaggccactcatctgaaggttaaatttagctagaaatttagaaaggaaatattttgacctccaatttaaatttcttaaatgtggagacattttaaaatatagtttttaccatatattcatgttacatgatttaatcctagggtatctattgaataatttttttcctgtgattttattaagttttaattctttttccacagtatattaaattgaaatcttagatgtttgttagacttcaatatttgctttgaacttctcattatctagaagtgaaagaatttgattgtcaagataaatatccaaaatattawaccatggtcttttataaaattcagaataatagcgwtataattacaccacataacgaaggtgattccattacaatccaatgcaaaaaacactctctacttatcraggtattaaatttatttagttgtttttacacttacattttggcaaccataaatttgtcataaaattatataaaagaaatcgagcaattccaggcacagataaaaataatgtagccaatatttattgaggtcttactatgtgtcaggcacygtattctgtcagatattctacacattttaatctgaatactcatagcagttctataatgatcacttgacagtggaagaaacaacttagttaagtaacttgctcaacgtcacaaagcttgcaagtggtataattaggtttaaacaggaagtctgagccctgagtcctcactctttactactcattagctgatcatgactgtaacagatataaaatgtgtaatttaatgtctcaagccttagtcatctcctgtctgtactacagcagcctcctcactgagtctgttgcttccattttgcctcctagagcaaactcacccagagaaatcttttaaaaagcatcaatcatatcttgtctcccacttgcatgaaaattacttaagtggtgtgrtaggtagaatcatgctccttcccaaaagatattgggccctaatccctagaaattgtaaatgttaccttatttggaaaaggggtctttacagatacagttaaggatcttgagattgggagattatcctggattattggggtggtggtctaaatgccatcacatgtgtccttataagaaggcagacgagagttgacgtatacatgtagaagaatgcaatgtgaagatggaggtagagattggagtgatgtggccacaagccaaggaatgatagcaaccaccaaaagctgaaagaagcaaaaagcagattctaccccagagcctctagatggaatgtggccttgccaacactttgattttgaccaggtgatactgactttgaaattctggcctccagacctgtgagagaagaaatagctgttgttttaagccactcagtttgtggtaatttgttacagcagccacaggaaactaatgaaagtaacttcccatttcagatataatacaaccccctaccrtgtccttaaatcacccccatctacctttgtgacctcatcatctgccagtcttttccctttctttcataagggcagaatatttgtcagtctagtttctcactatacccccggaacctagaatagtgcctggcagataataggcactcaaaaaaattttgtaaatgagtgttcattgaacttaacatttagagacaatataaatatctacctgaaagaccaagggaacattggcctgatccactgatggcattcttggatgagaagtaggaacagaatttgtttggaaatttgacayktacatgtagaatggtatataacgctgatttatgttcgagagagactttttgggggtttggagaggattygggaaatatataataaagaaaggataaaagggacataatcaatgtgaaatgtgatttccttttatttcggtgcatgcccatagtctcagctgctcaggaggctggggcccaggagtttgaggctgcagtgaatagttactgactgcactccagctagggcggcatagcaagacyttgcctctaaaaaasaaaaaaaaaacagaaaaaaaaagaaagaaataataggaaaaaataataatttctcctaatatgattatttattatagaattttatgtctcctgtatatgggtagatttttttaacatcttattctagagtttttacagaaagcattcactttataaatacatttgtaaatagaaagcttaactttacttttttaaaagtcctatttcaagtagcatagttaagtgaacaaacaacacagattgagcattcctaatcctcaaatccaaaatcaaaatgctccaaaatttgaagctttttgagcataaatatgatgctacaagtagaaaaytccccatctgacctcatgcgatgaggtgcagttaaagtcaaaatgcagtcaaaacttagtttcatgcacaaaattatttaaaatattgtataaaattacattcagcctatgtgtataaaatgtatatgaaacaaatgaatttcatatttagacttgggtcctatccccaaggtatttcattatgaatatgcaaatattccaaaatcgcaaaacattcaaaatctgaaacacttctggttacaagcatttgggataagggatactcaagctgtaataatgtgtggaacactgtaggccaggcactatgcttaatgctttagatatatccttaaaaaaatcctcctaacagctccgtgtgatgtatttatactcattttacagttcggaaaatctaggcttaaaaaattcagtgtttatgaatattttattgggagatttctaggaagcatgaaagtatgtaatttattcttacagttcaccaagaaaaagaaatagttttgactaaaggaattaaagagcataaacaaatgatacagattgctttcttctttggtttgcagctaagaaaacagggatctgtcttcctcactgaagatgatgtgttctgagataagcataataagcagatcatgatgttccagacccttacagatcataaaaagcccacaatatagtattctttagacaggctaaacatttagggacactgataggaaggaatgtaaataagaaagtgaaataattcctataatgtaaggttgatagaagataatcatcagggtcagaattaagaggtcttgtggtttaggaagcataaaattatgtaacttattgtttatttcactcagaaaataaaagtattaatgaaaggarttagagatgaacagattgatacaaactgttctatggtttacagcttaaaaaataaaggtacatttaatgctatgcattttgagaataatgtcttttatgctttttctttttacatatrtatctatttgtatttaaggacaaaatagattgacattactaattacttcactattaataattaaagttctgtgaaacatttactgagtatatagtttttctgggtatatatagttatattagctggtatgcattatagacctaaaaatattgcctttcagtaaattcctagtggacacyagtgttttcacatatgcttcctagtcattcagtcatttgttatttttaccctatctgcaataaaaacgaacagaaacttctgaaattactttaaatgtgtagttaagcttgtaagtgagtaaggaatgatactagggctcaaaaacaaagcaatccgtttcacttccatttaggatatagaaagctgcaagagaacatcactcttattctaataacagtaggttatccacaaaatccacacagtcrtaacttcttgagcacatcagagttggtcaccaggcagccaagtgagctgaattctcaagagtaacaaacccctcttaggatagatgggacacaggaacattgacttggcagagcataggaggaagaggtgcccaccacataaagtagttagcagtatcagctaagattttaacacatttttaaagggtgaatgtgcrctcgcacagtttatgtgtttaggataacttgtagcttagacacagaggagctttgcatccatttgcaagctcttttccatacgtttccactgtttgatctgtgagaaagactaggggacaaggcaggagattggagagcatctcccttggtgataaaggtgtggtggtgatgagctgttgctgagggacaggagccaactctgcccatttcctgaaaaccttctcctttatgaagcaagagtctaagctgcagagggagaagcagtgaactttcctgcttttacagcccaggtgaagtgccattgctttgatgagtttggtaggagcaaaacccacttgcttctggaagagaggtagaaaaccctcactcctccaggaccatgcaaagatcacttacttctgggagaaaggtgggagcataagccttttgacactaggggctgggtgtggaaggcaggagatgttagaactaggaccctgcactgataaaaagcagaggtctgccaccagtggggatagggcaagaaacttgaccctggcaaaggtccccctcccgcaccccaagatacaaagttataggacaggaacactgaaaaagttacattcctgaggcccaggctcaaagaccccctacctaagatgaggctgcaccaagatatctgagaatactctacatccaccattagcctagtgtgtagtaacaagcaacagttgtctactactagagaagggacaagagtgtggagagagaccgcctgctgaaaactgagggtggagcaggaacactgaggcaaaccctttggcatctgaggctgcacgttaaacaaaaggtaatagtggcccactattggaggtctgaaacctgttgtgctgtgattgccatagcaacaaaaagcctgaaacccagctcaactgctaactagactggttattcaaccccctggacttaacagcctagcagaggtggaatgttcatttctgagcataaatactgttgcccctatcatcactgaatatccagcattcaacatttcaaaatcaaaaatttctgggcacacaaaataggaaaacttaccaaaacataaagcaacaacaggtctagtgtcagagatgacccagatattggaagtattagagaatttaaagtaactgtgatttatatggtaaaaaaaaatccactgaaaaaacaacatgcctggatgtatagggcatttcaacagagagaggatctataaaataatcaaatgaagatgctagaaataggccgggcgtggtggctcacgcctgtaatcccagcactttgggaggctgaggtgggcggatcacctgaggtcaggagtttgagaccagtctgaccarcatggagaaaccycatctctastaaaaatacaaaattagccaggcgtggtggcacatccccgtaatcccagctactcaggaggctgaggcaggagaatcgcttgaacccgggaggcggaggttgcggtgagccgagattgcaccattgcactctagcataggcaacaagagcaaaacactgtctcaaatgaaaaaaaaatgctagaaataaaaaagatgatatctgagatgwcgcatttcttcaatgggcttatcaggagtttgaacatgtctggtgaaagaatcagtgaacttgaaaatagaaactatccaaactgaaacatagagatagaaaagagtgaaaaatgagaacatccaatggctttgagacagcataaaaagagatctaatatatatgcaatcggcatctcagaaagagaaaggagaaatgggaaggaagaattatttaaagaaatactagccaggacaaagcatagatctaagaagaccagaggactcagagcaggataaatgcgtgcgagcgcacacacacacacatacacacacaccctcacccctagacaccgcacgcgcgtgcacacacacacacacacctcctcacccctagacaccgcacgcgcgcgcacacacacacaccctcacccctagacaccgcacgcgcrcacacacacaccctcacccctagacaccgcacgcgcgcacacacacacccccctcacctctagacactgcgcgcgcgcacacacacacactcacccctagacactgcacgcgcacacacacacaccctcacccctagacaccgcacgcgcgcacacacacacccccctcacctctagacactgcgcgcgcgcacacacacacactcacccctagacactgcacgcgcgcgcgcrcacacaccctcacccctagacaccgcacgtgcgcgcgcgcacacacacacacacaccctcacccctagatacctcataaactgctgaaaataaaaaggataatcttggaagtagccagagacaaaggtgacaattgaacaggcttctgatcagaaactatgtagtctagaggacaaaagaatatcatattaaaagtactgaaagtaaaaagcaaaaattaaaaagtcaactgaaatatatacccagttaaaatacctttccaggatgaagacaaagtagctttttagataaacagaaattgagagaattaattatatcaaatctataccacaagaaatggtaaaggaaaatcttttttttttttcttttcttttcttttttttttttttttgagatggagttttgctcttgttgcccaggctggagtgcaatggcacgatctaggctcactgcaacctctgcctcccgggttcaagcgattctcctgcctcagcttcccaaatagtggggaacaggtctgctgccatgcccagctaatttttatgtttttagtagagacagggtttcaccatgttggccaggttggtcttgaactcctgacctcgggtgatctgcccccaaaagtgctgggattacagatgtgagctaccgtgcctggctgtaaaggaaattatttaggtaaaagtaatgtgataccagatggaaattgatttacatgaataaatgagcactggaaatggtaaaaattagggtaaatgtaaaggaaataacaattctacacaaattctttcagaaaatagaggaggaggtaagaacttcctgataaactttcaggcccagcattaccctgatgtatatatactcatgagcgtagatgcaaacacccaaaaaatgagaaatcaaatccaacaatatatcagaaggataataatacattatgactagtcagggtttatctcaggaattcaagattgtttcaaaatttaaaaactagtcagtataaatcttgtcagaaacctaaaaaaggaacaccaccatctaatcatctcagtagatttagaaaaagtatatgacaaaatccaacaactatttctggaaaaaaaaatcttagccaggtgtgatgacacacacctgtaatcccagctattaggaggctgaggctggagaatctcttgagcccaacagttttagtctagtctaggcaagatagtgagaccctgtcttaaaataaaataaggcctggcatggtggctcacgcctgtaatcctagcactttcggaggccgaggcaggtggatcatgaagtcaggagttcgaggccagcctggccaacatggtgaaaccccatccctactaaaaatacaaaaattagccaggygtggtggcaggcatctgtaatcccagctactcaggaagctgaggcaggagaattgcttgaacctgggaggcagagttgcagtgagccgagattgtgccactgtattccagcttgggcagcagagcgagactccatctcataaataaataaataaataaataacctcacaactcagtaaactagaaatagatgggagcttcctctgtgagaaacctacatgttcagttaaaggtgaaagactttttcctaagatcaggaaaaggccaaaagtgtctgctcttaaccacttttgtttaacagtatactggacattctagccagtacagtaaggcaacaaaaagaaaaagcattcacattgcagagaaagaagtaaagctgtcttttttttttctcagataacattatcatatgtaggaacctgcaaaagaaaaatgctggaacttccaagcgagtatagaaaggttatgggatataagatcaatatacaaaaatcagctgtgtttctacaaaccagcaaccaacaattggaaactgaagtttttcttaaactatcaaaatagcattaaaataagtgatacttagagatraatctggtaaatgttacataagatctataaactgmaaactatagaacatttctgagaggaaataatgagagaactaagtgaactgaaatatagatcatattcgtggatcagaagactcaatattgtgaagatgtcagtttgccccagatcaatgcgtatatttaatgcaaaataatcaaaattcaagtaggttaggtttttgtaggaaatgacaaactaattctaagattcgtatgagaatgtaaaggacctagaatagccaaaacaactttgaaaaataggaacaaaattggaggacttrcattacctgatttcaagacataatatatagccacagcagttaatactgtatgattggtgtaaagacagataaagtaatcaatgagacatagagaaagtttaagaaaactcacacctaccccacaaattgtcagtttgtttttgacacggggcaaaggcaattcattatagagaggatagacttttcaacaaatgatgctcaaacagtttgaaaaataaatccataccttgctccatatgcaaaagataaaatagatcatagacctaaatgttaaagactgaaattattaaaacttctagaggaaaccataagagaaaatttttgtgaccttgggttrggtaaaagtttcttacatatgactctagaagcatgatccttagaagaaaaatttgataaattagatctgttcttcagaagacactattaagtgaatgaaaagacaagtcagaatgggagaaaatatttgtaaatcacatagatgacaaaggactgtgttcagaattcataaagaacttctcaaaacacaataataaaacaacccaatttttagaaatatggaaaaatttttaagatgcttcaccaaagaacattggcagatggccagtaaacataagaaaagatgttcaacatcattagtcattaggacaatgtgagtaaatctccaatacacttgttaaaatatctgtactaaaaataacaaaaaacaaacaaacaaaaaaacagcaattgaccatacgaagtattgtggaagactgtagagcaactcaaactcccttacactgttggtgggaatataaaatggtacaacaactttagaaaacaggttctcaaaaatttaaatatacatctactatattactcagctatttaattcctaaggattaagagaaaatgaagcatcttttcatataaagtcttatacatgaatgttcattgcagctttacttgttatagctaaaactggaaacaacccaaatatcagtcaactgttgatggataagtcaattgtggtataaccattcaatgatataatactctttacatattctggttatgtgttgaaatttcttctttgactctgtggcttctcctgatgttttagattttattttgtaaacaacatgattgggttttattttttaatccaatctcacactgtattttaattagaatatttttcccatttacatttaatgtaattgcataggtcatcttacaatttgctttttctttttgccaactgctctatgtttctatttctcttatttattttatttgaattgattaagtagttttattatttcactttccccctcatctattagcttggaagttacagactcttttacttttcttgtgttagtgagcttagacattacaaaaaggacatattatcaaagtcgaatttcattggtatttttacccttttcctagataataatataattattatttaatcctcttctgacttatatgttactgttgttagctattttatttatatatttcaggtctcctagatattgttttatctaaccaatatctatttagatttacccacatagctatcattttttattacctgtagtatttccatttggaatcttttttttttttctgcctgaagaacaccttttagtattcagtacaagtctgctggtaacaaattatctttgtttttgtctgtttgaaaatgtcttccacatgcattttaaatagatgtttttattagcataggattttacactgtatatctgtagatttctagaaatatggaggcatatttatggctttttgactctgtggcttattttctttggccagttttggaaaattctcaggtatctttttacatgtgcctctgcctaatcttctctctctcctccttctaakactccaattttatgtatattagatcttttaatagtatttccatgtcctttatcttcttttctttcttttccatccttttttctgtttgtgattcattggtgttttattctaatacaccttctgtctcactaattcatctgtatctaacctgatttttattttgattattgtatttatctagtctagaatttccatttagctttttaaaatctgccattttttatatcttagagaattctctgttgaaatcctcaattgtatcttttatcctcttgaaccatgtatgtatcatatagcactagtatctggagctccttttggcatgtttatattttgtattgtttctgcttattatcttatctccttatatatgtkgatattattgattatgtgcttggtcttgtatttgacaaattatttgtagaaatagtttgaggcctargatgatatctttctcatggaaggaatatattttcttctggcagacacctaactgcactagcaatagagtcttacttaacctgatttcaggtactggatgatttgaagctgggctgtcctcccctgcaaaggacagtctattcaggactgcccttattccctactgcagaggggcttaccagggactctgcaaggctgtcagagaagtcacttaggctctcagtccctcaagaccctcttctagaatcagcaaataccccccaggcccaaagcaggccccaaattacatgctcacttttctggatatttgttgtctcttagatcttggaagggtaattttttactaccctgttagtttccataggcctgtatgcagatgatttttatgttttgttcagctttaaaaattatccttgccaagagggttgattagagttacctagtctgcctttattgaaagaggaagttccctttcctgttattattccttcttgatttaatcttagaatgagattaaccccaacatttctatttatatacctgcataggttctctgtgcacatatatccctctaccataccctgtcaccatctccacatccacacagatcaactgattgttttctaacaatacgttagaagtaatcaagaacctaaaattaaatattttgccaaaacccttgtgatatatgtccttaatttacacttctagttcttaagcttccttattttgttggtatgacattacatgtatgaagagaartaattagatgaagggcaagataaggggagataggaaagcaaacattcccagcattgagaaggaaagagaagcatgcagattgaatktagattcaaagaactgagagaaaatcagtgtgcctagagcataaagcaaaaggagttgccgagacagtgaaaaagcccaaattatgcagatccttaggtgcattatgcaagagaatattcaaattatagttttaaatgctttgaaatctcatgctgactgtaaagtcgaaaatgaatcagaagagagtgatgtaggatggaatggaagggatgtagtgggtgaggatcacttggaatctgttacccttacctgagcaaaccttcaaagtagcttggactatggtggaagtagcctggttggagaggtggatggattaaagaaatagacaacaaagcaaaaccaggactatatgagcaataaaaaaccaatagtatcaacgataactcctgaaatcctggtttgtaaaccaggtgggtaacagtggcacacactaagataggagactagagaaagcccacattaggacaagagactggaggaggcccaggtgttacaggaaatactgtgagctcaattttggacttgttacctttgagatacctttgagacatccgaagtagagtttgcagagagttgtatatacggatgtgatactctgaacaggtctgccaataaaaaagtaaaatttatacagattacatttaaagtcgttggtgtggaggagattgtctacagagaaaatgaagaccaaaagtggagaactgctattggaaacataattttacaccaagaaaataaggaagcttaagaactagaagtgtaaattaaggacatatatcacaagggttttggcaaaatatttaattttaggttcttgattacttctaacgtattgttagaaaacaatcagttgatctgtgtggatgtggagatggtgaacagggtatggtagaggggtatgtgtgcacagagaacctatgcaggtatataaatagaaatgttggggttaatctcattctaagattaaatcaagaaggaataataacaggaaagggaacttcctctttcaataaaggcagacgaggtaactctaatcaactctcttggcaaggataatttttaaagctgaacaaaacataaaaatcatctgcatacaggcctatggaaactaacagggtagtaaaaaattacccttccaagatctaagagacaacaaatatccagaaaagtgagcatgtaatttggggcctgctttgggcctgggggtgtttgctgattctagaagagggtcttgagggactgagagcctaagtgacttctctgacagccttgcggagtccctgataagcccctctgcagtaggaataagggcagtcctgaatagactgtcctttgcaggggaggacagcccagcttcaaatcatccagtacctgaaatcaggttaagtaagactctactgccagtgcagttaggtgtctgtacattgttagtcctgctcattgctgggtctctaggtctctagcacctagcagcacagtgccttgaacataattgagcatttgagtgagtgtatatagtcaacaggaatcactgaaaggtagagatccttatctttgacttctttccagtttcccagaatacgtagtatgatgctgggacttgaatgaaattaaaatgatattatcttcagaattagattttctttgggctacttttgagagagattaggatagaaggtgaaagtattatgactgacttgggagaaaaaaagccctgtttcctctttcttatagatatttgctagactttccatggctgcttttttttctaagagaactgtgtataatttttggaaaaaaatattgaattaattaaatattgctatagtgaatcattcagaaggaatggttctttatcattcacatccattaacaagattatttctttgaaaagcacatcctttctttgcaaagttttgaattgctgcttatttacattttaagcctaaattatgaaattcctgtgattctaatttattacgtttaaaaatgacttagcagagtactgcagctggaaggctcagttgcaaaactatggtctttaaattgatttgtttgttttgatgttcttatgatttgcatggcagcatattttattgtatatttacaatagtcatatgatacttgtatttcctttatggaaagagttcttaaggatatttttatgtgtacctcctcatgaatcttgctaatcactgaaatacagacttaggaatggtaaaacatatctccctttgttatttctgtttattgtcttcacttcatttttccctctcagattttgattttcagtgatctcatctagtcctttacaccctttattttagtggtggaatgtggcaatcagggatagggaaaatgatgaggtataatcattaaaggtatcttagaacctggcatatttcaattattcatatttaacctatttgaaagtcttttataaatatcatgattttataatgaagagggctattacactattatgttaattactaaaacctcccacatttatgatctttaatagcccagatattttatatgtccctgatcttcagtgttttaatatagaagtccctattatttaatttcaaaataatcaatgctatctctaaaaatacacagatattttgtaattttagagttcctttaccttttactagcaytattcatgataaatatatttttcagttttattcaataagattcttttcagaatttgtgaaacttaaacacttgctcttttggagtaagccaatgatttatttaatgcttttctatattgtgtattttaaggagaaatatcttcctgatggatataatacaggcttgttggagacagctatttccctctctgcaaggagtgtattatgttgttttacaaaatgctttcttgcaccactcatgttaactaaagagcgaatttaaacacagacgtgtctactgcactttccttccttgaatgggtacagtttttaaaacttggaaacgtgccattaactcttaatgtctcatttcatttttgaggaattcaagttgggatgccagccgtacaatagtaatgtaagaggaatggtaactggcttaaggcatgcacttaagcaatagaggaatttacttttcagtgtcttccaaggtccatgaggatgcacacttatttatccagagagtatggatctcacatatgtttgtccagagggtgtgactctgtggaggagaacacttactggtaagtattgaactcttattgtattatgtttcagaaaaatatgtttagaaaatcagttgatttttagcagtgatgaamtctcttagtctgtgctggtttcttaacagtggacagtcccagatgttgaagtcagcacaacaagagaaaaacccaaatcctgataagacttgaggatttttcgaaaattaaatgcaaaatagttggggcaaatgttgctgcgggagtcaagactaagtaatacagtaagaagatatgaagttggagagcttctcatgttcttcctttgtataaagtttgcatacgtacaaaacccaggactttaatgactttaagagggggcagaattgcatctyttggaagttaacagactcatgtgaactggaatgtacgttgtggccctcacaattgattttaatatttatttgcaaagtcctttctgtttctaaataaaagctgtgccttctgaaacctgtaagtgatgtatactggccacatcaaatcttttaaaagtgttttccaaaccccaaattgttagtgtggaagaaatgtttcttttgggaacactaaaacaaaggggtatgggaggattgatttcagagaccacttgctgcttctgctttatactttaacattctttccctctttctctcagccaagaactctcatgatatgtaactgacttttggttgaaaaaacatgtaaaataatgtttttgtgtatgatacaaaagtttagaataaaacaaaaatcagccactctaatatgtggtaggttttctggcaattaaccatagcacatagacatttgccacaggaaatgccactgccagatctcccacaccgccacatgaaggcttagcattgctttaagtcatgccttaataaatgatgaatggaagtgcagagtccgtgaggaagaattcagtgcataggagtgttttggcatctggtagacaattgtttgttagagttgccagttattagcttgctggcctttatcaaagtgctttactattctgtttcttctgctgtagaaatccctgtgttatcccctattgtgatgactgacagtgtcccactgtgctgaatcaagaagactgggtatataggtccaaatcatggttatggagatgttagggtagaagacagcagtatggacatgatagaaagaggattgagaatacatttctrtgtgatccatttttgctttgccttctatctaattctgccaattcctaatctttaggactcacctcaaaatctcttgaagccactttttgggagatgtgcaaaatgtgtgtgaagggagagagcatcaagagcagaaagcgtaggtgagagggtaagagacatttagtcacccggcagctgcttactgaatgcctgctgtgtgctaggaggtggggacacatgaagcttgtgtccagttttgaaagataggccataaacaaataaatatgttgtgtattggatgatggtaatgaataaactggtaaaggggggtagtgagaactgggataaggaggtgactttcagctcgaagtagggtcatcagggaaggcctcattgacaaggtggtatttgagtagaggcttgaaagaggtaggggagccagccatatggaaatccaggaaaagtggaactgagaacacatactgtaagtcattaaaaggactttgacatttcctttgagtgagatggaagcccattggagagttttgagcagaaaagtgacattatctgacttatttcttaaaataattcctcaggctacagtatagagaatggatagtagaggaacagtgatggaatcagggactggttaaaggttttttgagtaattgaggctggagaagatggtgacttggactagggtggcaacaggagaggtgattagtgttcagattctggatttgttttgaaggtagacccttcaggatttattggtcttttgactgtggggagtgagggaatgagaggagttaaggatgaccccrcagtttttgggctgagcagctggaatggcagagatgacatttactatttatcaggatgaggaagattacaggaggagcaggttttagggagagatcagtgaaggtgcgagcaactgagattccaactagatatccaaaggtaacatagacagaagacagtggatatacaatagtaattatttaaacgttcattttgcacaagttgataaatcacaaaagttctgtttaaatgatttaaatcttcatgaagatgttgctataattcacattttatagattaggaaataatgcagaaggattaatattcctaagaycactgatatgaaactattttatgactaagttccaggttgttctactgactttattatattataaaataggcatataagggarattttcattattgccataattgagcaagtaatacttcttgttgcctttacatyacacacacaaacacacacactttctctctctatctctctctctcatagagaagtacagtaatatctttgaggcttacgtagaaagatagtttttttgaccctttggtgtgttgaaaacatactataatataggctttaattttggatatgcattttaaaattctttaaatggtgaatggagatgactatgaatataattaatttttaaaagcatattcttaagaaattttcttttgaaaacagtttacttcatggtaatttgtgttctcttcagttgtttaaaggggaaatattttgcatactcttaagtgtattcttttttatagtagaatgtatgatgtttattttttgaaacacaaatacaaataatggaaacacatgtgattgtctgagctttgacattgttctaggtaggatgacaaactgtcacaatccaaacaggaaaacagaaattaaaacctctctaaagtttctactctgttgcttaaaggtttatgyactgtttataatttttattcaataaagcgrtggcaagttactttatcttataaaatcctaagacacttaaattttatgtagtgtaatgagttaaatgatcaggagcagattaatatagttctctgaaataagtacatatccttaaaggtcatatgtcttaattttgtggaatatgactatttagtttctacaaccttggatttttaaaaattataatttgtgatctctcatctatgtaaatagcaaactctttctgattatacaggaagccctgcatgttgcaggagtggaaatgcagttaacggctgcgatgtcatttctgaccattctgcaggacgaatcagtgtcaattcatgcatatacccactcattcctccaagtcattctcctgcatctggagcacagggacacaggtcaggggcctggcatgcttaattatatacttgtttattgtttttttgtgtatggccatgatattatataaatactgttagcctgatgaggataactgagtaaggccatgctgcctakgagttgagcagtggaatgacttaaaatagctatggctgtcttataaaacccacaaaatttaatatccttgaaagctgaagatccattaattcatcttatgatttatactttcttgttactttttttccttttctagcagtcatgtttatagtattgtacaataaaagagcaaaccttggtttaaagatatctcaccaatactatttttaaaaatataaaaattttctagatgttgactgagacaaaataatagagaaactttttagaatagtaatgaaaataattatttccattttatcattaagtgctattgtaactattaatggctgagttgaaactgaatttgaagtgagacgtttaatttagtatgttttatctctgtcaaccaggtgtcagcaatgcatggctggaaactcttctgtctgttatagaagtattgccaaaagaaaccctacggcatgaggtaatactttcatgggggcaaatactaataagtaagtcactctaaggtttttttttaaaaggtttcttgtcaaaaatggtttttaaaaaagaaagttgtttttcattttgaatgtaacacgtgcacattggaggaaatttgagaaatataaaatatagaaggaagaaaaaagaattcatagctctgtacttgtccacttttaaggtcctgatgtatttcctttcagatttttttcctatatatggttgctgcttggcttgctatatcagtgatcatactgaatttatatatggttgtttttcacttagcattactttcctatattttttaaactcatttgatagtagctgcagaatattttacttgtgaaacatttaagcctgttttcaggcttatattttactattgaataggacattaatgagcatttctgtagagctcttcctgtttttcagataatttaattgtagctttcaaacaggaattaatggatcagagggcattaatattcttaagcttttgactaacaatatgtgaagatgctcttttcctagacttttatcagcaatagtgtttctgttacatttaatgggccaaaaatggaattacattttattggaatttttaaattattgtgctgttgaatattttctcatatttatatcagtttctctttattcctttgcaattgtttgatcctatcctttaatcactatttatatgtgctatttacctattatggttgccaattctttgttatatttacaaatattattcccagcatgttgtttgcctattaattttcaacattgaacagcatactcttctctaaagactttaaataaattacaatgacagaagaagaaaaatggaaagaaaagtatccactaatgaaaagattttgtattctttgaacattattcctatatacatttctttccaaatatgtcatgattgaaaaaaagagtcatcagccaatgaaatgtcctctactgacttcattaagtgtctttgtcctttctttgtcttcatacagtttatggtcctgtcacaaygcttaaatactggcttgaaaatgggaagattttctagttataaggatgtttgcatacttgatgccaaacatctagatgattatgcatatttaagtgctgaatgtaatatagacatgtgatttttatatttttttgaaaagcaatatgctgtataatgcaatttttactctagaataccatattatttaacatgtrgtttcaaagattttagatatgtaatttattctaaacttttcacttctaaattatcaatgcatattcagtaattccagctactttgagaggaaacaagccagttgactatagagtcatagaattttagaaattaaagagatcttagtaggacatattyttgtttccattttaaatagatgagaaactggagattagaaatagcgagattatgggctgggcgcggtggctcacacctgtaatcccagccctgtgggaggctgaggcgggcggatcatgaggtcaggagattgagaccgtcctggctaacacggtgaaaccccgtctctactaaaaatacaaaaaattagctgggcgtggtggcaggcgcstgtagtcccagctactcgggaggctgaggcaagagaatggcgtgaacccgggaggtggagcttgcagtgagccgagatcgcgccactgcactccagcctgggcgacagagcgagactccgtctcaaaaaaaaaaaaagagaaatagcgagattatttggacaaactagagaactgggactagaatcagagtctgatcttcatagtgttttatggtctgtcaggctgttgtagtatttgagtgtccagtatatacataatgcaatatcagacttggcttattgtactcaaatgacagaattatttaataggatttatttgaagctataatgtttttcatcccattaggatacatataaaaattaatctatatggaataaaaatacatttcaaggtatttagtcattatttgctcttttctttttaaaatatgtatttcaaaattctacttttatctgtgcatacagagcattgtaaaatcaccataaactttacttcagttttttcctaattgttttaattgcataatttgtaattatctttaccttaataactcagaagacaaataagataatccaagttattgagtcatgaacctcaaatcgtaattcaggttctttaaaaacatttagaactttaaaatactctgaaggaatagctgacatgagtggcatgaatgtataaaattttgtgaatttttttctctaaattttctctttagattttgaatccacttgtttccaaggcacaactttcccaaacagtccagtctcgtttagttagttgtaaaattttaggaaaattgaccaacaaatttgatgcccacacgtgagtatttgtatgtaattttcggtctactttattacattsgtttaaaatgtataatgactgtgtaacaatatatttgtgttatttcatactgcatacaaatttagttatcttaactrttttaactttatggaattctcatgacgaatttacttattcagatgccttycttttcaatctcataacttttcagaattggtaaggttaacttttttcctacttcctatcttaatcttccctatctcataccaaatatagttttgaggataaaatagcgttatcttattgactttcaaaattggcagcggcataaagatagaattgctgcttttttacactgttgttatgaatttgttattttgaataatttaacttattgtgaggttttatggagcatgtttataattcatgtgctacttcttgcctgcttattaaataccaaatgaaaagaatggaatgttttataattatgatacaagagtaaagctgaagartattttggttgatggttgctagactcagatattctactgctacagccttttatcttagctatagacatttcaactgccaatccaaaattaaccattattttaaaaagactgtgtgatatacataatttacaagtagctaataacatccaaatttaataacatgtaaaataccttgtaaactattattttttttctattaaagtacrtttgttattattaaggtgagttaagattttaatgataattgyttgggaatattattctgaaacactcattcatttgcatgtttcttttctccccaccttcagcattaagcgagaaatacttcctctggtaaaatcactctgtcaagatgtagaatatgaagttcgatcttgtatgtgtcggcaattagaaaatatagcccagggcattgggtaggtatactttgaattccttatgccatttccatgaaaacatgccattgaaaggctgtatttgatctttaaaaatgatcataacaagtamctcctctatgtctggattaaaagagataaagaggaatgtgcttagcatggtggtaggcgtttgattaatgttaatttctttttttctcaccttagttgcttagttatcattccagacacctagattcaggaaagaaaagatagcccaatataaaccatacttggaatatgtttgactggctattctttgactatattattgggtcatttcagatgggattgcagttgtccctccatatccttgggaacttggttccaggacctcttttggataccaaaatctgaggatgctcaagtctctgatataaaagagtgtagtatttccatatgacttgcttatatccttccacatgtttaaaatcatctctagatgctaatagtacctaatacaatataaatgctatgtaaatagttatgctgtattgttcaggaaatawtgacaagaaaaaagtctgtacatgttcagtaaagaagaaatttttttctgaatattttctattcatggttggttaaatccacagatgtggaacctgcagatgttgagggccgactacackctaatggaagcctttctatagctcctgtgcaacttcaggcttccaatgtttgttttgttgctctccttgktctttttttttttttttttttttttttttttgagagggagtctcactctgtcacccaggctggagtgcagtggcgcgatctcggctcactgcaagctccgcctcccaggttcatgccattctcctgcctcagcctcccaagtagctgggactacaggtgcccaccaccacgcccrgctaattttttgtatttttagtagagacggggtttcaccgtgttagccaggatggtctcgatctcctgacctcgtgatccgcctgcctcggcctcccaaagtgctgggattacaggtgtgagccaccgcgcccagctgttgctccccttgttctatgggtgcctgaagctccaggagaggcatagcagccaatctcttcacccataagaactgatctcatttcaatcttagaagtgtgatattaaagggagtcttacctaaaaaccatcttgggaaatcttttcttttaaaaacaagattcaaaattggtacaaaaatcaytggaacctctcatttttagcagaagttgcactgatttcatctggttctttgttgcacaagctaggacaatcagattgtggtcattggtacctttgttaattttttaaaaatctgggccaatatttaaggctccgaaaaggcttttgaatgtcacacagggtatggtagagtgtcacacagggtatggtggaatgtcacacagggtatggtagtgtactctgtcctgtgtccactgttgctaaatagtatttaagtgtcgtgttggaagtttaacacaattaatgaaagagttatctgttatgattattttcttttttaatgcccagagataattaagttgaatttgcatcactgtcacatgtttttgaaaaaaagagaactctgtttaaagattgaatggaaataacttttactatagagatgaaattatttttcttaaactattttctttcattgttaataaattcaaggatttcagtaggtatacaaatatattctgagcaaaatttatatgaaataaatttttatgaactttggatttgttctatcacattttactcttctacctcctctgtctatatcctgtatttgctgaatgtttgtgaagtactggtaatgttaacatctctatctgtatgatctagatcaatctcttagaaaaacatgtttttttgtggctcttcaattgcttaagtccttgtcattgtggtatgctgcctaatatggtagcccctagtcacatgtggctattttagtttaaaataaggaaaattaaagaaaattagagctttagttcctcattcataataaacttattttaaaaaatgctcaatagtaccctactgaagagtacaaatgataaacatttccatcattggagaaagttctacttgacagcattgtcttagagtctttgagatttgcgctgaaatttttaaaagttttctacaactcttaataactttcttggactctatcaacatcttatgtcaattataattgatgctgttttccatcttgtacccaagaaagctaaccacatcacaaggctctccttgatcagagtgtttgtcattacagtgacaccttatcatgaggaataagcagaaacaaaatgttgaatacaaactatttgtgattgtattataaatattgtatactccctaaaagtatttatattatgtttcattctgctaggtaggacacctagagtgatatatcatcttctatatagaaattagttaccataatttcatgtattaggtgaatggaaaataatttataccctgaaatctagatagaaatatattatttaggtttctgcagttactactgataagtttttctaattagtccagatttttgctgaagttgcttaaaatggaaaactatattataatttataaagtttgatataaactcttagttattaagatttctgtaggtaacaatattatgctggaggaagtgggattgattgaaatcattatgaaattactattaatgtttcttatatgtatggtgtgctttcccaataagactgaaagcttctggagagcaggaacagtatctttatgatttttcatattttctgcagcaactagcccmgtcactggtttttagtaagttcctgctacacatttattgatttgatttattttcttctattgcttattgtgcaggacagaacttacaaaaagtgtggtgctccctgaattaatagaactttctagggatgaaggcagcagtgtacgacttgcagcttttgaaactttggttaatctgcttgatatatttgatacaggtaaatcatgtggctacatctttgcttctgaaaacagtgtttttctacatgttttatgtcactaataaggaataaaagtagatttagaatttcctatgttaagcctcccttcctctccctctttttatgattcattctgttttcgtgtcttcttggctttcacttttaccctcatggtgtcgtagtccattttgtgttgctgtaacagaatacctgagaccaggtaatttataaaggaatttattttggcccacatttctagaggctgggaagttcaagatcaggcagccccatctgacctgtttctgatgagggcctcatgccacctcgtaatctggcagagaagtggaaggtgaagcaggcctgcaaaagggagagggaacaaaagaagctgactttgtaacaacctgctctccagagaactaacccagtcccacgagagctaacccagtcacttgtgaaggagatctcaataccacaggaacttcaccagtcaacccacgagggtggagccagtgggtggacccatgcggccccacctcttaaagatttcaccttccagtattgctgcactggggccaagccttgacaggcattttgatggagacaaaccatattaaaaccagtaccctatggcatacagtgttgctacatattccatctctcttttctcycatcaaaacttaactgacttgtgtgtgtatagggctaagaatttgactttaactttttcacctaattgacattaagacagatcctgagacattgtctacatgagtttcctctccttaataatattttaatgctagagatctcatggccattgggggagaaatttgggatggggtatttgagtgggagagggtaaagagatattccttagtgttatgtaaatcatgtcacaaagacagttaactgctctactgaatgtatggctagactcttgactaatgctggatattagttatcagtaaacattaactattttgataaagagaaatttggaggagtaaatgtcaagtacttaggtacagaattcaatcgtataattatagtattacatttacttggattaccaacattttatctgaactctaggaagcctcttaaagattattgcaatatggacaataattgtgtttggaaattccagaacagtcatttagacaatatgacaaaccagaggagtaaaactgcagtacatgataagtgaatgaataaatcttttttcctctaataatggggcatccccaggctccaaactagaaccttgccatcatctttgatcttttctcttttactgcccacacccatttatcacagagctgggcctaacctgtgtttgtggctttatttcctaccattctttcccactcctcttgtgtctgatgctccagtcccacttccttagcataccagattctttcacacctctagtcttctctcatactttttctttctctattgtttccttccctctatttttgtcctagccaactccttctgcttcttttttttttttattattatagtttaagttctagggtacatgggcacgacgtgcaggtttgttacatatgtatacatgtgccatgttggtgtgctgcacccattaactcgtcatttacattaggtatatctcctaatgctatccctcccccctccccccaccccacgacaggccccggtgttcgatgttccccaccctgtgtccaagtgttctcattgttcaattcccacctatgagtgagaacttgcggtgtttggtttttttgtccttgcaatagtttgctgagaatgatccttctgcttctttagttcccagtttaaatacagtttcctccctgacatctttctaaatcctttacaccaggggttggcaaactatggcccttagaccaaatctggcccaccgcctgtttttgtgaataaagtttattgggacagagccacacttatttgttcacatattgtctgtggctgtttttgtgatgcaagaacagagctgagtagttgagacagagcctgcaaagcctagaatatttacaaaaaaagtttatagatccctgccttataccagctattaagacagtgatcacattgtcttatattttttgtgtttggcttttttgctggtttacatttctcaaaatcagagaccatttattattcatatttctacttctacttagttacaaggcttgttctgtaagaaatacagtgtgttgaatgaatgtcatttaacaaaaatagtagatatggcaccgaaatgtaatgataatagtaataataatactcataagcctgttatagcattttatttagtatttctagataataaagaagtgattcatttctgaaatttaagaaaactgtgagaaatttggagagcatttagaattgagacttaaaaatcaccagtatgtcagatacttatgacctaagcagatgtactcaaataattgattaattttttaaagaagagccatctaagaagtaaaagtgatgaaattcaatacatagaacatattataagctaatgtaattttagtaawaaatgaaatgataaaatgggcttaagctgtagcatggtatgagatgtgtgtaaaagagaataagaaaagtttcctttgcttactrtttatctatttatgttaatggtgttagaattcttttagttattcaggctcaaatcctcaatcatcttagctttttaattcataatcactctttatattctgttcccaatggcctgcagtatgaagtccaaaccccttaacctgacattaaagtttttgatcatttcaagcctcctcttacccctttttcaccacccacctccatcgttgttgctttcaggtattttctattactatgaggctaacatagtaatttttctttctggaatttgtgtgtgtattagtttccacatgtgcaatgtggacgactgaatttaaagtatgtattattttgttttgttttccagatgacagaagtcaaactatacttcccttagtgaaatcattttgtgaaaaatctttcaaagcagatgaatcaattcttatttctttatctttccatttaggaaaactatgtcatggactatatggtatgatatatcctaagaattttgagactgtagataatttttcccttttttttctacctcagtcattaaactttggctcttcagttaattgtaaagcctaactcttaagtatataaaaatcttatgagatcttagaattttgatagcatcatttagagcacatttaggaatgactttttcaccaatagaacctatttgaaagaacagtgacagaatgaagtaagcatagctctttaaatctctgaatattttataattatgtattatttggtatgtgataatagaagctcaggcttattaactatttgtacgtagtaagtatacacttattaaccatttattgaataatttattatatcattagagaagttcagcttgggatgtagaataatgccataactcttggcattttgaacacatagttcttagctttccgtatcgatgtgagatagactgtttaataatgaactcgtaacaatatattatgagtttctagctccttgagatagttaatgaagtggaaccattccattgattaaaaatattttgaatttatttgctgtctttcagattcaatttttaagctccttccctgcagagacacatacacacatgcatgtgtcttttctgtcagcaattttagaacatttactataatagcagatgtataaatagccacaatgttactattagtgactttttagtggcctacaatatgatacatgctgcagcaattaatgcagctacagttcctgcgttatgtaagttatacttttgaaattaaaatattactggtattaacatgaggtaaaataatgtgatctgttagattcctaacagatactcttttcatgttccttttatttataaagtatctgtaaccatttatttaagtatttggctccaattatatttttattgtactttgattttccctttttaaattttgttttcaattgaaatgttgagctagttttttatatttgttttaggaattttcactccagatcagcacttgagatttttggaattttataagaaactttgtacattgggtttgcaacaagaaaatggacacaatgaaaaccagattccaccccaaatcctagagcaggagaagaaatatatttcagtacggaagaactgtgcttataactttccggtaataaatatgtatttatatttactgaggatttttattataactttaaaatatgtgcatagatggcattcaaaatattgccatttttgacacttgctgcttgcattatgtctagcatacatagtatgtgcagagtaaatatttgtgaaatttatatctctacgtataaatcagaataatagacacatatttggatcttycaaatatgatttttagttaaattacaattcagagaacatgatttcaatttaagtgaaacgattataatattaggtattgatgcatgtttttctttccttcccactcatctcctcccttccacctccaccaggccatgattgtttttgttgatcctaaaaacttccacatggaactctattctacattcttctgcctttgccatgaccctgaagtaccagtcagatacactattgctatttgcttttatgaagtaagtctgaagacttgatatcrctttacgtttgttgttaattctacctatgtatactagatgattttgtgcttatagattataagatatagactggatatctctttcatgttctagtcttaaatcttgtttaaaaatttccttaattttcttcttttttagtatgtttactgaatcatttccataaatacattatatttgtgtattcttttwttaacccattcattcagcatatctataccaagtgtttaaaccagacattgtggtagatatgggtgatgcggattttaaagtaaaatcagtttttatatgctttataatatttacagttaactttgcacctaaacttaagcacttgagaaccaatagaaaattgagacacattaattatttttactacaaatggatggtgtttcgtgagcatggcttttagattctgctattatgactataaagtaagagcaaaaataaattgaaacttttatgatgaatttaactttttaacccttgaagttgaaatttggggcatgtttcttgaatgacagcaagaagtgcacgtatgccgtggttgcaataaatacggataagctataactttcaacttcaaaactgacacataaaagcctctggataagtggtacaagttcttattctcagtgagaatatttcacccccttccttgcactgtgttcctatgtcagagcactttgatgatctgcaagtgtgcaggatatccatccatagcatcattattaatgttgcttagatttttttttggctattgggtgatagttttgcttttttaaaagaacgctttttctggtatgaaaatatatatgcattatacaaaatcctggacatcttctctttaaattaatttcagtgctgcacaattatatcatctttgtaaaacacacctgtagaactctgctttcggaggagcggggatagggcagaaagcactggccagctgagcagaatattcacctccaagatgcattaaatggtcacttaggcttggttaccatgtccacatgtacttgttagatcagtggtctccagagagggttgtacaagtttggagtctgagaatgcagtatttatgcaattttagactttctatttttttctcatcagtttaatatttaattttatttatgttttatagtagacataacatagcaccatataattaaacatatggaaatgtacatgtgtatacaaatatgtttcactggtggaagtgagtttgataatcattgatctatatttgctgggtggctagtttccatattctaccacaatcataccatgtaggtagggtaagaatgatgtgcctctccataaaatgaggggctagtgtaaattttttttttttttaaagtaatgaaaatccactggtggatttaaatttttctaacagtgtcaatgctagagtctgataattgcttttgtattctttgttctcatttttcagaataataacactttggaaatatttttgacaagtcaaaaacaaccctgttagagcaaagaattttaaaacactttctttatccagggaccattttttttttcaaataaaactttattcaagyccagtgtgttttagaaagaataaggtgaaatagaaactggtaaattcaccattgtgggctccgagtttataaggaggagacaaaaaaactactgtctacaaggggaactgtattattctggactctcccaactcctctcatgctggttaaagtctttgatggggaaaagtaaagttggtttgctttcttaggagttataactaccccgacatcactgtaggccttcagtagaagttaccctttgggaagttctgaactggtatgaacacttgtatgcctaggatatcctttaagaccctgttggctcctctaagactttaaaatgtgaactagaggcccctgtgggcttgttattgctgttgatgtgaaagtaatgactctggtaaatcccattcttttgtatttcctcaccccatgtgtgtctgcacattccagcatgtcacgaggcagactagaaagctggttatttgtgccactaatttttatagaatctaattttatatttgtgttataacatggctttattttagaagaaawatataacaaggatgtatttttaaaaattattattgtaacctgtatctgtctagtactctcaaatctgagagactttattgctatattttaggtatctaagcttctgaattctggagtatatttaatacataaagaactaataacattattacaagatgaatcactggaggtaatattttcttactctttgatttttaattcttttatgtttggtccaaatataccaatgccttttctccccttcttcttggaatcgtgtcaactctttcagctgactagccccagaagcttcaaattgttgtaccactatatcataaataggatattgggaagatagtttaaaaaataaggttttaaaatatattcagttttaaaacttagtatatgtatatttgtttattaagaaaaatttaggaagtgccaaaaaacagacaaaagaatgcctttaatttcaattactgttactatttgttttctttttcttttttatatgaatattcttttctatataaaggtttttattttactcaattgtaatcatatatcacattttataacttgtttctcttgccattgtgtagtattttaccacttaatatgtacttatgaagactttgaaatactttattttgatgctatatttagatattcctttcacctaaatgactgttagtttgccaaagcgcagctcatgaatattttgatatcactgagaatattatccaatttaaacaacgtttcgaaagtttggaggcagtttttgaacatgttagttttgtagaagtagctgtctcagatttagactatttggacaatgtcaagaggcaggtacactaatctctttttgaaggttggccaaggcagttgatcatgtttctaagacttttcagcaagaagatggcagagtaagaaaatacaaatcctcaaaatgttatttgggggaaaaaaaaaaaccactactactatatagaaattgacatgtagaattaatctagcaaaaacatagtaatcactataacagtaatcaatatctctgttaaaaggtactagatgctcttatagatcatcttccagaaatcttggaacttatgtctactggtggagaaagcagtgttcaagaaaataaggtaaacttcatctttcagaaacattctgagttgtgtaaatattatcctactctacagggtgttttgaggcatcaatgaaagaatgtttggaaaacttgtaaaatagtgcatgccacatagcaggtggtcagtaaaagcctattagagtttgaacagcttgaatttcctctatctttcttacattaataattttaaattaccatgattgttgtctattgtctttggagtttatgttcatattttcatttttcattagcattaatgattattccaagaatagcaaataggacaaaagggtagaaatttattctttattattattttttaagcctctgtgtaacctaagaaaagggtaggatttaggaggtcaaagcttattgacagtaataatatgtaatacattttactgtagttggaagagttgctrtgataatctgacaggaagaagaatgagttgtagtttttatttcaaaatttggttcccaggaatcatactttttacttaatgatttcttttaaaagtgtttgatttaaccagataattatctccttgtgacaactaagatgtctcctaaactctgaaatgagaaggagtattctcttccccaatgtgttataagactgagtaattttactgagtgctgcaatttatttataattgattttttgatgcgtttcattttcagttatcttctctgcctgacttgattccagcactcacagctgctgaacagcgagctgcagcctctttaaaatggagaactcatgagaagctacttcagaaatatgcctgcctgccacatgtcatatcaagcgatcagatttattaccgtttcttacaaagaatgttcacaatcatgatgacaaatgtgagctcagtacctttcatcttattcttttgaactcatggttggttctggaattaccaaaactcttcatattttcaaaatagtagaacaaactcagttcattccattctacctaggaggatgtcagcttcgtaggtccagaagaggggactcaggtttccctttgcctccccactaggtctccctctgagaatcttctctctagctggagagaggaacgactaggtggcactttcacctaccctttgtttatatactgccaagaacagagtagactcacttcaaacttgaaatagttcttcttaagaggaaggttgacaggactcagtgaccttgactgcaaaggaccttcttctgttctgatgtgcacctctgatgcatccacaaccttagtgtttgaccccagctatgctgttttgccaaggcaccccttaagcttcctactataagtttggttacttttagagtgtggcaatggaacagagaaagcttatacaaatacatggatgccctrctattgataaccttataattagtgttaaaagaaaaagactcctccctcaaaacaaggtggcactcaagcctccccacaaagttaattgtctacttttttcacagaaatttccaaggggattatttaactcataattcactgtacatttaacatgacatcctattgcaattttttgaaatatagaaacattccatggctctgtgatctcggcacagaaggcttgggacaagcccaactggtcaggcctgcctctggggcagatgctgagttggggtagtgcaagctgggtgggccccacactcatctgctgggctgaaaaccctgggctgcatgtgcctacctggttgtataccagttgtaccactgccctgcccagggatctcccatctttgacccactgcactgccagactaccagcagacataccttgcaagctcctctgagctggaatcaatcctactgaaactattcaaaaaattgaggaggaagtgttcctgtttaactcattctacaaagccaccatcaccctgataccaaaatctggmaaagacacaagaaaagaaaactgcaagtcagtattcctgacgaacatcaacataaaaatcctcaagaaaatactagcaaaccaaatccagtagcacatcaaaaagttaattcaccacaatcaagtgggcttcattcctgcaatgtgaggttagttcaacataagcaaatcaataaatgttatttgccacataaacaggattaaaagcaaaaattacatgatcatctcaatggatgcagaaaaggcttttgataaagtccagtgtctctttgtgttaaaaaccctcagcaaactaggcattgaaggaacatacctcaaaataataatagctgtctatgacaaacccactgccaacatcaaactgattgggcaaaagctggaagccatccccttgagaaytggaacaagacaaggatgcccactcataccactcctattaaacatagtactagaagtcctaggcagagcaatcaggcaaaagaaagaaattgaaggcatccarataggaaaagaggaagtcaaatgatctctctttgctgatgatatgattctatacctagaaaaccctaaggatcttgtcagaaggctcctagacctgataaaccactgcagtaaagtttcaggttgcaaaaccagtgtacaaaaatcagtagcatttctatacaccaataatgttcaagctgagagccaaatcaagaatgcaatcccaattttaatagccacaaaaaaaatatccagtaacacatctaaccaaggaggcgaaagagctctgcaaggggagctataaaacactgctgaaagaaatcatagatgacataaacaaatggaaaaacattccttactcatggattagaagaattaatattgttaaaatgaccatattgcccaaagcaatctacagattcaacacattcctatcaaactaccaatgtcatttttcacagaattaaaaaaattattttaaaattactcttgaatagccagcgcaatcttcagctgctatttcagccctctgtttacccagtgtcctatcagccttttacctgttagttgtagaatccattgatgatccttgcttgaattggtgatttcattataacttgaaaaataattttaaaattccatcatttatgcatttttaatggtggcattctgtgaagaagtgcattcctttgtccacattggttatttgattaccttgagctacgtttactaatgtaaagacaggatgaattcttaattttttcccttgaattatcaattttcagagctaggaggtggcgtagtagctatttttaatggtgacaaatgcactttgtttttaatgttgactctcttttagataaatgttattgcagttattattttttgtgcacaaattgttacaacttctttaagctggctcttatgtgcttttgacttgattacatttatctttgacttctggcccaaaagaataccttatgccataaactataatatatattttatatgaggtacaaaatatacatgttttcatatgactgttatatatgtatttgaaattctatcagtatatataaaatgaaagaaaagaataatatgcttttrtttagttcaccatttatcaaaaattcattttccttaagtctaatcatgtttctgcttatgtatattttttaaattttcttttctaaatcataggaaataccctctttttacattcaacagattaaaaaccccactcaaattgtacccgatagaatgtgaatagctcatataaaatatgagaggaggtagcaggcaacactgtctcagcaatgtaaagtttcaatttgaatttcaaggatccccactataatatttgggatctttagtaattcaacattatatttgtatgtaaatcaagataatgaacatgaatttatactggacacartacgtctggttgagagatttttctctaatatatggtttgaacccaaacccaggaaagataaatggccatatttatttagaattaaggttctgcctagtggtgtgacagaaattgaaaggacaaagggacttgaaatactggtaagaatgattgacatggtgtcctttggattctaaatgtcatctgtatcatgaagagctagaattaagccagaaggattgaagagtatacctgatcacaggatctctaaattaatatttcagtagtggcatatttttggtgatgtacctgacacatggcatgttatagcaaatgtttgtcagatgaatgaatgacaaagtccagggaacagctaaaagaataggtggcaggggtgtatttgatcatgtaagatgagatggcaaggaaatgagagtcaaatctggaggatttggacatgactatgccaaattaactttgtaatataattattggttgatttgcctgagtgattaacattaaattatgaagatacttccagaaggatgtaagttcartgagttgagaggcagtgaacactttagttttgtcaataacttaaaattgatttkgtggggtcaaattatctagactagaattagcctagtgtaactgtctgtcttacttacttcttcaagaatgttttacctgtccaaaaggcggcttcacgaactctatgcatttttctgcgttataatcgtaaacaagaacagagacatgaggtcattcaaaaattaattgaacgtaagtaatcattgtctactattttraaaaaggaaagtaaacaaactagttggctttagttatgtctaacttatgtatcattttgctgtgaataattaggttactattgggttttataagatgatttttattttctagaaatccttatggcaagattagatctgtgatgaatgaaagtaataattactctgttttcttttgtaaatgtctacactttagaaattaaaatatatttacttatattgaaagcccagtatctcccctgatgaaatagcatttggaactaaaatataaatagaatatccatgcatctaatcatttattttatggtcctatttcaatattcacataattaacagaatctgggatttttctttgaatagagttgatagtatatttgaatattaatttgatgagcctagttggtttataatgtcttaagaaactaagtcagtttacaaatgcaaatttattttaatttgktaagagctaaaatcaaggcaaaaacatttggtttatagtattgattctagaaatagttgcacacacctatatatacttagtgagtttgttaattattgtatatttgctttgcccataatgtcttaatatttttaccaaactatattatccagcataggcaggtaatgggattttctagttattggagtttaccagtttaagtgtgtatcactacttttcaaaaaattagagtacttttataaaattccatttaagaaaaaatatgctcagtatactttaatctttctttttatagtcttattttaattcggttttcatttttcagtggcaagagctcatgtttagaatgttttattttgaaagaagattcagtttggttttatttttgaacatttatgtaaaaagtagaaaattaaccttttaaatattgacctgaattattgtcagtaatgctgtttatatatgactgtatctactttaggcatttttaaggaaacaaagggaagaaaacagttaatttgattattaaaacacttagaagttatacagagctgtgtttgaattctagctctgcacctgccagctgtgtgactttaaactcactaaatcttagtatccttatcttttaagaggaagaagtatgtgcatcccttgggctgcttttcagggctaaatgagataatatgtgtaaagtacttagcacatagtgggtgataaaaagtagtaaatacagtcattccatagttaataaatgcttatgaaattgaatgaaatgtttgacaaaactgttttatggtttttgaggtgtcattttggggatttacaaacctgaggtatataataatgatatttttcctcttatgtcttgtatttgctagccaaattgtgggtatgaagaaacttcttatgcattttgtgtgtctaactttgtcactttaatttcatataggaaaaattaacttaagataatttttgttgttgtttctagaattgggccaaggaaaaagttactggaatagacttcgatttttggatacctgtgaatttattatagagatattttcaaaatcatttttctgtaaatatttctttctacctgctattgaactgacacatgatccagtagcaaatgtgaggtatgttatcaatgaaggaaaatattggaaattgtatttatttttatctactatagtgaacatatgcaaaatcttttccttagccaattaaaaacttaagtcaagaatttacacrtgctttgaaattcttagtattcataattgatgggcatcagtaagacttggaagcatactctttcaacactgtctcagatcttttgtctttactgggttgagagcagttagtcaaagccagattggtaagcttcttcggccatttggatatacacattgaaatgattagaagrttgagtagatgttattaatttatctaccattaaaactaaagaaaagacggtcagtagccttatcacttcaaagttgtttggtgagcatccgttagtttctagaggcccayttattcaaagaagtagaactgcttcaaagtcttcatcttgtcttctatgttttgccttatattattgaaatccagtaaaatgttaattgcatttgattaactgttaagttggaaggaacagacctgaaaatggcttgcctggaaatggaaaaaaataataaatatattttgtcctttttctctccaaaagagcacatcacttcctttttttttactgtggtaaaatatgtataatataaaatttactattttaaccatttataagtgtatagttgagtggcattaaagtacatgcacattattaagagctatttttgtacatttgataatagaatgaaaagaatgttaaaccctcagccattagatttctgtgttctaagtcctgtgtctctattttgaacttgaactcagatctgcaggaaagagagacatcagagtcagttggccaaaggcattcctgaacaaactctagaactccctgctgaattttcatacattggggcacttagtcttatgcatctgaaagatgcatatgtaccacttttataaacaactgatgtgaattttaggcaatatgtaaaacatcaaaactttttaataggaagagttggtgagataataagctaactgagattaatagtcttggtgttgagatatatatgaagatgaattgtcaaaagatacygaaaagttcaacttaagacttttatgagcattttttaatgggaacaaatctagaagtttttcttttgtattttaaatgtgagaaaatacagaaagcacaactgcattgactttagtttttgttgcatatttcttgtgctttataaatgagaggtggggtattgctgacatttaaagtgaattgaaaagaaccttttgggctgggcgtcatggctcatgcctgtaaatcccagcactttgggaggccgaggcagacaggatcacttgaggccaggagtttgagaccagcctggccaacatggtgaaaccccatctctactaaaaatacaaaaatgagccggtcgtggtggcacatgcctgcagtcccagctacttgggaggctgaggcaggagaatcgtatgaacctgggaggtggaggttgcagtgaaccgagatcacaccactgcactccagcctaggtgacagagcaagacttcgtctcaaaaaaaggaacctttggtaattctttagattttagctcttcctaaacaactaatgggtccatctttatgaacattttgtgaattaaaattgtgattctataaaagcaactttcaatgtgatgtattgtcacttatcaggcagttgacaaaaataatttgaaaggaaacgaaatcatctctactttgatcagtgtaactaagagcataacattgactctttgagaaagaaatctgccaattcaaaaaaccaaatgaagagtaattaaatattactctattaatttcagagatctgcagggcagcagattattgtataactgtgtgtcttggttcctactctcttgcctggccagctgccagccaagatatgtgtccagcaacactgtatgctaactggctttgggtataaaagcccttgctcagtgctttagggatgtgcagatagaatgaaagccatcacaggcaagggtggtaggatcatgttggttaggaggacagtttccggagccacactccctgagctgaaattccagctctatattaaatgtgtatctttagccaagttacaaaacttctgtgtgcattgatttccttagtacctaatttataaagtattctgaggtacaaataactgagataatatacataaattatctgaaaggtgtggtccctaatctcaagaatttgatcatctcatgggcccaggagtctcatagagatgaatcattaygatggcttgggtagcttctgctgaatatctgttttctagacatgccttgggttataaagaatggagtgtgcatagattgttaagtgtttttgtttttccttaagttaatgtttaaaatttaaattcaccaagtttagacaatgtcaagctggaaaaagactcttggtattcagagaagccttttccacagctgccagaaatgaaataatttatttggggggattgataytccttaattagagaaagcattactaggtttagctgtatccgtggtgagctgtgaatgagattgagaccattgttgctatttacaatgctggaaattctacaggaggagcttctttaccctttttggttaaatcaaaagcaaattttgttgtatatgaagaatcctcaagtaaaaattcagctgagaaagtgttctggaaactctaaaaatgggattcaggtgtctcaaggttgcaataaaaataaaaaataataatttgtagagcattcagatgaataaatgaatatagcagctataaaatagatacccacctagcatccctctctaaaacagccatggaaaaagagtagacttttagcttagcaaaggagagtatttcctctgaaatgcctcctcctggaaaggcttttttttaggctctgggattwactcttaacttcctggcattcttcaacctccttgtttcttcctttccaacccagtctagactgtggtagtgccttagaccaccttagactaggtccttttatccttttcttctctaactgtacacattactttggtgatctctcccatttcatggtttaaatatcatctccttgctgaagattcctcactctatctccagcattgacatctaccctggacagccaacttattgagcctgttgcccacttgcatttccattgcatatctgatagaaatctcagacttaatctgtccagaattaaatcttcatctttcttatctgcttttgctccttctgtagtcttctccatctcaggaaataaccatcacatctgcttagatgaaaaccttaaataaattcttctctctgtcattctacctccaatccctcagcacatcctgctgctggtaaaagatattcagaatccggactgggcgcggtggctcctgcctgtaatcccagcactttgggaggccaaggcaggcggatcacaagttcaggagatcgagaccatcctgtataacatggtgaaaccctgtctctactaaaaatacaaaaagaaattagccaggcatggtggcgggcacctgtagtcccagctactcgggaggctgaggcaggagaatggcatgaacctgggaggcggagcctgcagtgagccgagatcacaccactgcattccagcctgggcgacagagcaagactctgtctcaaaaaaaaaaaaaaatggtattcagaatccaactacttctcaccaccttttactgctaccactctggttcaatgtaccatcatctcttgcctgaattattgtaagagcttttcctattgtttctctttttctgttcttgactagctgcagtctaatttcaacacagtagacagatgatgcttgtaaaacattgtcagatcatttcacccctctgctgaaaacctaccaatggcttcttgtcatactcaaaataaaagacaatttccttacagtagccctcaaagcctcttatttaccactctgagctctcctgctagtctcaccttcactctgtttaggcatagtggccaatttgctcatttggaccaacagtagagacaagctctctatatttgctgtgatgctcttttccagatattcacatagctcattccctaattttctttaggtctttgcttaaatatcatcttttcagtggaaccttcaatgacaaccctctttggccacctgctttaaaactgattaatcccctgcccctggtackcccttgtctttattcytcactttatttttctccatagcatttaacactatctgacagattttacttgtttcttttctcttctctgctcccatactagaatgtaagttccaggagagcagagaattttgttggttttatttactgttgtatctcagcatccagaatgatgaatgtttgacacataatagacactccatgaatatatcttgcatgaataaatgaactctcaggctatctaaaacttgatttttgttttatgtttctgtyattcttagttattaamttcactcaagagtaaayactattttattgtagaatgaaactttgctacctgttgcccaaagtgaaatctactctgaagattcctgctgataagcatctacttcagcagttagaaatgtgtgtgaggaaactcctgtgtcaagaaaaagataaagatgttctggctattgtaaaaagagtaagtatcactcttgccacaatgttgcattttttgcattaaggcagtaagaatcttagcttcactatttcagcttgacaggatagcaatatattacaatatttttatccttgctaaaattgtaagaattagtaaatgatttggttgatatgtgctacaactggatatgaaactttcgaagggcacctagacattaaacctgtattactagtaatataagcccatgttgagagagtttgacacatgttaggtgctcaataaacactgttcaattaataatgaatgttttattcatcagactttctttataagtgattataatccagtgaaactttgttggtaaaattggcaaagtcacattttatagaaacttatccctggaagggccctttgagttaattcaggggtctgtttgactttatagaagttatatgcctagaaatattgtgtctacttgagatcatattagtaagtagcagaatcaggaggactagaatagagacctcttacctgctcctgagtgcatttctttgtaaataatgtaacattgtatcctatgagttttttgtttgttttagcatgagatcttagtatatggattctttggagatgttggaaaaactaaacagtaaaaatttgggttagtgagccacatcttagaataatttttactcttcaaaaattgtttatgctgaatatataactaatatttttataagttgaagtgaaattatttacttttatgaatctgaatataaacttcaggacacattgtttttgagcatttatttatagtgagggaaatttccttattagtgtcataaataaattagcatacatggtgagaaaagagagaattcttattttttctctttttttctagaaatcattgccagatgtcacatgaagaatcttttaattaagtgatytgatgacttagtatgaattastatagttttagttttaatgaaatgtgaattcttctttcattaactggtataaccagaaatacgtagagttgcacatgcatttaaatctacacacacacacacacacacacacacacacacacttgtttctaccagacagttccttccttactatttaatatttaagtatagaagtttaggcaatggagttaacttgtcaaaataataaacatgagatggttaattacttttccagaataatttattaattcaagagacaatataagctaatgctatacaggtgtaacagtgatgtaataaaattaatggattattagtctatagtggattattctggagtacagctcttattttcagtatgctgcatatagtgaagccagtctgtcmcatggaaattctgtagtataatgagacattagtatggaaaactcccaggaagctacacaaaacttttggataaaaattgaatagtttcatcagttttataatatgagaagtaactttatttaaaaagagagtctttcatggcatgcattatgaatttttcataaatttcagcagaaaaagcttccactaaattttatgtttgtcatggatagctttgggcatatgcatatccaaatgtactttattttggccattagggttactcttgtagaataagttttagaagtactgccctctatcagagacagaaccctgggttagattgaccattgttttgattgggataatttgtttcaaactagtgtattccaaaagacaaatagtaaattgagagaatattttcagagcagatataaaatttctacagaagggaactaaggattattaggccccatgatggcttgtctcattcrtatatagctaaaagactttttaaaacttcaaaagctacattatgtttctgaaaattcagaaaagattggcactgggagttactagaaattagttagattatatgcatttggtatttgaaatatgcctgtagacttggtcttcttaaggttaaaaactttcaaaagttaaaattgaccctggcatgattgtataaagaytgattgtaagtacaatgtagaatkgggcagaactttagttttctgacttagtcttccccctagtgcagaagtcttctatttgaacctccatttgcaaaataagttgctgagaaatgattggttgttttaatttaattactttagaataattttaaaaactttccttatagactgtattagagttggacagaatggaaatgtctatggatgctgtaagtatactctctttaccttattgtgttggtccattttcatgctgctgaaamagacatacccaagactgggcaatttacaaaagaaagaggtttaattgaactcacagttccacgtggctggggaggcctcacaatcgtgacagaaggcaaggaggagcaagtcacatcttacatggatggcggcaggcaaagagagagyttgtgcagggaaactcccccttacaataccwtcagatctcgagagactcattcactatcatgagaagagcataggaaagacccacccccataattcagtcatctcccacccggtccctcccacaacatgtgggaattaggggagctrcaagatgaaatttggatggggacacagagtcaaaccatatcatttatattgaaaggaatattttaaacttggcagaaactcatcactaatgtttcacaatttcattttaaactttaaacagtttcagaaaaagttttatgagaaagatttgttggatcaagagaaagaaagagaagaactacttcttttgsaaatggtatgttgttttcacatgcacacacatatactcttttctgattaataactgtgtttttttattaaacttaatcatttctttccatttcaccatttcacattactcttttttcttcttaaatgatagtccagttttttgaaatctgttcttttatgaactagatagaaaactatatttgagagccttttaaaraaactactttgctgaagtataattgacaactacatatatttaaagtgtactatttaatgaattttgacatatcgatgaaaccatcaccacaatgaaaatatgaaacatttctattcctttaaagatttctgcccctttgtaatccatgtcttctactctagtccccaacaaccaatgatatagtttctgtcactgtagattagcttgcatttccataatttatataaatggaatcatatattaggtattaatactatttttggtcctgcatctttctaccaacataattactttgagattcatccatattatcgtatgcatcaagaagccattcctttttatttctgagtagtagtctatatttcggatatatcacaatttgcttatccattcacctctttatggacatttggcttacttctaatttggggatattacaaatatagttgctttgaacattagtgaagaagtccttgagtagacctgttttcatttctcttgggtaaatacctaggaatagaatggctgatttgtatggcatgcttaacttaaaaataaaataaaactaaatttaaaaaaatggccgggtgtggtagctcatgcctgtaatcctarcacttttgggaggccgaggcagacggatcacgaggtcaggagatcaagaccatcccggctaacatggtgaaaccccatctctactaaaaaatacaaaaaattagctgggcatggtggcgggttcctgtagtcccagctactcaggaggccgaggcaagagaatggcgtgaacccgggaggcagagcttgcagtgaaccgtggttgtgccactgcacaccagcctgggtgacagagtgagactctgtccccccaaaaaacaaaacaaaacaaaaaaacctgctttcaagtggttgtaccattttacatctacattgtctatgctggaaagctttagttaccagccatactattgggtatgtaatggtatctcattttttttttaatctctttttctattcctgatgcctaaagatgtcaagcatcttgtctttgcttactggccatctttatctcttatttgataaagtttgttttcagaattttaagtgggttgtttattattgttgagaggtaagagcttttaatycattctgaatacaatttctttcacagatatacatattatgaatwttttcttggagtctgaggcttatctgttcatttattaatggtgtcttttgaacaacagaaatatttgattttgatgaagcccagtttatcaattctttctttgataattcttttttgttccaagaatcctttgtctgtcccaagatcatagattttttcctctattttcttttaaaaattytcattttaggttttatatttaggtttatgatccatttcaagtacatttttatataatatatgtttatttttttccatagggaatattcatttattccagcaccatttgttaaaaagccttcttttccccattgaattgtcttagcgtccttaagaaatagttgtacacatatgtgtctatttcttgacttcctattattctgttccacttatttataagtttatcttttaagcaataccaaactgtcttgatcactgtaactttatagcgttcttgaaatttggtaggatacgttttccatctttgttccctcttaaaattgctttggccagtctagggcctttgcattttgatatgaagtctggaatttatttctacgtattttatgtttttggcattattataartggaagtatacatttttttatttcactttccagttttttgttgctggagtataagaatactgttgatttttatatattaaccttgtatcttataaactttctaaatttgtttattctaaaaattgttttttagattttctaaaactaaaattttatacgtaagtgatcatatcttctttaaawacagcaatattacttctttctattcaatatttatgccttttgtttctttcttttgtcttattgcaagatccaggacctccagtaaaattaaggtggtacaagtaggcatccttgtctttttactgatcttagggggaaacagttcagtctttcatcatcaggtatgatggtagaaataggttttatgtagattccctttatcagattgaggaagttacctcttactcctagtttgctaggagtttttatgaatggttgttgcattttgttgtatctagaaatgatatttgatttttctccttcattctgctaatatactgaattacactgatttttcaaatggtaaaccaatgttgtcttttggagataaaccctatttggcaatggtttattgtcctttttctccattggatccttggctaatgtttttgttaagggattttgcatctgtattcatagattcatagtgaaattggcctataattcccctttttgtcatttttgggattagatttggtattaatgttattctggcctcataaaacaagatggatggtattcccaccttctctattttctgaccaagtttgtataacttggttttatttttgccttaagwgttttatagaattcactagtgaagttatctaagcctggaattttcattttggaaagtattttgataattgattctatttccttagtagacattagataatgtagatcttctgtttcttctgttgtcaattttggtaagttgcttcccttccaccccagtttacatgttrtttaaactgacaaatctgttggcatgaagttatttataatattctattatccttttaattatggcattaatctatgatgataaccattttattcttgtgttagggatttcctctctcctttttttggaaattttttttgcttgtttctctagggattttaatatccatacctaaccttttacagtctacatattgttattattatatcatgtcacttaacaataatacaaatctctttacctcctccacacccattcttcatgttacagttgtcatatgaattatatctgcattgaagaccccaccagtgttgtaattttgctttaagttgtcatatgtatcttgaagaatacactcttagtgtaaacttttacatttactcagatctttaccatttccagtgctcttcattcattgcttaagatctaaatttccctctggtatttttttccttaagataaaagaattttctttagcaaatcttgaagcacaggtcttctggtgacaacttctcttattttttctttatctaaaatgtcttatttttaccttcattcctgaaggatattttcactgggtatagaagtctgggttgacagccttttccttactgcattctaataatgtgtttctgtctgtcttctggccaccataacatctgataaaatagctactctcattgaattgttgatgcttctttatgaagcattgtttttctctggacactttaaatatttttttcctttagcttttgtttttagcagcttacttttgatgcatctaggcattatttacttgaaatttatccagtttggatttggtaatcttactgaacctgtaaatgtatatcattccccaaatttgggaagatttggtcattgtttatttaaatatatattctcttccaatttttctctctcttatttctgggtcaccagttgcacatatattagatcgtttattattgtccgtaggccaagaggctttgttctttctcaatttttaaaaaaactctgtgctactcagtgtgaataatttctcttgatgtatcttcagtgttaccaacccttccctgtcatctccattcagctgctgagcctatccarttaatttttttatttccaatattatatttttcagttctaaaatttccatttggttcttttagtgttttctatttctatgccaagaatttgtgtgactaaagtggaaattttattatttcagcagcctttcaaagcaagattagaattcaggattgccagtgggagaaactgtagggaagactctaaaaaattttaggaccaaatgacctagcccaagacaaaaacagacaatagaaagagaaccgcagataatcctgatactggaattagtagacaaggacttcaagataactgtgattaatatgatcaagataatagaggcaaacatgtagaaaatagataactcygttaatccaacccaatgaaaattttcagttttatgctttatttctgttttagaatttccatttgatttttttatgtagtccacttctatgtggaaattctttatcttattttctccatatttttccttagtttacatgtgcatttgaaaagaatatttattctccacttgttgactctagtattctrgcatgtcagttataccaagtttgttcagaacttgctgtgtttgttgattttcwtgcctattctgttagcataagggcctcctgtgttttggtaacgttttgtttcatgatattggagctggttatacaagtgcgtctattttgggaaaattcattgagctatgaatttgtatacctataatttgtgtactttctttatacatatttatgtatstatatttgagatggagtctcactctgtcacccaggctggagtgcagtggcatggtccaggctcrctgcaacctccacctcccgggttgaagtgattctcctgcctyagcctcctgagtagctgggattacaggygtgcatcaccatgcctggctaattttttttatgtttttagtagagatggggtttcatcatgttggcctggctggtctcaaactcctgatctcagatgactcacccatcttggcctcccaaagtgctgggattactggtgtgagccactgtgcccagsctctctatgtatattatacttaaataaagcatttaaaaatatccaagaccattttcttttctctcaatctttttaaagaaagatattatttagccrtttaccaatctgaaattgaaacgaccaaagtaatggatattttgctaatgtgatttaggaaataccgtctagaaaatgaagggtaattattacartgataccaaactcattgttttagcttgacaaaccctcaagggcataattctgtagatatgaaaagagcacaaatctgaaagaaccctgaattctttagacactaacattggaaaaaaatacttcttttaggcatttttatgaactttacttgaatctctaatgcttaatttctcagaacaattttctagacctacttcagttgtacctttaatgcaagatactgtcttaataacaggaacaattagagaaagaaaagcaacagaatgatggaaggcccatgagtgataaaatgtttgaaaagaaacgtaagtagtttttctatgtcttcaacacttaattacataattaatgttgcatcctggtattctgaaagaccatgctgaattttttatttgatatggaaaattgctttactttctttcatttttgaaaagtcgtttttgaaaattggccacttaatgtggtacagatgttaagagtacatgaatgaaaggcaggaaccagggtggaygttcagatgcttcaaaagaaaagcttcaagtctgataacagctgtaagattgtgaaattgatcactgaataacaaagattgaaatatgtaaatattaccaagtaagaatatttggaaaagaaagctgcttagctagggatagtgattcatattgtctgagttgtcttgtgtatttatggagattaataaggacttagaggaaattatacaacttaaagcagaatttattttaggtagagacactaagacaccaacgcaaagtctgcccaagaacatccccatttctgttcctggaccctcttctgtcaccccatcgacaagtaagaaataacttctttttatatctttttgtaatttttcttccttgtatacaaattgctgggaaagtcactctattagatgagatacagtaggataatrtatctcattctaaagcacttttcaccttctatcattaggtgttttggtagtttttaattggtagtaagggtaagagatacttcagtgagctcaaattaaggaaaaaaggctaaagccatctgtgttttactgaaaatgatggtagttggggagggaatgggggttggagcagccgaggatgaactgaatacattttycttttttctgcttattgctctaggtaaagaaatcaagaaatccaaactgattcgaagccagtcttttaataatcaagcttttcatgcaaaatatggcaacttagagaaatgtgctaggtaygatctgtaagcccttcaatttttaacataatttttatctttattcacatcttcatatatatgagtttacattttataaaaatcagaattaattttgaggtttttttataggccagtattttgtgagtgttcttctgtagggattgttayatttaaaaataagagacctccaacaattttcacaaaaataggtattctggcattctaggaagaatactgacatgatactatttaataatatcatagaatccatatattatttcatgagggagatagtagtatatcacatgtgccacttaacttttaatacgtatgagtatgttccattatctaaatgtatatagacatccctttgctactaatattgtttctgtctataaagaatccattggcatgttcatatgataaagtgatcacagcagagttagcgtgacaatagatgaatgtctggtttcccctttagcccaggagacaaaattacaagcagttaagattaggatagaatcaatataagttaaattaccatgattttttatatgtgctatacaaactgctgtatgtcaattgacaagcaaaataattttaagaaaacaaatatctttaaaactattcctttgtctatcaagataaattacatgtttcaggaaaaagtatttttcttttattaaagatagcttcttacagaatttcagctgtgtttttgggcattatcagtagatccatcaagagtacctggccagtagagtgatctcaagatagaaaaaagagattataactaaagataagttttgtttccaagaaaattttacccatyttagctgccttgcttgaacctcaaaagaaaaactgtaattctgatgaagcaaaagtttaaggaaatgctttcaagttatagacgaagtaagtgttgtgaggcatgaatataaaaaaaatgagaaataaaagcaacaaacgtttcataagtagaggaaagcattaaaaagaagattaaaacagcacaagtgttagatgactgagattgtaagaagtgtgtttttgtattttaaactaaatcatgttgttttctagtaaaagttctacaacaggatatacaacttctgtctcagggttaggaaagacttctgtgctttcactagctggtaagtagcaatctaagttcttcaaaaagttgctaaatttaacaaaatattattttccttaaatgacctatttctttagtactagatgtagtgttttcttaaatctawatctttatcaggtccctaagaaattaaacttttgtctagcaattgagaaaatatttgactaaactattttgtcttcactgtgtcaagactcaagagtttagtacttttaaaatagaaaaagaacaaaagtgatagggtatgttttgccatactgggaaggtttactgaggcacagacaaaaaggttttgcaataatttttagggaagttaaaaacaacaggacttcactgtaaatctagatgaacagctagacatttacaatattatgtatttggaagtttgtggcaggggtcagcacatttccctgaagggccagaaggtaaacatacaggctttgttggccaaattgaactctgctgttactgagtaaaagcagctatagacagtacataatgaatagatatggcggtgttccaataaaactttatctacaaaaacaggcagtggattgacccacagactgtaatttgctggcctctggtttatataatagagcatagaattatactataaataatgtagactatattgttaaaattactagtggctaaatgtgtgtttttaactttatgctttggagatactggttgaaaattttactattgatctatggtaatttttttaggtgtaaatagtagtgaatctgctcaaagatctgaaatttttaagagattagttacattttctttttaggttacattttgagtattctgtcttctttttctttttctttttaattcttaggaggaatgtatatactcattggctcttctgtaaactggttcatttgctggaagagaaaatctttctagcattaaagcatcgacattcacgtacagtatatagagtggttttctgcaaggtagatggtgattatcgcaagaaataatttgataacagaaagttgattaactaaaattttccccatatcttggactataaataataaaaccattgattactttcagctcagtaaagctgtgaattctttaggaggtactaaggaacattcagagtttaagaactttatttaaaatatagagtgcctttaaaaattttagtgtacaaaaccagtttgaattagcttcgagctaatggtgcagatgattatagatgttcataaggggttcttcagacttggatggatctcacctgtcctcttggtacttcttcacttagctgtaatgagcatgtttattcatgattttgtaacattttttgtcaagaaatttctttgtctaaatcattaagaatattgattcagaagtggtttttaaaagttttaattaagtgcattaatttatttagttttaactttgctagtttttaagtgaccttaagaaccaagagagtagatatggtccacagattctaaaacttacatccaaagtcttaagttatgtattttatgaggtgtatttgtctgttctcatgctgttaataaagacatacccaagactgggtaatttataaaggaagaggtttaattgactcacagttccacacggctggggaggcctcacaatcatggcagaaggcaaagggaaagcaagacgtgtcttacatggcagcaagcaagagggtgtatgtaggggaactgcccttttataaaaccaccagatctcgtgagacttattcactatcacgagaacagcatgggaaaaattygcccccatgattcagttacctcccaccgggtccctcccacaacacatgggggttattacagttcaaggtgagatttgggtagcgacacagagccaaactatatcatgagagtaaatattttattaaaatatttgaaaaatattctattttaatgtctcaatattatttttagttgagggagaactgtaggttgaatgaaatatctcctagagttcttggttagaaaaaggtgcttattattgttattcattacttaaaatagaaactgaaaatatttactatgtaatacatctataaagagaaaatggaagcagaacatcttttaacaaatttgtcagatgtttgcatagagaagagatcttatttgtyggactcaaaacaggcttcaagatgattatgtcatttgagatgaaccttaaggtatgctaggattttgacaggcagagatgtgtatagaataacattccattcacagtaccggtcataaacaaaagatgattgttggtgttttcagggagcagcagctgactagtttgrctggagtgtggagtgagtataatggagtagtgttacataaaactgtaaggaggccgggcgctgtggctcacgcctgcaatcccagcaccttgggaggctgaggtgggcagatcatgaggtcaggagatccggwtaatcctggctaacacagtgaaacactgtctctactaaaaataaaaaaaaaaaaatttagtcgggcgtggcgtcaggcgcctgtagttccagctactcaggaggctgaggcaggagaatggtgtgaacccgggaggcagagcttgcagtgagccgggagagagagcgagactccatctccagaaaaaamaaaaacaaaaacaaaaacaaacaaacaaacaaacaaaactgtaaggaaaggtcagagtcagagcttggaatgccagattggatactttttacttaacacgaatccactgttcattgtgtggggacttatgcctgtcttcagttatactactcaaaactgttcaggaaagtctgagaaactgtcacagccaaggagagcctaaggagaactaacaagtaaatgtgatatagtatcctggatgggatcctgagacagaagaagttgctattagataaaataataactactatggattttagttaataatgtatcagtattggttcattaaatataataaatatagcatacttatgtaagctgttagtagaggaaattggatgaggggaatatatgagaattattctgtcatctcaatttttctgtaaatcaaaactgttctgaaaaagacagtttatttaaaaaaataacatttacagtatcttcaaaaacactaagtgctcagggacaaatttaacaaaatatgctagagatacataaaaaactttgaaatattgctgaaagaagctaaagacctaaataaatggagaaatataacatgtttatggattgaaaaacttaatattgttccaatgtcagtttttttctaaattgatccagagattcagtgaaatcctaattaaaattctagtagtctttttgcagaaatttataagctgattctaaaaatctgtattgaaatgcaaaaggaccccagtgtagccaaaatagttttgaaaaagaaaaagctggagaacttaaatataagtttgatttcaacaattactataaaatgctggtaatcaagacattgtgttctatgttgtcatatatagtcagtagattttaacaaaggcttcaaagataaatcaatggtgatagaataatattttaaaaaatggtgctggatggaccaattcctggaaagacacaattcatccaggtgcagtggctcatgcctgtaatcccagcaatttgggaggcagagacgggtggatcacctgaggtcaggagttcaagacctgcctgaccaacatggcaaaaccctrtcaactaaaaatacaaaaatcagctgggtgtggtggtgtgcacctatggtcccagatactcgggaggctgagacaggagaatcgcttgaacctgggaggacgaggttgcagtgagccaagatcatgccagtgcacttcagcctgggagacagagtgagactccatctcaaaaaaaaaaamaacaacaacaacaacaaaaaaagactcaattcaaaactcacagaagaagaaatagacaatctgaataggctcatatctattaaagaaattgaattggtaattaataatcttccaaaacagaaagcatctagcccagatgggttcactgataaattctaccaaatatttgaggaataaattttaccaattatctacaatctctttcacaagatagaagcaacgggaatacaccctaactcattctgtgaggtcagcattacccaactaccaaagtcattccaagaaaagaataatacataccaacatctctcaagatcacaaatgtgaaaattatcaaaaaaattagcaaatcacatccaacaatatataaaaagaattatacaccaaaactgagtaggatttataacagttatagaagactaattcaccatttgaagaacccttaatgtaatacatcacactaacaggccaaggaagaaaaatcacatgatcatggtaatacatgaagaaaagacatttgacaaaacccaacacctattcatgataaaaaccatcagtaagctaggaatagagaacttcctcaacttgatagggaacatctacaaaaaacctacagataacatcacagtagtgaggaaccagaagcattccctctaagatcaggaacaagacaatgatgtattcctctcaccattcctttttaccatcatactggaagttctagaaaaggaaagaaaagatatactgattttggaaggaagaactcaaattgtctttgatcacagataacatgatcatctatgtagaaaatccacaagaattggcaaaaacactcctggaactaagaagtgattatggcaaggttgcagaatataagggtaatatatgaaggtcaatgtaaggttaatgtgcaaagttgagtatgtcctatattccagcagtgaacaggtaggaatttaaaattaaaagcaaaataccatttactatcagcactcagaaaaatgaaatactcaggcataattctaacaaaatatgtacaagatctatataaggaaaactacaaaattctgataggagaaatcaaagaactaataaagraggagatgtctcatgttcattgctagaaatactcaatattgtcaagacgtcagttcttcccaacttgatctataaactaaatgcagtctcagtcaaaatcccaacaagttatttggtggatatcaacaaactrttgcgaagtttacctagagaagaaaagtcccggaatagccaacatgataatgaagaagaacaaagctagaagattgacaccacctgacttcaggacttagtataaagctacagcgatcaagacagtgtggtattggcaaaagaatagtcaaacagattgaaggaacagaataggaagcccagaaatagacccacgtaagtgtagtcacatgatcattaacaaaggmgcaaagccaatacaatggagaaaagatagtcttttcaaacaaatgcagctggaacaataggacacccacatgaaaaaacaaaattagatcttttacacccttcacaaaaatgtattcaaaaatgaatcgctgttctaaatgtaaaatgcaaaactataaaattcctagaagttaacataggagaaaatctagatgaccctgcttatggtaatgacattttagataccatgtcaaaggcgcaatctatgaaataaagaataagctgaaattcattaaaattaaaactactatttgaaaaatactgtcaagagaatgagaaggcaagccactgactgggagaaaatgtttgcaaaacacataatctgataaaggacttttatccaaaatatacaaaaaacttgtaaaacttaacagtaggaaaactaacaacctgattaaaaaatgggcaaagacttgaataaatacctcactgaagaagatatatagatggaaaacaagcatatgcaaagatgttcctcatatgtcatcaggtttatgcaaattaaaacaatgaagccccatgacacacctattagaatggtctaaatccaaaacgctgacagcaaatgctggtgaggatgtgaagcaatgggaactctcattcattgctggtgggaatacaaaatggtacagccactatggaacatcagtttggtagtttcttacaaaaccagacattcttaccatatgatctagcagttgtgctccttggtatttatccacaggagttgaaaacttacatccacacgaaaatctgagcatgaatgtttattcataattgccaaaatttggaaacaaacaaattattcttcagtaggtagatgwataaacaaactgtgatacatccagacagtggaatattatgcagtgctaaaatgaaatgagctatcaggccatgaaaagacatgaagaaaccttaaatacatactactaagtgaaagaagcaaatcgaaacattccaactatatgacattctggagaagatgaaactatggagacagtaaaatgataagtagttgtcaggggttcgggggaaggagaaatgaatagatggagcacagataatttttagggcagtgaaaacactctgtatgataccaaaacgatggaaacatgtcaattatatattgtccaaatccgtagcatgtacgccattaagagtgaatcctaatgtgaactgtggactttgggtgataatgacatgtcaatgtgggttcatcaatgcaacaaatgtaccactggtgggagacattgaagttgggaggctgtatatgaatgggaagatatgggagatctctgtaccttccactcaattgtgctgtaaacttaaaactgttctaaaaaatagagtctacttaaaaagtagtgctggaaccattggatatccatattaaagaaacaaaaacaaaaacaaaccctgaaccttaattatttgttaaatttatataaatttaaggcatacaagttcagttttattacatggatatattacacagtggttaagtctgggcatttagtgtaacctaatagtgtacattttaccattaagtaatttctcatccatcatcccctctgacactcccaccctttctagtctccagtgacaagtattctacattctatgaccacatgtacacattatttagctcccacttataagtgaaaacaggcagtatctgactttccgttcctgtgaatctcaagtcttatcactatacacaaaattatactatactcaaaatgtattataaacctaagcataaaagtgtctatattttctaaagaaaatacagaagaaagtctttgtgattttggaatacacaaagatttatcttgaccataaaacaaaaatatcaacacactggacttaatcaaaattaaagcgtctgggctttgaaatagagcattaaaaaaataaaaggcaaggcatagatttggaggaaatactcatagcatatgtaccagacaaagaatttgtatccagaatatatacaaagatgtctttgtaaaaattaggcaaccaattttaaaatgggaaaaaggtttgaacatgaacttcacaaaagatacacaagtaagtgcatgaaaagatgcttaacgtcctaatcattagggaaatggaaatttaaaagcaataaaaaaagcacccaaggagatatcacttcacacttgctagaatgtctaaaactagaaagactcacaatatcaagtgtgtgtgaggatgtggagtaactctccagaatactcacatgttcctggcagaaatgtcaggaaagaaaagaaattctgcacatcaatttggcagtttcttttgaagttaaatatatatttagtctatgacccagcacttccactccttggcatttactgagaagaaactaaaacatatgtccacacacagacttgtacgtgagtgttcatagcagctttatttgtaatatataaaaactggaaaaaaatagaaatgtctatcaacagatattatgggtaaacaaattttgacagattcacacaataccagtcagaaatagaaaggaaggaagtattgatacataaaacatgaatgattttcaaaattatgctgaatgaaagaagccagacaaaaaagagtatatgctgtatgttttcatttatataaaattctagacaatacaaactaatttatagttgacaggagtggtttggagagggaggaggaggattgtgatggggtatgagggactgtttcatagtgatagacatgttcacatcttgattgtggtgatgacttcatgggggtgtacatatgtcaaaaccttaactttttgcagtttgttgtatgtaaattataccctcataaaattgatttaaaaggtgaaaaagttagctatcattaaccttttcttctctttggttaccctctttgttagtatatttggtatgtctgactttatatgtattgctttcagatgattcattccggactcgtaatgccagtagcgttccatcttccttttctcctaatactcccttaccgagtacttcccgtgggacaggtaactcagttgaccccaagagcagtggaagtaaagatacacaaccacggaaggctaccttgtaagtaatcaagtgatgtcagactgagtgtattatcctcctcttttgcttaacacactttccttcccacttaagtactttccaaagaatagaaaatgtctgtgatgagaaaatgttataaattaaagggtattattgtcacatgtgactctgttatgttagtttatayagaataacttatatatggcaaaggcattataaccttagggaatcaacaggaaacatttaaatggctcccactaatgtctgaaatctattttttttctatgaaatgtttacatttagggaatttatctctaagaaggcatccctttaaacacctagcttaaggatatggtatttaatcacccagtgtgcagaaagattggtaaagctgatgtcacttaagaaataagtggcagcatkgaacccagaattgtgagtccaataaactgaagagatttacagactgtacttgtgtcttgaagctgaggttataaagggcctcctttctccttttcccccatgattccttttaatgtgctgtttgtatcttgatttgctgaagtctttcttttaccttaaatatttaagagaggggtaccataaaaatcaccatgataagagactatatcagggtataaatgattcagccaggatacccaaaccatagttacaagttagccatttcatataggacacctgaaccttctggttggaacagacttttaacaagatttagattttcttttaaatgtattttagtgaatgcatgggcatttttgaataaagtttcttaaatrcattcttttgcaaaaactgtgctggagtcccttttaggatctgatttaggctgytttgcattgctatraagaaatacctgggcctgggtaatttatgaagcaaagaggtttaattggctcatagttctgcagactttacaggaagcatagcggcatctgcttctggggaagcttcaggaggcttattatcctggtagatggtgaagcaggagcaggcacatcacatggtaaaaacaggagcaggagagagaaagtggggttgggggaggtgccacacacttttaaatgatcagatcttgcgagaactcactgtcacaaagaaaacaccaagccgtgagggatcagccccatgatccaaacacctcccaccaggcctcatctccagcattgcagattacaattcaacatgagatttgggcagggacaaacatccaaactatgtgtattccaaattgtaattggtcgttgggtatatgcccaacttcattcaaaatttagaaataagtttagaaataaatttattgactagagctcaaggaaagaggaccaatgtactattacaaaaatgtaatagtaatagaaaaaaatgaacattgatattacaggttaatgtcaatgcagagtatatttttatttacagagaatgctctttagctatacaattattgctcccatgattatacgatggaagttccacttaaaagtcatgaaagtgccaggtgcagtggctcacgcctgtaatcccagcaatatgggaggccgaggcaggtggatcatctgaggtcaggagtttgagaccagcctggccaacatggtgaaaccctgtctctactaaaaaattacaaaaattagctagctgtggtggcatgtgcctgtaatcccagctactcaagaggctgaggcaggagaatcgcttcaacccgggaggcggaggtttcagtgagctgagattgcrccactgcactccagcctgggcaacaagagtgaaactccgtctcaaaaaaaaagtcatgaaaacagaggcaggacatggtaatggtgtatagagagctttgtgtgcctcgttcccagcagcagctaagtggttgtgcaaagttcaactcagcgcactggccctcgctgtgcatgtctgtcacatgacagggctgtctcatggttcctcctcctctaaggtgccttctagctctggcatcctgaaatcctctttattaccctaaaccctcttcctctgaaaagattgccctgaaattcttctgttgaagagcatatttagtaacatcaaaagtaatctcttgtccacttgctatatttttctaaatgccataggcattttttacagtaaagaccattgaaacccagtatatttatgctggttctcctttctttcagattactctctttatctgttgtttcactgttgagcatgcttttccttttcatagactgaattttttcttgttcaacatacgtagtatgtagttatttatataatttatatatatgtataattgattaaaaagtgaatctagaaacaaacattttgataacacatcaggtttatttagtcttttctgattctaaaggagggacgttgatatccacagttgcttttttaacttgtgactgggtatacaagtttgtaactatatttccatctgatgtggcacttatatggatctctcttgagtgcacactgccacrtggctggatgggtgatgatatccacattggtctttcttctgtgaaatagtatccacaattcaaaacaggccatatccaagtgaaaatatgttcttttcatttaaaataagcctatgaggtgattttggaaagtataatttatcttaatttttgcttctcaaattctatgcaatacattccccagcttttcagtgtcattgagatgacacatttggtatttaggaatattagtgtcttaaaggaagcataggtatgttattatatcttgtcttttaaggcagttcatatatttatgcctatgtaacttccattatggttatacaaaattaaaaatgtaggaaaaatatgaattaaattgaatgctatgttatatatatacacagaatttttggtaattaaagatcattccaagtaatctttaatgtgtaattcattttttcccttaatcagacttctcatatattagaattattcaaagtagagtatctatatatttttaatttactttgtacacattatatgaataacatttttcatatttttttctttttctccctttctcactccctccttccccaccctccctctcttccttcatttctttcttcccaaagaaaatccagaaaatccaatccttaaatcaactgcttgatgaaggaggcaaaacaaaggcagcaggagataatgtgattggtacacaaaagctaaagcagtggctggggctttgtttttaaattttgggtttttttttttgttgttgttaatgagcagaaagagagacataatgacagctgatgttaaacttttcatatttcaaattagattccctaggaggtataatatatatttcttgagtaataatgtggttacggaattccaatgttatagtgaagtgtaatgaaaaacatctctaggaatgtgctttaaccactgctgcaaaagagacaagtctgcatttatttgtgcaggaaaccagccatttaattgttctagagttttagcatttaaaaatcgtatgaaagtctacatcagctgaattgtcctagcttgataagcacttggagggggacttggaaggtgagaaagatactgcattttctcatgagtctccaagcccacttgaaaagtcacactgaaaggatgcaaatagccgtctgcgattttggcggccctccggattgtggtgacaatatgttgtacccggacattcccaaatttaaatttggcartgaaaattccacaaagatttctggtaactttgagctataaataccttaaaaataatagattgatgattttctttatttcctagagaatttattttataaatactttgtttacattttagattgtacttgtctttatttaaaatgatgaatctagtctgaatcagctgttattccaagctatcatgcttaagctatgtcaacagcatttatttgtactaatgctaatatttccatcaaaatttgcctgtggaatatatacagttcttaattttaaactgtcagttcttgagatataccgtgtgaagctattgtcagcttctctatttcaaaatgcaatcagcatataactatattgatattagaagatatttgttttttaaaatatattgatgtatgataaagatgatctaatttgtgaatgcatatgtatgtgtggttactttttataatgtgaaataatgaataatgaatttactcaaaataaaacataggttaatgagatacctgtgtttgtgaaaaaaagtcttaaatactttcctgcagtttttattctataattaaagagtaagatagttcatttttaggtagtgaataaaagaaatataccagcgtcaactataagagcatagttactcagtgagagaccttttcatgccatttgttttccttcttccttccatatggcttctttatggctatttttagtgattcttaataatatcctttgccaaaggacaatcaggtaaatggaattgttactgctcattttgtcagtagttaaaattcaataggtatgagaaatttgacagtactggttaatcagtatactcgctgtggatttcatttaactgttttcattatgtctcctactagcaccaataatgtggaactgaatatattaagatctggagaatgtggtacagaacgagacatcaaaattgcatcagtttttttggtgctttgattcataacattctattaatttaataaaatggagaatttcaatgtatttgttataataaatttagcagaattataaggtttcactttcccatgatgcaaatgggaaaaggggacactgatttgacagagagaaacaactactgcttataaagttcaggaatgtagagcagtcaattgcagtcttagtcctagttagtactaagttatcaaaactgttcatcaaaattacttttggaagttttttaacagaacatgacatttcctaaaatctttgaaatatttattaaaattatactctcaaggacagatatatagaaacaggataaacagcaaattactgacagttatgaataactacatgtatctccatttatatcaaaaacaagatggatacttttgtgaaagttctcagtttaacaacttatcaaattaatcctttaagctagttgtatggcaaagaaaaatctccctccatctgtagttgtagggaaaagggacatcttcatcatcattttgttaattactaaaacttgcatttttaagaacaagtccaggaatttcactagttagccttacaagctaactgtagagctcacttttactgcagaaatggagataggtctataaaggattttacttaatagaggttaaataaggagcacataaagtttttctttataacctcttacacatttaaaaaatcatttctattatttgacttcctgagcttgaatatcttagtctggagatgagtcagttttgccatacaattagtggatatatgagaaatctttgaattgaaatgaaacaggctcttcagctggagtggaagttttacaatgaagatagaatgaattagattaagtcagtaacctgttctcagttgttacagcatatatatgtgagaacgtgtggttgagtgtgtctgtgtaggaacaatttttaagactcgacacttggccgggcgtggtggctcatgcctgtaatcccagcactttgggaggccgaggcgggcagatcacaaggtcaggagatcaagaccatcctgactaacacagtgaaaccccatctctacttaaaatacaaaaaattagccggtcgtggtggcaggtgcctgtagtcccagctactcgggaggctgaggcaggagaatggcacgaacccgggaggtggaggttgcagtgagctgagatcgcaccactgcactccagcctgggtgacagagcaagactctgtctcaaaacaaaaacaaaaacaaaaacaaaaactcgacacatatatagtgaagacttctacaatgttaagatttcccccgctcggttggaaaccctgaatttgtgtgtatgtatttgtgtaaggtaagttacattttttattggtstgcgtttttctgtcatgcctgtgtacttgggaaatctgaaactgagtgtcttargaacttcttaaagcaaatgtgrgggaacattaaaaagtatatttaaaatatagaataggtccattttctaccttaaagagtagtatattaaatacaattattatgctgttgttgctttgcagtgtatgtggtgggaagaaggcaggagttttttatctgcatgctatatgaatccttcaataataatgtacctttttattactgggtttggccatattgatttcagtgagtattgtgctctcacagacttatttttccagatttcatctcttaaaagtgggaaattggactggatgctactttattcctctttctactatttttccacaaacaaatctgactaattgaacacaaacaaggtgacttaagaatgtcagwtagagttagtcctctgtctttggccctctagggcctagaattgcctgtcccttcataagtgtcaattagtactcttggaatgaatacaggaatgaattttattttattawwatgcagtctaaatactgacttttcatcagtccaggttatggaatgatgaaaagtcagtatttagactgcatattaatattattacctattcacattactctgaattatattaaacaactaatcaataaatgaattttaggtttttttaaacattagatagcagacagacagaaatccaattaggcatttagttaacatagttcacactgtaaatcagctctattcaggattctctgaatatagtcttttctgtttctgtgacagaaaataactgcctaaggaagatcagggatatttacgattttccttttcaccctgggacaaagttyrtgcttatattctgtttaacccccatgggtagctgtagtgcatgctgtttacctggtccccatcagatgttttagatggaaggaagagtaaaaagggcttggagactagactcaggaaaggtaggcttctgactctgccattgccacactggaagaccttggacaagtattttgttcccactggtatataaggtatgacttatccactagatgcagaagacacagtgcccaaggctgacagtactgtaagggcccatgaaggtgttttgcttattgccatatgctagacatataactttgaagctagatatgcaactttgaaagacgaatatattcatctttctaccaatgcagccatagaacatatatatcttcatgaaggaaggaggagtctacaaggttaaacgtgcctagggcccatgaaagtaagaatatggacctgtttctgggtccctctttctttcctttgtaaaatgaaggtattgaactagatgatctgtgattcagccaatgcctctgccaagcgatttgatgcaccatggaagcagatgctgtgatcaggactggttagagctattttcttctgatgtcagtcagcaagaaatgactccgtaatagattaaaataaaacacttattttgcaccagagagaaggaaagagagagaagcacatgactcaaggagaatgtttacatgtgttcctcccaaaggctttatcttgacatagtgttctcatctgcaactttttaaaaatgaaaatatgtgagcaacagagaaaagatattctacccagctagtctttagccaagtaactaaggttcttagaaacaagcttaaaataccagacagattgcacaaacatcttaaaaaatatgtatcaatttaatgcttttgtagtagtcctcccttatccatggttttgctttctgcagtctcagttaaccatggtcaaccatggtccaaaaacattaaatgaaaaattccagaaataaacaatctaaaagtcttaagcagcatgccattctgagtagtgggatggaatcttgcatygtcctgctctgtcccacccaggatgtgaattctccccttgcccaatgtctccacactgtctatgctcctcgcccatgagtcacttagtagccttctctataatcagtttgactgttatggtattgcagtgcttgcrttcaagtaactcattttacttaatgttgttattattgttaatctcttactgtgcctaatttataaattaaactttatcataggtatgtatgtgtaggaaaaaatatatataaggttcagcactgtccaccgtttcaggcatctgctgggggtctttgaatgtatccccctcagataagtggggactactgtatttatttgagaacaccctaaactagttaagaacaaaaggaacactctcccctgccatccattgctggtatcctgtgtgtgtttgatacctcagattcagcatctactacagcacgaagtgcttatgcrtgtcctgaattataggagagtcggattcaccaccctgcccagaaacagaagcattccagaggtttcttcatagatcatgaaatgaaatggccggtccactttgatgacaggaggcatggaataagcagtaatttctgacaagattccygccactgcctcagtgcccctttcatcaacttcaatcactgttcttygtaaaacctggaaaaaggaaataatgtgaaaaaccatttgtgtggcagtgcaaaggaggaattaaatgagccccttgaaattcttcacagtggtcctacccatggggtcatgctcctgggatttagtggagcaggcccatctacgttaagaggagtggtctggggttgcaccagggactgccacaggagtcttaaacaataccaggagacctcaggaacccaatgtgaagtattgtggaatatgtgaaacacattccgggcrtggactcaggatgcactcatgcatcaaatctttattgagcatgtaatttatgctactaattcttgagctgagctggtgctcctaaaaggttttcaagctgcctggatcccttgatccctggatcccttgagtcctctgactttccttttggcaggcaaggtggaggcagggaatggctagtcttctgtagcagcttcccarcrcctggtactactctgaggcatttttctgggccaagcccaggggtccctggagccttmctgaattctggctgcctatactgtggctgcttgctatgtttgggaggcccttttttacagaaacaagatgtgatatgagtgatgtacctatataattactgtgttataagagataatgaaaacataacatgtaattacactgattttcactccaggaaattccctgatttcctagaggaaaattaattccccagagcaaacagagggagaatatttaatcatttacagtttaaatttcatgatgacccttcataaagcagcagcgcatttcagtttttcatgtgttcatagcagaaacactttcaggtgctggtctgacggattgttttatttaattgtcttacctctcttgaggttgtaagacctgattccaggccacagttaccctactgtgtcctacttaagtggatgccatttttagtctctcttggaattgaaaattgcaattgtataagaaaatattaaaccacacagctaaggaagaatgtagagagatgtagctgccatttggaaatgtgtgggagcatttttatagtgatgactggagtttcctactggcattagtgaacatgggccagcaatgctaaccagttccctgcaacatgcacaactgctctggacaacaagcagttcccctcaaaaccaagaacccttccactgagaaacactgagtaactgaagggattctatgtggatggtgactaaacttgttcttagaagttttagagatagaactaggaccaaaaagtatgaatcagaagttacaggactctctctctctctctctccatatatatatgtatgtctctctscatatatatatatatrtgtgtgtatatatatatacacacacacatatacacacatatacatttatacacacatacatatatacatatatayacacacwtatatatatatacatataacaattttagctatttgtggattgggcagctcttcaaagaaatggtgagtttgatgtcactggaagcatgaagaggaagagaagttggagggctatttcgtagggctatggaggggatttccacaaggagggagaag

SEQ ID NO: 13449 - DNA, 13928 bp, Homo sapiens
gcttgtctgcctttttttttttttaattttgttatctcatttacaaccgttttttgcttgttttagtcaaatggtgtttcttcctttttttaaaaaaaataatttttttgttccttttctctttccttattctaggacatgaagcagatcaaacaggttttgtttttgtttttgcttttgtttttgagatgggtcttgctgtgtcacgtaggctggagtgcagtggtgtgattttggttcactgcaacctccgcctccctgttcaagtgattctcctgcctcagcctcctcagtagctgggactagaggcgcactaccatgcccagctaatttttgtagttttagtagagatggaggttcgctgtgttggccagggtagtctggaactcctgacctcaggtgatccaccaccttggtctcccagaatgctgggattacaggcgtgagccwtcgcacccagccaggttttcttaatatatcaaatttatgtgctggtcactttagatatttgattttttaacaaaataacactcactggagtttacttaaaacytttttttttttcaaatggaaataaagtcattttataccatatctacttttatattttaatatttcttctgttaccctctcctcccccccaagtgaatgtgctgaatgctcagggcaacatatgaatttggatgtactttatacttttgtaatactcttttctcaatgtggctctcccaggcttgtcctgagttacgtgagggaagaggcaggaaagctagrcttttgtgatggtcacagccctgcggtgactattacatttgtttgcccgtcggagcggagagaggtaagtgactcgtctcctgatcactaatgtggcgcacagtagcctgggttgcccatgcgaaygcgtttctgggcttggggcagggtgggcctggatgcaggaagctgggagccatgacagaggcactggtgggttctcaggagaagacaagcttcctgggatagcttctgtcacatgcagctcactcagggagagctgtttgcattttgccttttgcttttttacagcaatccggaggggcctccacatataatgggatggtrttttgttctagtctctgtgagattattttaagtagttcacggacagatttttttttggtagttgggttgttttagtgaatagtggaaaaacgaagtagaatttcaagcctgtgatttcttatgagaagcctttccctccctctctcttcccagtctgcccctaaacccccatccatgccttctcccctctttctcatcacaggccagtttattgctgtgccctctgctgttgatgaaatctccagcgcagctgtaaactcttcgagtgtggctgctgagacttacttgtccttgagtgcccagcgcctgcaagtgttttaaccaggggcaggtgctgatggaaaggaggcgtcccccagggagggaggggtagggcagggctttcctttagtttctttctgccttcttagtaatagggtgaagtagggaggggctgaattcttttgccagagaaccacactccccttcccccaagcaaatgtggaatttgctctgacgtcaggctggcagctggcctggtgtgtgtgggatatggagacagtgcagggctcagctttccactttctgtccccagacttccacatcaagtgctgtcagctgaatgaaggccggagtgtctgatgtttgttctgaatgtgaatggggaggaatatttattcacacttttcatttgtacctacagatgtgagttgaaatcttttaagcccagtgagatgttctcaggcggtagtggttttagtgttttccctttttatttgttctacatttggtaagaatcattttacactgtgagaaccaagagaattgggagttttcctcctttttcttcgaaggggtatgaggcatttcttggtgttagaagaagaggctgatttgttattagtggagcaagaagttccctctgttttttttttttttttttaaagacagtgtcttgctctgtcgccccggccggagtgcagtgccacgatctcacttcactacaatctccgcctccctagttcaagcaatcctcccacttcaagcaatcctcccacttcagccttctgagtagctgggactacaggcatgtgccaccacgcctggctaatttttgtatttttagtagagacagggctttgctatgttgcccaggctggtcttgaactcccaggctcaagtgatctgtccacctcggcctcccacagtgctgggattacaggtgtgagccaccgcaccggccaggtttcttttcaagcttaactgttcactgggcagaccttgtgtgacatgtgcttggacactgtaatacttgggaggtttgtttaagcatttacatttgctcattgaatgattttaggagctggtatttagtaaacactcaccttgtcatatagatcattttaaaaatgctttatttaatttatttattgggtttacatactgtaaagttcagttttttttaagtacaattcagtggttattagtatttttttttagaactgtgcaaccatcatcacaatctaattttgcatttccatcaccccaaaaagaaacctcctgcccattagcagtctcttcccattcataccccaagccctggcaactgtccaccttcttcctgtctctgtggattggccttttttggatgttttatgtcaggagaatcctacactgtgtggctttctgtgcctggtttctcttacggagccctggggtctgcatcaccatgtgtcagactgcactgagccacgtgggcagaagcatcgattatgagtcaaacagaagagggttgggcctgcagctctgcaacttactaattgtgtgcgacctgtttgtaaacctggcacctagtgcctggcgtgtagcaggtgctcagtgagtatttacggaatgaatggtgctgggaagcagcacggctatgcccggtgctaagcccagtaagtcgtgtctcctaagggtgattaaaaagctggcagtgacattcctggtgagcagggaccccatcagcccccttcatggctcacatcaaagacgaatggtggagctcctgctctgtagaagcaacacaatggcagaatcgggtttgtgtctgggtggtgccctggcttcacccaggagcaggtgtgggtacagatatggtggtgcccaggatcccaaaggggttgtggaccgtgtctctggttgtgcacgcatgtgataatgttcactcagtgtcagggttgcaccactccagttgagcacctcgtggaaagcggtgaatggaccatgcaccctgcacggcctgttagcgcttgccgatgtcctagtgattgccacgtgccactgagtccaggtgcttgctggccgaagcttgagtgtctctctgaaggtgactagactagaaagggaatagagtgtaaagaggaaatggaggtgttacgagtcaaatggaaaaaaaataacagtttagaaaaaaattaaaagtaactttactgagttgttayaagtcaaataatcttaatgtgttagaggcaattatgattcaaaaaacagaaacagcaaaatgtagaaacctaacaacctgtctttgagcttttcataagtgtggaaaatctgcattaagctgcatgaaacattttttattttgctkctttcacrttgttcctgatagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagyggaggtaagcaggtgctttctgcctcctggcgctgcttaggaagaaggggatcgagagagggaacgggacagtaggggccaagtcagtccatgcatgcttctgggttggagagagctgtartttgggctggtgtttcaraaataggattcaggtttgactaagtaagactgtaatcttctaatacctattcatataaaacaagcctcttcttgttaatttccctgtttttaggttcrtcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccggtacgtcaacaacctctgtgcgattttcctttttctttgtatttcttgagatagggttgcactctggcgcccaggctagactgcagtggtgcaatctcggtgcattgcagccttgacttccctgcctcaagtaattctcccacctcagcctcccgagtagctgggactacaggcaggcaccaccatgcctagctggtttytgtagtttttgtagacatggagttttgccatgttgcccacgctgatcttgaagtccttgcctcggtgatcctcccacattggcctcccaaagtgcgtggattagaggcgtgtgccttgggaytggcctgcataattttcaagtgcgttgtgtgtattcttgtgaaacataactccctctccttttcttcctctttccattttccgtaaggtahgggagaatcagttactccagcattccttcctagtagacttcggcaagttgccgtttgtcactaaacaatcaaatgtttttcctggctttagagtaagaatgyttctgttagaactgttcactttataaacttgctgtttgtacggaacctactgtaggaaaagtatttaatgagtttacagttgatagggttttttattttaaaattcgtttttaaggagttttgatttttctctggcagtttgagaatctgaagcaccatcaacataacagaaaattttaaacaactaaaaaaatgcattcagcacatttcttttgacccttaacttggtagttgaccttcataaaagcaggatgaaaatgcagttttctgaaaatgtgttaggggcagttacgattcaaaaattaggaacagaaaacygcaaaaaccccagaactggtctttgagctttttaaaagcatggaatatctgccgagaagctgcattttaaacattttatttttgcttctttcaaattgttcaggatcagtatagtccaaggcccctcaggcacggctgtgttcatggcggctgttaagaaggctgtctaattcttgggcgttatttattttgtacgaaatctaaaagygagaacaagagaagtcttcatgctcacagcaaaaccttcggcactttcttccagccagttactactttgaagcragaggatgtcaagtccatacatttggaactcatttcctgtagatatttttccctagctggctagagagcttgctgttttagatccgtartgatttgttgatgctacgcaaaaggcttaatgtagacatttaaaaagattcaagtttttttcttggttctcccaaacacatttgtctgtgtattcacaaaaatctagatattcggatggagacctcaccttgatatattttggaggtgatgaatgcagctcagggtttcagcggatgagcgtcataaactttgagtgcaataaaaccgcaggtaagtgtgcgctggagttcagcccctcctctttgcattcatgggcatgtgcttgtgtgtgtgcacaggcgtgttcttggaagtgaacactgaatggaggagtcagatgccctcctttggactggccagctctagcccccagactgggttttttctgttggagtaacactttccccacccccactgccccagtggacacacacacatcctgtttgtgttttcctcggttttctctgtttgttttgggaatgggcccagcaatgagcttgttgggaaagttttcatcttgaattttggtgcacactaaactacagcaaggacagattcggcaggggcgggatggcttgtcaattttgattgagtgacctcttyttttatgtaatgagtatcaagataatcctttttgcaaagtggtgaccctrtggtagagtttggatctggggattgcagaatgtcactgggtgcrttgaagctgaaggcgtgcatttctctgagtaatgagaagcacccttgagtcaccaaggcactggcatatcaaaaagcggtgccgctgtccatatcttgacgattgtagacacagttgtagctgtagagagatgatgggattcygtcatcatcagagacctgccccatctgttgacccccaggctgtgactccaggcaccctgcagggcatcccaccactgctcagagcaattctagggcccattctggtttccagcctaagtgctgccccacccagagggtctttctggcccttgcttccgtgtgttctgtgtgtttttctacagcagagctttgggtggcttggttacaggatgggttgctacaggattcactgtgggatgagggagaggcagctggacatgatgtgaaccatgctctcgaagcctccggagatcaggtctgcgttgggagagacaggcacccctgccctggtagcaccgcacccctgcgaacgtcctagcaagcaggcaaagaaccagcccagggtcttgccactgggaaggctttcaagcccaaaatgccccagtaactgctgttgtggcacctgcccctgggatgcccttgttcacaggtctgccattgctgtccttgttctctacatggccccttttgttactttcacaatacacacattttttaagtacctatttgcttaggccctatgaggctggagggtgttgtgaggatagatggctctctaggtgttcacagactagcagcagagagagataaggagcatgatgatggaggttcagggcagtgctgctagagtagagcgagtgcttagtgttgtcgctccgctgctttaccaggagggaggcaccgaggtcagctggctggggtctgggctgggtgcaggggtcaggcagttcagagaggaggaagtgctgcctgagccacactacattgaggagcatgccagtcccgtgttggggtggctttagggcctgggcctccagacattcaaaggcatggaccaggggaactgcgagcaggttagaggcgtgtatggggaatgtggctgaagatgaccctggaacrgtgagtgtgcagtattgtaagaaacttgtatgtcctgcagaggagctggattatatctggaaatctgtgaagtcccaaggattttcagcaggggtatgacatacatctgactcgtgaatgagaaaatcagtgtggcctstggatggacctcgcatctggtctgagcactccctgcacccctcagcttctccatcattctctcatcgccctcacctcctagcctacctacgctactagcctccttagccatgtctgcaccctgaatcacgtctctcctacttggtgtccccagtccccagggatgcagcctgtatcttccccatgtgcccagcccctctgatgcctgaccttggttctggctcccaggtcaccccaactggctctcctggactccggctggctcargctgctctgctgtggtctgaatctccctgcaactttgtgatgacctcctttggcctgttctgttcagggctttttattaatgacttggccgagatctttgagagtgtgctgatctcatttggggatgctgggaagacagaatcatyatccaaaaagatcgaaatggacgagcaggatatgagaagggcattatatcgtttcagacttacagggaagaggtgtggacatcgatgagctgccaaccaaacaaaaaacacaggagagaaaaaccaaagaacagaaagaaagaaaaatagaaaaaaaaaagaagacccgcagtagagtggggagatcttgccttgtagttatgagcatagatgaggccacaccctctgggtttggttcccagctgccctrgtttttagttatgaaatcatgggcccagagggagctaaagcccagatgagctgaggcttgacaaaacgggtgaaggcctcccatagctccatttttccttttcattataaaaattttcaaacatggaacattaaaacagaaatttacatgcctgccactctgacagccattgatgttttgscagatttttcatgtaagccatgcgtcattgatggctcatatcaccccaccctgatgccaagaacgaacattcctttatgtaaattcagtaccatcgttgtacttaacaaaattaacagtgacatcctgatgttaaaaaacccatgttttcctaggctgttttcattatgattgtaacaaggagcctggacagagagatgtcaggtgttttgtgggagggttttgagctggctctcaggcaggagttggattaaaaaatacttacatttccttccagctctgtaattcagcactccaaactctgagagcaaattgtgtactgtaaaattagttcattattattttgctcgaatttaaacttagagtttttggagaatatcccttggtagactctgtttattagatagatgtatttttgaaggtgaacgagtgttaattggctatgtaatagaagtgtggtttaagttggatctctaggaattattcatgtgaatctaggttcatgtacttttcaggatgcaagcgcatcttttggtcataatattttttaccagtttaaatctagtttgttgtaaagcgatgctttattattggtgatttttttaaataaagatgttagataattttttggaagagcagaattcattaggataggctaataaactactcacaayttaagtggctcagcccattaaaggtttattttcttagttcagtgctagtctttggggatggggctggggtcgggggtgcgggctctgctccatgtggtcatttggagacctacgctttttccatcctgtgtttctgccatctgcagatgtgacttccaggggctctgcaggatgggaacatcaatttgctttgttttattttttttccaggccagaaataagtcacttggcccagcctgaatatcaggggaggctgggaaacggagtttagctatgtgtctagaggaaaaattaaactagttgggtaagaggtagcattgtttttgccacagagaaatgggtgctgctgcctcctccttaggcagagagctccttggttccatttgaaaaccttccttccccttttgctggaattgagagactgaggacacaaagtggtgtgctggakaataaactagagcctgtggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactgttctgctaaaattctttgaggaattaagtaagaatacgtgtaaggtacgtagcaatggttatttacaaaatggactctgcctgcagattattagtatgtctcagatgtaaaaccagctcaaaagtactaggacgatttgtagtagtatttaattatttgtaaacttasacgtttttcttcacgtttgcagaatacaaatctttgtcagtagtgaaatgtgaatctagtaggattaaactgtgtgtaaaccttgtgggcgggatgaagagaggcagaggcgcgtcactgttgctgttagttgaccggcaagctcaggggcccagctatggtagctgcctctgggttgtcagctgcgcccaggaggtgaaggtggaaggcattccttaaagacagtggcttagtgtacttattaaaaaccaaaccaaaccagccaaccaaacaaacaaaaaacacaggagagaaaaccaaagaaaaaaagaaaaatagaaaaaaccccacagtagagtggggcaatcttgccttgtggttatgagcacggatgagggcagaccctcagggtctgattcccagctgccctagtttttagttatgaaaccataagcaaattatttagccaccctaaatctgcaaaatggtgctaaaattgtacctttgccatggggttttgaggatcaaatasattaatatagtcatgtgttgcttaacaataggaatatgttctgagaaatgtgtcattaggcgattttgtcattgtgtgaacatcatagagtgtacttaacacacacctagatggtatagcctgctgcacacctaagctatatggtgtagcctattggctcctgggctacaagtgtgtatagcatgtgagtgtactgaatactgcatgcacttgtaacacaacggtaagtatttgagtatctaaatatatctaaacatagaaaaggtccactaaaaatacratactataatcttttgaggctaccgttttatatgcagtctgttgttgaccaaatgttgttatgcagcacgtaactgtataaagaaagtacttaaacagagcctgttcttctgcagcttgcctttatgtagccgaggtgctgagctcagtgcctggctgagattgtgctcactacaggtttgccgctgtggctggtattataattatagtgatgataatattaaagattggatagaaattacaattgaaatatcatttgctcttggtacagaatcttacttcctgttttcttagatcattacctagcttatgataccaaacctcaagaaggcagatcacatggtgggaggctcagacaaggattatgaaaccatcaggggtgggaaaaggagtgttgtgcccacggacccctagcctggaaaggtgcagggataggatttccagcaaggagcaagtcagcaaagcctctgaatctcagcgtccatgggatggggacgtggcctgtgaagagctggttttcagacttaggcctgaactattcctgctgatggatgggaaatctgggtggctcactcttggtggaagaagaggcttgatttgaggagggtgttacagacaggtgcactgacggaaccacagaatttcagcactgtttggagttgtgctgctaacattgtggggctggcataggaccttggcgtgcttcactgggagcgactgactrtagatggcttccactcttgttttactttagggatgagtcccagagaacttgtcttgttcacagtcgcatcactaagtcagcagtgcacagggaactagagctccatttctgtcctcctttctgtgagtccccaktgtcacccagagatgttcaggagcctctgggagctgaccacagcccgggagcagaggatcccactcactgctcttgcgttcctcctgcctgcccttttaatcttatctttggagrtgctgtacayagccttctgtcaatgtctcccaaggtgaaaggcatgctggcctgccatcgaggacttagggttaagcatctgaagcttaatagaagcctgtgtcaactcagatccccatggtctctaaaaaaacctggacctgaattttttaacggagcagttggcattggtcctgttcagtttcttccttgctccttagctgttcctcaattttggtcacgtatggagtttaaatttctcctcttgaattgtgcaggtaacgatgggaaaggaactcctgtattcacaggggaggttgactgcacytacttcttcacatgggacacggaatacgcctgtgttaaggagaaggaagacctcctctgcggtgccaccgacgggaagaagcgctatgacctgtccgcgctggtccgccatgcaggtactgccctccttgccatgcgggtcttagtccacaygctcatggaacattttcccatgagtayttttggaaatgcggttacyattttctttgtcagtgggttgcgtcacagccctcccccagttttttcatgtggctgtgtgaattattagaaggagcattggactgggaggtgaaataactgaatttgagaccagcatttttgaccttgtgttttcacccttttacacactgcctctcttccatctctgaggtgggatctgcagcctctgccccctggggttcttctgtttggatcctctaggcagatggatgtgcaccttgggctgctgttcaccgctgcctcagcgtgcagtgggcttgtactcgaggctgagcttgctgttgcacggcaggcaccggatgaggtgccaaggaggcagcagcgccccccacagcacaacccctgtccttgggggcctggaatttagcaggaaacagagcaggtggaataataagaatgggagtctcaagcagggataatctgatgggggggatttctggttttaccctcttggcagctcaaattaggtgtacagaagccagttgcctctgtaagggggagatgacccgaagcagagagaatgacttgcctcatgtaattaccacccagaacagtcacagaactgctggcggtatgttctcgctcgtaagtgggagttgaacattgagaacacatgggcacagaggggaacagcacacaccatggcctgtttagggttgggggtgaggggagggaacttagaggatggatcagtaggtgcagcaaaccaccatggcacatgtatacctatgtaacaaacctgcacgttctccacatgtatcttgtttttttttaaagaaaaataaaactgccagggtgacagcactgctgctcctgtcttctgagtcccacctggtttgctaaataccaggttagaaagaggaatccctcttgtggagtgtttgagaacctgcctcactgtgaaccgcctgggcagggagtgctggcagtgctgttgtggttaaacaccctgtgtgctgctgggaacggtgccatagttaattctggcacatgtgtgctagtgaagacattgrttttctgtgaagtggaaagagttctagctgcagagttggagacctggctgaggactggtgttgccgcatccaaccacatttgcttgagcgagctgctctccaggcccgggtttcttacggtgaactgggtggtgctgttagattccttaagttaacttttttttttttaaacattactgtgtataagagacaacctaggatctatgagataaggagagatacatttttcaatctrcagacttcctgacatagctctggtttcttggaatctgcagtatttcgtggtatttgtgcgtagatagccctaagtaaattatgaagggagagctaaaaccattccttactgcttgaagaagtcccttaagactttacagcccacctggctccaccccagacttccagtgtttagggcaggtccttgttcacatgcacagtcttgtatggtttcttttaggctgttgacattggaaagtacttctccaaatgtactgtatcaccactgatgagtcatggggttttgccttccaaaccccagtacccaacctgcaaagggagcattttcaaatgagaacgtgtatttttatatctttacctcctccttgacacactttgtaagttactccttcagcgactgttcgccgtgtggtttgctttttgtggatgccctcgcccttgcttgctgtgctggtgacactcagctggtgccccctcacgtcctgcaggtgcctaatcagtgtctgatcacactgaccagctcaccagtcttgtgagttcagcggccacctgtggtaccttgcttgtcttctgtggtagcatgcattgcatcctgcactcagtctgcagatgtgtaagaggttgctggtttcttttagcttcacaggccttcacaggggccgagcggggtg

SEQ ID NO: 13450 - DNA, 12309 bp, Homo sapiens
aggcattagcctctatgctccgccagaaatcttatcttgtgtggttgaagctcattgagattggatggatcggcatttccattgtgcaaaccacactcagtcttccagagtggaagaataaataaatggaatcatgaaaagttaattggcaaagcttacagaaagctttaaccttccctggcctaaggctcttccatttgcttaacttacattctaccctgcttggaaaacatcagctttctccttttgaaataagaatggaaagatccatgcacctggatgaaggagactacgaaccagctctcctgaaaagttgtaaactaaaaataaaatccaaagccctcgaccaactgagtggacccactctctgccaaggaraccccagagaaacctcaaaaactgagctctcagtcaaaataggaagagaggtcaaacgcacttaattctactccctcccttttggagttgaggcgtaacaattgaccagcattaatgttacaatagaaataagaccgcgaaaacgtctctgtggcaataagacaccaagttataaacaagaccttaagggtatgcaaggrgagggttaagtcatgtctgcacacccatcaattttgctacatagcatcatgcttaacttacaacatcccttttttttttttgagacagagtcttgctctgtcacctaggctggagtgtaatggtgcaatctcggctcactgcaacctccgcctcccaggttcaagcgattctcctgcctcagcctcccaagtggttggcactacaggcatgtactaccatgccctgctaattttttttgtatttttacaaaaaaagaggtttcaccctttttttgaaggggtttcaccatgttggtcattctggtcttgaactcctgacctcaaatgatcccacctgcctcagcctcccaaagtgctgggattacaggcatgagccatcacacacagccacaacagccctttctgttgattccaagttttagacagagccttactcctttaatcaattgcaaattaaagaatctccgaatcaccgggcaaagtggctcacgcctataatcatagcactttgggaggctgaggtgggtgaaattcctgagctcaggagttcaagaccagcctgggcaacaaagtgaaaccctgtctctactaaaatacaaaaaaattagccaggagtggtggtgtgtgcctgtaatcccagctacttgggaggctgagacagaagaatcgcttgaacccaggagcgggaggttgcagtgggccgagattgtgctattgcactctagcctgggcaacagagcaagactgtctcaaaaaaaaaatctctgaatatgctgaataaataacctgtaagcccttgctttaagatatcccaccttttcatatggaatcaatgtatacctttcatgtactgatttatgtctttgccagtaactcctgcctccctgaaatatataaaaacacacagtaatccaactgcctcaggtgcacattctcaggactccttgagaaagtgtttccccgagccacagtcactcatcttggctcaggataaagctctttaaaatattttacagagtttggtttttccattaacaaggtgatactcttcactattgtcaaggccttataagtttctcactgaaaattctaaattaattaaggattmttttaacagcaagctcttaggagacaaaaacatcaaagatcatggtctccaacctggaagattttgtttaatagaaaataccatcaaataaaggactcctagccacgttagaagggccaatatcaggctaccctgcctaagtggacatcttcctcagtggagatcttcaacactttgttctttagaccaggacaagaagtggattaaaatattcatttggttaccttcaggaataggaacacttttcatatttgtatttcaagttgttttgttgataattgtccttatttgtgtcatccttttgattcttaaattgattatgctttgtatttctagatgtctaaagtctaccacaaaattctataacaaaaaactcatcataatagctagatgcttagaaatgacccaacatacctcaactccagtgtaagtgaatgacctgaaatcccgctgctctgtccccttatttttcaatccaatccctgaattgttgcctaccaattcagccttggaacctcactaagttyttaagtgatagtacttctgcccatctcattccctctgacatgggacaagactatccggaaatgagccttcccagcaatgtgggacaaacttacatccaaaacgttgatcatcagtattttaagaagagaaagatttttattaaaaggaggaaatgagaaagaaaaattgctcagagcagtctgagatatgcgaactatgcaaaatttatcaggcccagagggacatgagcatgggacttcagtcacatcactgcacccattcccaggggcaattctttaaaagcattttgttcctgacagctgcctcacccactatcttcatgttcctggaatgtgtgatacaaagaacaatgtatagccaaccaatagctcgttaktgtaacatgaatgcttgataaacaacttaggaactgcctcttcctttttcctttaaaaacccatttgtaactgctgctaataggagcatctactcagggcaacttgaatctatgctcctgggttgcagtcctcaaacttgagccaaacggactctctacatatatatagatatagatatagatatagatatagatatagatatagatatagatatakakatakakatatagatatagatatatgtttttttaaagaactctttcactgaaacatgaaagtagtcttcagtgaccaccacccatacgcaagccctttacacatacacagatacacagatatatgtattcataartatagcagaaggtcacaaacaacacaaaaaaaatgcttttgaggagctaactggagaaatgtattgcaatgtagttgagaattacatsactgtaaaatcacaccaagaaacaagaaggatatttaaatacatctccaagtcaacacatctcggtggaagtctacacttcagttcaaaacttcatttacaaccaaggaaaggcatctaatatttaacatacctactgacacatgtagagaataatacttgtttttccctcttgctgttttcctcagtttggctcagtacctaggcacaagcattccagggcccagggccaaaagcctctaaagcacagcttggtggccctctcctaagatcaaccaccacaatggggagaagccagggtaggacagaatcctcactccttcatccactctcacacatctacatcattttagtttatctgagaaaactgcagagtaatgtaaaaattacattgccactgcaacatgattgcctctgaaaggcaaggcaacgcaactcttctatttatcctgctaaattaaaacagtgtagctgaggatcatagtgctgggcctctcctaatcccaaccccaggttgcaattagttcaatctgtttctgcagctttatgaaaagtgtgctgaggtttaatctgaaaacaaaaggaattctataattgcagctcctttctagaagacatatcccagagctctttgacsacaattgtcaggatgcttttggggccttttccatttggaagcccattatttggggaagtyyttggggggggggcggggttgggggaaaaaggtattgaagtagggaagggaaagaagaatacgagtttgcactttcagttcagtagctaaatagcaatttcaacaataaagggtctcaccgtgtcacccaagctgaagtgcagtggcacaatcacagttcactgcagccttaactttccctggctcagctgaacctcccatgtcakcctcccaagtagctgggacatagacgcatgctaccatacccagctaatttttgtatcttttgtagagatgggtttcatcatgttgcccaggctggtctcaaactcctgggctcaagcaatggaaccgcctcaacttcccaaagtgmtgagataataggtatgagtcaccgcaccaggtctatttggtaacatttgtatgttaatgtctcacagtgttccatcaaaagatatgaagtaaraattctttccaattcaatagatgcaaaagaccccaattaatggataaaaaaggtccataatagtcctacttgtggaagtaagtcctaggacacttccatgtcaaatgcccagagtagcatcatcacacagaatgctgtttgaccagttgactgcaggtctcaaagactggacagcttattccaaaactagacctttgctgatatctgttgtggatgtataagtaaatgagcaagaaaaatttaaaacctgaattttgcaattggaaaacctgtaaaggtttayaggcatgtagaaatggttttacacaagagttacacactgattccatatacaattatcgactacctcatcgtgtgtgaaacacctcaaggtattaatactaaacaatttaagtgatcaggttgtaaaagctaaggtcttccattaacaaaatttttaaaaggtgactcaagagactaagttctcatcaatattgtgttattatagactcaaaacagtgttacaagatgcaaaattttatcttgagatgcaaacatcatgtggcttggggtacttattctgtgaaactaaggcttctttttaagtactaagcatacggcaccatctcttaagtctaggaagattgattcctcaaagtattatagcatctccatgatgtcccaaatatagtgaaaatggaaatgcatacaaaatgaaaggagacttgaaaaattagaaatttttctacaaagcattattcaatcatatgtaaggggatatattttagggtacactatacatagaaatctgtgatttccatataatacaataaaaatgattctatttccttgctgttttcaatttacttccctacctacattcttcagcttgattttcacaataatcccatgcaatgcacaagggagttgatgttgtcccattttcacacattagaaattgaggtttagggacagttacgcaaggcctcagcaaataataacagccaggaatccaggccttctctcaatcagcacttcccaccatgaattcagaataaaaaccaacccccacatttcatgaagttgactgtgggtcctgcaaatgtcatagcaaaatagcagaggagtaataggtagcttttgttagcaacacaaaccgtgtagcctctggttagaagagtgggcaaagaatcataaaggtttcttcagtcacataatgtgaacatccatggaatttctgagcacctgcaaggaaattccaaaacggagcgaaagggaaaaagtgttccgtagagttcctaataaaacttaaagagctccgctaactcttcaactgcaatcagttaacccaagtgaagtcatgtatactgcgcccagagccccctaaaagaagcaacacattgatgcaccttcttaagaccaacaactttcgcgtttgacatttttctcctctaaaaacccgtactctcctggggcagggggtcgagtatttctaaggatgaccgttttgaacagcctgctttcacaggcatccataattcaagtgagagtgaaccatcctgccctggcaaggtacctggcargggcggctgtgtagggcacttgcaaaggctgcggaggagagcgcgcgggcgaagaagcactcccggaccatgcctctctccggtgcccggtgctgactgcgctgagagcgcaggagctcggcgccgccctccccgtactcccagccctcccgggcgccggggcctggccgcggacctaccagcgagagtactttataggtgttggggtccttggcagtgcgggcgcgcgccgccttctccagcggctcctcccccacgtccataggggccagcaaggacgcggccgcctgcgggtccccgggcgcctcggcagcgtggctgcggccccgatcgcggccgttccccgccgggccctcccggggagcgcgcccgccctcgccgccgcggctcccgccccccgcgcagccgtcgcgctccatcgtggccccggccgctccggcccsgctgcccsgccgcgcctttaataggccccgcgccgcccgccccgcyccgcccctccccgmcgcgcccgcccctygcggtcagatccttggctccccgccctacacccggctctcgcagtcagggcaaagcgactcaacgccccggattatttggcttcctgtctgatttcgggcactctgtgtgtcggttattttgggtcccttacgtgggcgtgtcttaaacttccccccaagccgtcccctccccgcgccccggccaccctcccgacacttgcaggaatcgccctgcgtggcctcgcggcgcgggctgggctggaattgcagcgtgtggtctgcagagggcatgagatcatggggccccaaaatagagcggggaggaggagaaggatgcagccgccgatgccggtccggcttctcaaaggcgggagagagtggagtcttggggtcgacctgtgagtttctggatggaaatgcaaatgaaccatggaggaaggcgactttctgtttctccccctctgcgccccgtcccccactacctacggtactctgagagagaaatcgtccacttaaaatacgtgggttcacatrtactgaacacacgtaagggatatttcgattcccacggttttatgtggtttctggagtcttctcgctattgtttgtatgtatatttgcttatttttctagactttctgtattgaaggtttcaggagttggcgttgccctctcctgaggttgacactgatacctagctatatcaaaagtgttaatgcaatctgaaatactttgataagccttatttttcaactaggacgctaacagtgagctgattcttggtgggttttgttttacctttgattctggaacttgtacattttctggctcatcacttagcaaaatcaccagtgtgtagtgaagtgagacagagggaaaccagtgacttcgaactactttgcaatacccaggactgacttcaggtaccaaggaaaacaattaattttcaatacattttgaatacatgaatatatacaagtgtttacaaatgagaatgaatgtttaacaaatataaaatgcatgttatccctttaaaatagtcaacttgggatgctcttcatttatactgactcatccatccacccatccatttattcatcaagtaatgaatccttcaactcaatcttttggcctccaactatgcataccatataaaaaatgaattaaaatgtatctttccttaagtgtggtggaagcgggggtgggggggtaggaccaactcgtaaacaaaataattaaaacctaagtcatatatgcagaatagagtcacacataggatattgatacaggagatagaaattatttaggcagatagtatgagcaaaagagccctcggcagaacttaccttctaacaaaaagcagcccaagaaatcacttcctttctaacaaagagcaacctggaagattgggctgcaaacataggtaaggaaactggaagcttgcacgggagatgccggcagcggcacagacagaaggggctactggggccaggcatgtccaccatgggggttccacctcccctcttttttaccacatgcacagtaagaaggaaataagcaacacggagtagctacctgcctatatagtagaagattggggccggggctgccagacacttaagccctatgcagatgacacacctggtcctaaccgggttttcatgccatatgcacgaaaccgggttttccctccttatgtagatcagacaccgcctccccactagctcatctataaaaacccctgcatttcaccacgtattgcaacccattttttgggacccctctctgtagcagagctattctcytccttttgcctattaaaaattctgctccaaacctcaccctttgtgtgtgtccacatatttgatctttgtggccgtgagaccaagaacctcggatgtcaccatagacaacaaagctacttcaatattatgagagcttagtagaaaggacagttgacatctggaagaagtaaaagccttccctcaaagcattattgaacttttttaaaaagttacctttgagtcagctcacaaaccacccaagagaaacaggttttcactgtttcataatcacacatatttttctgccccaaacttggctccaaattttcctttgactctttccaaaaatcagattcaaggacaaagatttgctccactgagactggtcaaatgagtgtcaaaacctctaaaagcaactcaacagagacattatccaaagtgcctttaaacctgacaaaacaaatggaagaagtgtattgtctgcatctcaaggcaacgaaccactttaaagacttaacatttggaaaacacagtgtgcagtctccagggtcacaaacatcttaaggcctagggaaagcatttttctgtggcattaatttatttttaagattttgtatgacatcctggtttttctttcttttttttgaaagcacaatatgccatgaaccatatttgactgaggcagccctatacacactgcaaaaggcaaaccatgtgccatgttaaaggttgcagcatctattcaacaggattgtgtgcccagtgtgggcagatggtcagatttttcaagagaagcaggaaatttaaatgtttgtgtgaattctccggttgcaaaatgttgtctacaaaattcagagaaacagtttcttcaaacaaacaaaatgtagcacgtttaaaagccaaacaaaatgtagcacatctgcaggacagacctggcacacacgtcaccaggatgtggcctctgcctaatgctcatgcctcatctgtgccaggygggacttaatatgggtaattataaaaacccaattggaagtctaaaatcggaagaataaaaatgagccaaggccgggcacggtggctcacgcctgtaatctcagcattttgggaggctgacrcgggtggttcacttgaggtcaggtgtctgagaccaacctggccaacatgatgaaaaccagtctccactaaaaatacaaaaattagcagggcatggtggcacatgcctgtagtcccagctactctggaggctgaggcaggagaattgcttgaacctgggaggcggaggttgcagtgagccaagatcatgccactgcactccagcatgggcaacagagaaagactctgtctcaaaaaaaaaaaaaaaaaaatgagtcagatatgccattttcaggtttagctatagacattgcaaagcctatagtgaaatattgcctcagtcttctttattctaaatgatctgagggacagcttcaccatcacattccaaagtacaataaggtcatgagatataaaaccacaacacaatttttgggttaatgcaaaggtgaacaatgaatgtttcatccttaatcctaaatcactctgttttagtgattgcatactctaatctggaatagcagtaaagatgataatttaagattttgtgtaagttttctattaagttttattgtaacataaatatttagacatttctgtcttggtgcttgaagctttggttgtagataaggccaaaacaccaaacaaaaacaatttatcaatgtttaattattactttgaaatattactttgaaacaacttttcttagtgattaaaaaatgaaatatgctgtagggtaattattttagcagctgtttcagagcttttccagctttcttctaattcgccagtaaaacaagaaagacatctagccaaatctaaacagaaaaaaaacccacaagcctctttaatctttgtgaggcctagggaaaacatttttctgtggcattaatttatttttaagaatgtgtatgacatcctgatttttctttctttttttgaaagcacaaaaatatgtcccctggagcaagaagcttggataactatgtgaccttgaacagattaccagaagcctctgagccttagtttccttatttgtaaaatgctctttcagataatatctctaaatgccaacaaaatgtttgacatttcaactttacacaaacatttaaatctatcatttgcatttgtaaatcaaccactcactacccctaagggagagaataaaaagatttaattttctcctatattatgcatggtttatatataatctctgggaaggtttgagacctgttattgggcctgcatctacaaagagggtaaggaaaggattcttgctgctctgggatgaaggagagatgcctacagggatcagttaggtaacaaaacgaatagagagaattcagaagtgtaagatccaaaggagagtaatagaacctgggaaaatggaaaacgcatgtaccatccaaagagagtgtgsggttctaattagggaaaaggagtcaggatggcgggaccgagggaaagcaaaaatataaagcagataagctgtaagtctgccttgctttgtggtccagaacatgtagccctcttgcacaaataactcacaatcttcctgcactcagctatcatcagaccctcgggtgattaaaaaaaaatgcaagctaattcactgcaacctcrgtgttatcagtactgcacaaagccctcttcagcacacagcacaagcaccattctagaacatccccagcaagccttcgtctccttgcagtcagctcctctcttgctggcctgcccattgttcccttgcaacacattttcatacgtgctctaataaatatgactttctttacctacaagtatcttcataaattctttttacccccacaccactggccccagattgtcgctgattacctgctacaggaagttggtttctagtccttcactttttgttaaccacggtatctgccactccttcattatctcttacacttctatttcaaacaaaatgtagggttgccaggtaacctgaattttaagtttgattaaagtacaatttacctattatcatatctacccattatatgcatacagttcagtgatttttaataatttatacagttgtgcaactattaatatgatccagttttggaacaatttcatcacttcaaaaagtttgtttctgcacatgtataatcaaaaactcccattccagtcccaaccaaagacttctctgctttctgtctgtagctttgccttttctagaaaattcatttaaatggtattatactaagttgtcttttgtgtctgtcttctttcacttagcataatgttttgaagttcatccatgctgatgcaaatatcagtagtccctttttatacatagtagtaatttattgtatggatatatcatattttatcttttcaccagttgctggacattcgtattatttccagcttgagctattataaataatgcttctatgaacattcatgtacatgtctttgtgtgaatctgcattttcatttcccttgggtagataactgggagtttmattgttaagtcatatgcaaagcgtatatttaaatttttgagaaacagagaaactgtttcccaatgtggctgtaccattgtacattcctgccagcaacatgtaaggagtccatatgcccctcctacacttactattcacagtatatcagtgggtaaggagtccacatactttgcaatacttcctattctcagtcttttataatagccatttgaataggtgtttggtggtacctcaaagtggcttttatttgcatttccctaatgacgaattatgttgaacaccttttcatgtgcttatctgtcatctatatgtcttctttgatgaaatgcctactcaaatctcttgcccatttttatcagatttgtttctcatctgattattgagttataaacttttttatatattttggacacaagtcttttatcatatttatgatttgcaaatattttatccaatttctttttcttaatgttgtcttttaaaaaacaagtttttaaaattatttttataaaatccaatttatcaatattttctcctatggaacctgattttggtatcatatataggaaatctctgactcacccaaagccacagaagtttctcctatgttttcttctaaagtgttgtaattttagcccttatatttgggtctaggaccattctgagttaatttttgtgtaatgtgtgagataagggtctaaatt

SEQ ID NO: 13451 - DNA, 22832 bp, Homo sapiens
aattagttattgattgattacagatcaacatgggcagccttcccttgcccaagggaagggaactcggccttcccttgcagaacgtggggtgttgagatctgtctcctgttacccaggggctcgcttcctgttgctgttacttgggtccataggcaacccctggggtgctgacaggtgttctgtgataaaggcgactagagggggatgtgcaattagggaaacaggggcctcttccccctagggccttttggtagctctcctgtggccgtgagccctggccccagacaggaggggctcagtggctgcactttccatcttgcctggccacggaagctgtctaggcaactgtccgagtacacgtgggtggagaggggcctgcgtggggcagtacygtctctrgggagacctagcctctctctggggtcttctcttcctgcaggtggaaagtcatgtcccttggcccatgttcggccagctgtggccttggcactrctwgacgctcrgtggcctgtgtgcagctcgaccaaggccaggacgtggaggtggacgaggcggcctgtgcggcgctggtgcrgcccgaggccagtgtcccctgtctcattgccgactgcacctaccgctggcatgttggcacctggatggaggtgagcacagcgggcactcggaatccctatggggctggggtgggcatcagctgtggctcctcatgtgtgagggagtctaggaggcattggctcatcgtgtcccctgaaaggaaggagagagctgcgcccgttggtgagggggcacctagaggcagagagacagagggcctagagacctgcgggcagctaggacttaagaggcccttaggtttggggacgctggaagatgaatggcaggccactcagctctacacagatgagggaatgccagctgtgccacgcacctggcaaggcaggacagacaagggtaaatggggttcaggctgccccctggaggggctcgctcatggtgtggagggggcataggggcacagcagacagagatgagcygcagccccgcagacctgcttgctctaaggcttggagggacagagaggccgtgagggtgacagggacccagacttgaattatggctcctcccacctatatgacccatgcaaggtgccctctctgagcctcagttttctcatctgtggaatggagacacttaactgcctcccagcttgtacaaggattatattggatcactcctggcctgtggttaccactgtccttgtcaccttctggcagggtcagctgtgactcctcctcccctctcttggcagtgctctgtttcctgtggggatggcatccagcgccggcgtgacacctgcctcggaccccaggcccaggcgcctgtgccagctgatttctgccagcacttgcccaagccggtgactgtgygtggctgctgggctgggccctgtgtgggacagggtacgcccagcctggtgccccacgaagaagccgctgctccaggacggaccacagccacccctgctggtgcctccctggagtggtcccaggcccggggcctgctcttctccccggctccccagcctcggcggctcctgcccgggccccaggaaaactcagtgcagtccagttatgtcctgtcctccttcctgtcaggcagctgctgcaggaggggtgggcaaaggcatcttcctctgggaaggactggcacaagcacttggtccctgggttgtgtgcctgggaggccggratcagggctggccctctttctccctggcaaagcaaaacctcccttttactactatcaaggggaagtaacttgaaggtaggaacccagcttgtgagccccctagcctctgggctgctctgcatgtgccccctcttgctggatcatctggtagcagccctgtgccctgagggtgatgctctgacctatgcagcccccctccctgtcctgagaaggcttccagctgggccttggaggacagggtccacccctacctcctggtctccttcctcagcttggaagccccggagcctgccctgctgggaatcggggaagcactgcttacctgtctcctgctcccttttcaggtgcctgtggcaggcagcaccttgagccaacaggaaccattgacatgcgaggcccagggcaggcagactrtgcagtggccattgggcggcccctcggggaggtggtgaccctccgcgtccttgagagttctctcaactgcagtgcgggtatgtctagggccatgcaagcgatgctgccagttatgggccctgccaggagccagcacgacgctgcatgccccattcctggcaggagcccatgtgcattcccacctgtagtttgcatcccatctcatgactggggagtgatgatctgcattttacagatgaggaaactgaggctaggagagattaagtgatgtgcccagttacttagagtcacatagccagcagtgggagaggtgggacttgaactcggctcagtctaccctggagccactcctctgctgaccaggcgtgggagtgctggaccctcactgccctgccgcttcctaggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagaggtatggccaggccttctccacctcccttgggtgctccagtcctggcagggaggctgggtgggtgctgctggggatggggccagtcccagtggggcagtgggaagatacggagggaactgactgagatggaaggaactggggttggccagtgtcagtctgcacgtgccagggaggggtcacaggatgaatgctatatccctcctttttgggaccgtgcagcaagatggacggatgtgggacatggtccacatcctcagtcagtccctcaggcctctgccccacacccacctgccccgcccccacccctccagcctttcaagggcttttagggttttgtggaagccactgtccctcagccctgtttcagtgcactggtgtaagcagacatgcttgtacatgcatgtgcacccacaagcacacctcaggcagaggatgccacctcagggactccagccttgcccgtggccccctcgatatcctctgatagccctctcggttgtcctggggggcttgccctctcccaacagcccgagctggccgaagttggcttccctagctggttccagaggttcctcggctcccccaggtgtctggggcttagtggcaacaggggcttagcctctgcagagacctagtgcgccgcctccttgccccagacctgcccgggcagagagccgtgtatgtgtcycagtgcacaggcgctgctgggccctgccaaaaggccacaagcccactgtcaccgttcacattgcttctcgcttcccggcccagccccgcccacacaggcatctgccttgaaagaggtgcaggaggtacaggcaggtgggggctccagtgagctctgaggaacagcagtggccgccatgggtggagcctatctttgttgccagtttcagtgttaaacactcttgcacgtgtgacatcattgagtcctaaagaccactctgctcagtgcatgccattgtttccttcagttacagaggagggaaccagagcccagaacatttagcctttgcctaaagtcactgggccaggaagtggtagaggtggggttcagcaggatttgcctgggaaccccaatattgaccacagtgccatgctgccctgcacggctccctggctgtgagttgtcctggcctctggcaccaccggtctgtctgggttcctatgtccctatgtcccacctgcagaatgtgacatgcagctctttgggccctggggtgaaatcgtgagcccctcgctgagtccagccacgagtaatgcagggggctgccggctcttcattaatgtggctccgcacgcayggattgccatccatgccctggccaccaacatgggcgctgggaccgagggagccaatgccagctacatcttggtgaggcccagcatggggacttgtgctgtgaytctggacagctttccctagggcgtgcagggctaggggacccccttcagtttatttcagactaaaaccctcaaaatcattagtgaaagaatgggagaagatagcttcctccacatattcaccaagaaatgttttttgagctacctacaagagtgaaatagtggctcacaactgtaatcccagcactttgggaggcccaggagggcagatcactcaaggtcaggagttcgagaccagcctggccaacatgatgaaaccttgtctctactaaaaatagaaaaagtagccaggcatggtggcgtgtgcctgtaatcccagctacttgggaggctgaggcacaagaatcacttgaacccgggaggtggaggttgcactaagcccagatmgcaccactgcactccagcctgggcaacagagtgagactctgtctcaaaaaaaaaaaaaaaaaaaaaaaaaaaaagcgaaatggtaaagaatggtaaagacctttctgatgtagactgacagctaacccargactgaagcataattttacagtctgatataacttggacagaatagcaccctgcaccctccccgaggtttcawgtgtcctgggagaactgtsttctgcagggtatcagcttccccagaggaggcagcctggccccgctctggcaccctgactgtgtgtccttggggaagtgatgtaacgtccctggacctcggttttctgggtagagtaatggcgtattcctagtagggctttgtaagcattaaatgtgatccggaatctgtgagcccttgcacacgaaggcttccgtgagtgctaattattacttgtggccggtccttctgggctgccccttttctctcagatccgggacacccacagcttgaggaccacagcgttccatgggcagcaggtgctctactgggagtcagagagcagccaggctgagatggagttcagcgagggcttcctgaaggctcaggccagcctgcggggccagtactggacmctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggytggaggtggggactctggaaaagcagccccyatttcctcgggtaccaataaataaaacatgcaggctgaccggcgtttttttcttataagctgtccagacctggcttgaaaacccatcccatggcaaggcagggattcgctggccgcggttggctctatcttgatctgagcaagccgctggacgtccctagttatcttcttcctatccaggaagaaaatccaatcaggattccactccgaggatggcgcattagccagctccctgcgaagccccacccgtgtgtcctggtgtgaggctctgaccgctaaggtgtctgcgcgcctccaggccccgccccstatgctaataagcgcccgcctcctttgggagcaagtcgccgcaaactgcgagcccccgccccctacgctaatgacgcccgcccccctcgggcacacctctccgatgcctgcgagccccgccccgtatgctaacgagctccccacccccagctcctcgccgcagcctgcgggtcccgccccctacaataatgagcacctacctcccctcaaacgcccctagtcgcggcatgagggtcccgctcactatgttaatgagcacccgcctcccttcgggcgcgcctcgccgcagcctgaaagccccgccccctatgctaatatgctccctctcccacaaggcagcgcgccggctcggacgcggccggctaccgagccctttgtgagrgctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctgtgagtatccagtcggggagaggggccggccccgccgcgcatgcgctcctcgccctgccctgccccgccccgccccggcggccccaggggaaaggacccgctgggggtcgggggtctgccgggcgcctcccggggcggaggaatggcggggcygccgggagccggcgtcctggggttgccatggttacccgctcgggcctgggcgccttggtaccccgggctgggctgggctggcgcttctgggaacattcccggagggaccagaaaccccakggcgggggggcggcgggggcgggggggcggcgggggcgggggggcggcgggggcgggggcggggggtggggcaccggcctggggcacgtgactgagccctccccccgctccccaggggcttttgtgagactttctcggtgatgctcacggggcgcatgcccacctggcccgtactaaagcgtcaactgttgacttgggcgtaggtgacggcagccacattgctaacctttgggcaaggattgtttgtaagggaggcgggtgcacggctggctagatttctggcaggaagccactgggcggaagtttgctgagggtcaggtggtgtcagggcacaggtggcccctggggccgcggggcagtgagctsagggcccggcctctccctgggtcctctgtccgctctcatatctcccccgttgctgctgccttagccgcctgtcaccggccttcctccccttctccgcacgcatcccagtcacagaccctgaccttaggctgccagggaagctaggctcttaagcacagccagaaaaggacaaagagggaggcaggtcagctccaggagtgaatggaagccgtacagctggccttccagggaaagacaagtctgtctgagtgataccctttcctttcctgtctgccctcaatcttgtggattactggagtgggcaaggtcttagagaatgtctgtcgaggatgtctgcaggktttaaacagtgcctgcctggcagagagggctagctctgggcctgggcagggcaggccccatcagcaatcctgccagaaggaccaccttttcagggtcaccttgggttccacagcctttccaggtgggtagagggtggagggaggttgaggcaggagggtgctgggctaggagtgtgctgccctcgctaggcatgcccttatccagaggcaacggatacggtagggcaggccctacccccaaatcacaaaaaggccccgagtttgtgtcactgctcttcagggcaagtacgcttttgactttgtagkagagactggtgggtttgaagttaggcattggatccagtcctgtcatgtctggttagctgttttccctgcagattagggtgggcagtgcagtggggtgacatggtcagtggtgagaaaggaaaggtcctgactatggcctgtaggccacacctccttccttcttggtcagtggccctgccgactcccagatttgctgtggagtcttactcagttctgtgcctctcaaagtgaggtacctctgcctttcctgggagttcctggggctctgttgggtctacagatgaagcttcaggagaaacttgyggcattgccctgagttgtcagttgcatctgcagatttttgggggcatggttatgtgaacatcaaaatgctgtattacagggtagaatgcaaaaatgcagggtgttttagagatgcggcaggagttcagacaagggttgtgtgccgggctggtccttgggtaaggttttcctcctccagggtgaggggatcagagagagtacctggagagggtctaccctgggtcctaagagcatctggaggtgataccttgggaggggacaggattgcatggtgacagccccctcacgtggaagatatcagcattgaggcccccaagtggacatcctccagccctttattgctaaaggattcctggctggagcctgctggtctggcttgacacctggtcctcccccaaggctggctgtgggttggacagctggggtagggttggagctggaggccaaatgctgactgcagcaggaagcacagccgagctgtcaggtgaggccaggcacagcagagaggcagggagccgtgtcaccctttgggcactctgctaggacaggcaggcccctgtgtacctgtggttctggaacaccttgctgtctgaaggcagatgtctaaggctgtgctgaggagcagtgcaacgcttgagtcctttgttttagaaggagaccctgggggcccatgaagcagtcccattgcagttcggctcactttatctggcttctttgcctgctgtctgcataaggttacctgggaaaatggaaaacagcagaattccagacccaggtggagggatcaggtgcagaggagctgctgcaagtttaatgagctgggtgctaattgctgcctccaaggcccccctcagtgatggcctgggcttgctccctgcccagcagccacctccttggacctgccttgaaggctcctggagttcctggtgaagccaggctgcaggctgtgggtggaggagggagttgggtgcaagagaccctgctggtgaggtgcagctgggaggcggggcgtcaaggctgcacatctgagcatcagagaagccacgttctggggtggaaaacgatgccccctccccttcctggccttatggcatttcagcggtgggtggctgggctgtgggacttgctcatgtgcaagaggagaaacgggtctaggaagatgaagatagcgtgccagtggcacagggctggtgaggaagttagagctggaactgctgctcagtcttacctggttcccatctctgttctgagagaggcaccccttgtcccaaccaaaatccaagccacattttctgagtcagaggacttcttgtgtggccggccctgtgaatggtggcaagtgacccttaccgaaggctgagtcttgggggagcactggcctgaatccttgagggacattcactctttaatccttctttaatcctaacctccctttgaggtggatattgatgtagctggggtcagagggccagctcctctgagccctgaaacggggagaggatgctgtgagatccacctgccaccttgctgccaccttgctgtggggcctggggcaagcaaggcactgcacctctctgcgtctcctcacctgtctcagacgatagagggcaggcttctgggtgctgtgagaactgtgtgctgagcatccgcagagactctcgtcctttccagtcatctcccaaggccgccttcccagcgggctccgcctgcctccctgctgactcctgcccgtgtctcttgtttcaagcttgcgcgatctctggcctcttcaactgcatcaccatccaccctctgaacatygcggccggcgtgtggatgatgtgagtaatgcatggccgtcccaccccgggggtcttgctggtcgggaatctgctgggcacctcccgggacagaggagtggcaggggccgtgggagtgggcatccttgtggttgccatggctactggctccagcctgggtgcctcgggcatgtgagtttctggccacarcatgcggcttcttccccttcatacccccaccatgtttagtttcctaatgagaggtcaaggcccagggaatgcccaccccggccttcatccggtgcaggggcaaggccatcagtgctccagacatttctggagcatccactgagactgcagatgccaagtccactatactggggccctcgccctctgggagctcccaggactggggtggggaaggctgttcattggggctggctgaggactgggttgaatggtctgctgggagagggcactcgagctcggagctgtgccaaagatagatgggagaggcgggtcggagttgtcacgggaacccgtggtcagaacaccctcatgtgcgttccatgcccacctcctgccagggtttcgccatcccatcggaagggaaggcggggtgagggcaggcccgtgtggcttggggcacgtgagaagtggcggtgcaccaggaattgatgagtgtcctcatggggcttggtgccttgaggggtacagagctagacgagattcaggtcccgtccccagtgacctatggccagtggagagcctcgggggcctgctgtggtggggtcctcagtgcttgtgctggccagtggtggatagggaagggggatggacagagaggcgcccagcccagcttcagggggtggagtcggagcctggccgagtttgaagtggaagggctggcccagcacagagtgagcccgtgcttggaggcctggtgtgtgggaggctcggggcgggtgcagtggttaagagttgtgaagagagtgcctgccccgggcttggggtggctcttaggtgtcctgagcctgcatttctgttacacaggcataatgatggcacttttctcccaggcctggggacagaagggcctggctcagtgtctgctaactgattgttatccatgcatagagaataccaagaccacagcagacaccttccgtcaccagtggcttagctgttcccaccccaaacatagggctggatgcaaggacttgctaaagttcttcctccccagcgtgggcttcccctgggtgtccccgggcctggggccggtggcatcaggtgtgtgggcagctctccgtgactgtttygggactgcgtggctccagctctctgcctccctggtggggcagccttcctggtgctggtgccactgacggcttttggtggccatggcgataatactaacagcagacagaggacacagctgccagtgctccatctgtggatgaacctgccgcagcgttgtagcagtgccatgatgtggggtcccctttcctccatgtcacacaggaggaggataaagggaagcagaagcccaggggcttccctctaggagtgttcagttcagctggggagatgggtgtgcaggagcagctggggagtgctggagtcttcagcagaggctctccgaggggtacgagcaggtgccctggagcagccgggcggcttcccagaggaggagggatgagggcaggagggtgagggaggtggcattccttatggcactggcactgggggccgccctcatcctcctgggattgtcagtcgctgctcttctcctrccctggtccctgcagcatgaatgccttcatcttgttgctgtgtgaggcgcccttctgctgccagttcatcgagtttgcaaacacagtggcggagaaggtggaccggctgcgctcctggcagaaggctgtcttctactgcgggtgaggggttgctgggcagggtcccgtgacacagttccccaaaaccccactgacaaaataggacccaaaagtcaggtgagggtgggcagtgtattcagttcctctctgtggaagtgtaaactgggattgcctttgtgcacagtgatttgctcatagctgccaaaacgtgccccagtggttctgcgcccaggaactcagctgtcgctgtgccgtagtcactggaaggttcagaggtatatgagcatgtgtggcagcatccgtgcagtggagagaaagtgggaagcgtctggaattttggtccgtccactgggagttgttaaccagatgatagtaggtctgtaggacatgtttctctgcagcctttccgaagagtgggttcatctagatgtcctgacgtgaagggggagaagcaggttgcagagcagaaaatgtggttgccctctaaatacacttgttaaaaattttcccatttctaacaatgaaatcaatatgtaatacttctcctctcagtcataagaaggaactaatttcaggataagcttaatacacggaaactcctagaataatgcctctagtgcataggaggctggtggcagctgtattcattattgtctaggttatctttagaaagaagtctagatgcaagcttgcttccccttcagagaggcccggtagttttgatggtaagagcacaagccacatgcttagttctggagccatcttgtgccatatctaaatcacgaagaacacaggatcacaaagctcttatctacacgcagtgtcatgtccttaggggttcaaaaaactgtattttaaaaatgctagacatcatagaaattcattcacaataatttggaatatagaacaatgtyactcgaagcccgctgcctgctaatcttctgatgtgtgtgcttcctgtctgcaggcattttttaaaagcctgcttttaacacagttataaccattatgaataagtttgtatcctgccttttttcacttagagtaatgatataagcatttgaacatcaccacagactttataacattctttcaatacaggaatattcattcagctggatgtatcatgctgttcttaatttcttaactggtgtaaatcgaggtgtgataaacatgtgtctgctaaaactttttctgtrtttatgatgatttccttaatatctattttcaggtgtggaattactgggtcaaagattctgatcattaaaaatattttaagatgcgtggctacrttgctttccaaagaggtcccttgagtctctcccccgcccccaccccagcccagggctgcmcaccacttcacattcgcatttatctatttgttatctaagagggaaaaatattttcccacgtgtttccattgcattttctgatatgaaaattttcgagttyactttttaacctgtgggawcctcagtgttctgcttagcaagttcagtgtgttttctgtattaaagatttcatgatccttggttgtatttcctgcaactatttttccaggctcttgtttgcctttaattttgtttttgtcagaaggttcyccgccgtggtctttttctttgtaatttctattattattttatcattttgaaattttttaacgacagaaaaatctcacaaccacatgtctacaagaatggaaactgaggtagaatgcaattggccacgagtcttgtcctcctgcacaggcagcctcctctagggaggcgacaggacagagcgctggcctccaggctgcaggtatcctcctggcccagttagcccaggaattgctgctggcctggaaattccagccaggatggagaatcagccccggggacgcttaagccccagtggaccctgccaccagstgacgccaaactgcagcaaggtctgggccgaccccgcagaccccgcagcctgcagccctcccatgatgagaccctgtgttccatgtggttgaattccagggaccttacttgtggcgatgtggctggtgttactctataactcagagcatttatttagtgcctgtggtggtcagcattgtgtaggtaacatgactgacctcggacaagctttgatcccctctccgcggtggagattccragtaacttgcccgcgaagctagtaggtcctggatgggaagccagattctctgtcacaggcwctttctggccagtttttctcacagtgagggcactggaccatctcgttactgtttagctctttttgggatcacagaccccttcaaaaatctgatgaaagctttggatcctattcccagaatggaacagttttacagacaagttcagggctgatgaaggactttctgaagctgtgtctcagttgatttttggggatccttcctgtgccctgggtgtctaggaaggatgctgggccgagtctgggaagcggggaaggatgtggtggctgtggggccggagtgcccccttgacctctgctttccccccaggatggcggtcgttcccatcgtcatcagcctgaccctgaccacgctgctgggcaacgccatcgcctttgctacgggggtgctgtacggactctctgctctgggcaaaaagtgcgtctgccaggcccagcccctgggcagggccttcctccctccgccccccgaagtccttcagtgaggaggatctgagagtggccccttttagctagtggagaccgaggcagaggtcccagtaactcattggtgcctccagggctcagctcgagtgggtgaagacagaggacttacaacacttctgcgtggcccagtcttgcccygtcacggcctgcagcaaggatagcaaaaacatggctggtgggagccccttcccctcccaggtctgcaccgggcattgtactyagttgccaccctctctcctgcagagcccagactgaggctggttccttcrcagcccagcatcccagggagcctgggccattctcagaggrgacaagacaggcctttgccaccccagcagttgtctctggggaaatcagaatgcctgcaggtcacacctgggtcacagggcaggaaccgggcagtggtcaggagggctgtgggcatggggctggtgctccacgtgacgctgcctctctctctccccaggggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtstggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcytaaggtgcacyccggtacctggaactgcagccttggcagtgactggacagctgggtgggggatgctccctgctggccctgggaaccttggacaggccacctcaaggcccctcggctgcccctcctccctgggcctgctggggcccctaggttctrcccatcaccccccgcccctgctggccttggtgctaaggaagtggggagagcaggctctccctggcaccgagggtgcccaccctctccctggtgtggccccgtcaacatcagccacagcccagccccattagtgggttagygggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggyttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctycttgtttgttcctctgtgttctgtgtgcgtcttaagcaataaagcgtggccgtggctcgcgtgcctgccctctgctcccttctgccttggtgcctgtgtgtgagtgtggaagccaggcaggagccgctggcccaggaaataactacaggtcctgtcccgaggctgcccccagcatcccagacaaggaaagtgacctgcccaaggtcacacagctagaaagagcctgttaagggtgggcctcgcagtgggcttcccctcactgcagccttttccctgccctgcttttgctatggatcagcagtcagtggccctggcaaccttggctggttcgggtctagcctggctgctgtgggggctcctggagtagaccccactctttcctcgctaggactacaggtccagttcctttatttttacaaaagggtgaacacagtttgcagataggagctgcctgttcccagaggttgggctggggcaggaggaagtggccacgccaggtcctttgccctggcttttttttttttttttttggcagggggtggggacggagtttcactctcgttgcccaggctggagtgcaatggcatgatctcagctcattgcagcctccacctcccgggttcaagcaatgctgcctcagcctcccaagtagctggaactacgggtgtgtgccaccacacccagcttttttgtattttttagtagagacggggtttcaccatgttggccaggctggtcttgaactcctggccttgggtaatccacctgctttggcctcccaaagtgctgggattacaggcgtgagccactgtgcccggcctgccctggctttttaagtccaggatgttccctgtggtgcccataagacttgtgagggcaaagccgggtcttccttgcacagccagatgccaccagatcagagcgcgatgatatgactacgttacttggctgcctccagccctgtcctctcagtcctccccgtagccttctgtggggcgtgtccttcacgcaagggaaagggactaggcctgaggtcacccagcagggccgtgtccctggatgcagggttgtatgcactcctgyrgcccatggctacgtgcagcactgtrggctgcctgggctggggctgtggctggacagcagtgctacctgtcccgagccaggggcacccgctgctgaggccccatcacactgctcttcctgtgctctggctggtggcagggatgactgctgcctcttggtcccagggtgcaggtttgtagccaacacagaggcccagccactgggggtttggccccctccaggcggggaccttgacctagcgcaagaaggaccttctccccrtgcggaagaaggactcgatctgctccagggaccgtcccttggtctcgggcacacagcagcctgtgaacaccaggctcaccaagcagatggccgcgaagaagaagaaaggcacctggaggccgaaggtgctctgcgggtgaagagcggggccgggtcacagggagaagctccagggtcctcctgccccagaggagctcgtgggcgctgctggtagtgaccagccctgtggggccttcatctggtccttcctgtgttcagagaccgcccccccacaccagggctcccccactgtccccaggacaaatccgaagtagcccttgaagtctgcatcccgtctgcccctcggccttcctcaggggctgggccctctggcgtcagctcaggtaccccctccacaccccctacccagcgctggcatcccagctgttccatgccgcggcctgcaggaggcccgccctgcagcctggtgggcacgcaggttcttcttggaccctctaggctgatggactcactctgggttgcctgccctcccccaacccccctgccctgaccactgcagggacagcttaggcgctggcctaggctgccctagccagcttctccctcatgggaacttactctgggcctcacagattctggctggtcacagggcccgtagttttgaaccaggaggcagggggagtgggtggggttgaggggggagtgtggctgctgctgagacccagcgcccaggaggrcgggagatgaggcacggtggggaggtggcttccggggcccctggcagggtcctgggccatgtcctgccctggcccaggaggtaacctgacttcccagaacagttgcctacgcccgttcctgtttcttataatgaagagcgtttgctaggctatcacgtgaccactctggggtctctgagttcagggggtgtgtgctcatctcctagggtcactgagagttagggtcctgacagcaggccttggcacagcccctggcactgagaagggtcctggccagtcagmgagggcctaggggcctggggcctggggctgaacactcaccaccactggcaggaaggacttggtgaggacgaaggcggtgagccagctggccagcacgcagagccctgaggccacgccacgggcacgcaggggcaggacctcagacatgagcagccaggtgatgggaccccagcccacggcgtagcctgctcggaggaggaggcaggttcaggccctgtggggtgactggaggcggctgtgtctgtctccgctgagctgctggagacccccctctccagccaccccagacacatcacccatcccttaacacccaagacagcctgcccctctgagccaccaccacacctacccatgatgaagagcatggtggccagcaggggcaccagggtgagrtagccagcgggtgctgcmaggggctgcgccaagtccccccaggactcgctttccaggcccgcagtgctgttggggctcagaggcctggggccaaagtggatgtacagccccagagtcaggttggcagcaaacatgatggccgctgtggacagacaggtggcctcgtggggccaggaccctctgagccagctgtttctctcagagctccttctgcagagccccttgatacttgcgtggtccagctcgtgtctgggactagagacccccagcagggcagcaagctctgtctccagccgcgtgttaggctcccaccgtggagtgtcacagccagtgtgtccactcggagccccagcggacctttctggaccactggcctgggccagggccctgccgatgctagggaggcaggtgctctgcagttcccagccacacmgccccaccccgaggcaggcctgcacacccagcccagccctgacccatgcggaggagtggggcaggagggctgcctgcagggtgcttacctgagacgaagagcagcaccttgcggcctgcgaggtccatggtgagggcggcgatcagcacggacaggagccgcacggcyccaacgatggctgcgtcgtccttggggggctatcggggggagaccaccagggctgagggacctgcctgctgttcccatccccctccaggacccagcttgtcccggcaggcattgcaggggctcaggccagcagctcagtgcagtactgagtggcctggcacctgcagcgtgctgggcatctatactgtccgagcctatggggctcctgggcagggacacatctgctctgcccaccactatgcccagctggcacagaatccaggcgtgatgatgacttgctgaaccgtgctgttactaatcttcaaatctcatctcactttgagccttggggcaggctgatggagatgtgctgctatcttcatcttgcagaggaggaagttgaggttcagaggggaaagtgacttccctcattaagtggcagatgccacagggctctgaacctggggtctgtggcctcaaggggtccacgtttctataaagctggtttcctttgtaatcccatgtattttatttaatttttaaaatttctatatgtttttagagacagggtcctgctctgtcaccaggatggagygcagtggtgagatcgtggccactgcagtctcacactcctggrcttaagtgatcctcccgccttggcctcgtgttgggattttgccagtattttattttaaaacacttaagcttatcttaaaaacattctgagaacaggtgaaggcactggaactgtctccacaaggcccagatctcagatcttgctgtggcatccctgacaccyggcacagagcaggtgtgggtaagaccaggggttgggtaagtgcaggagcaggccctgcctcccctgccctgccagcctccaggggaccccgtgggtgggcgccggccggggctgggctctcaccagcaggacagcggtgctgtcgaagatggactgcaggtagaccaggatgggcgtgatgcccgtcagctgctgcaggagrcgcatcagcaaggccacggtgatgggccggcacacgtgkggggcccgtgcctcagcccacgatactcggctgctctgaaacacaaggccgccgctgagggcgttgggccagcctctccagcaggcgccatcctgccctggaccgccaggggttgtgtgggagamctcctttttccctcctccaggaaagaaccagcttaccaggccacccaggctctgggaacagccccccaccccaacccaggcacttggattagtgggaactactgtggtccygtcttccaggaaaagcctccacggccacacacagctgaagtgctggaggtgggcctgcccggttcgggcgcacaccctcctgcacctgtctccggacgttgtcctggatctgctcgaactcccagtggacatcgacgtccgtcccacgcagccaggccagcgcccgcagggcctcttcgtccctgccccgagagagcaggaagcgcggcgagttgggcatgaagctgagcagcaggatcatgatgagcacaggcgcctccccggccacagccagccagcgccacggcagcaggaggcctgggggcgaggggtgggtgaggggccaggtccaggcctggtacagccccttccctctggagcctctgaataacctcatctgcccttcaaggtctagtccaagggccatctcctacaggaagcctaccctgattgccccaggcagggtggggctgcagggattgctcagcccctggcacatagtgggaagtccttggaaagtcttakggccagggcaggatgaggaaggggtaggttgggcaggcaaggccctaggcctccacccaagacctccacgccccctcaactgagcagctgcacgcactgtgatttcttttctatctggacttcccatctgagatggcatttgatggaagctttctgccgttaaaagatagtctggcgactgtgggtccaggagaagccctggctgccccagctagagactgggcctgtggctagaggggcaggccctgcctggaggtgcccagcaaggtgctgactgagtggggccgggatgccagatctcttgcctctcagcccaggatctgttctgggacaaatcattccctttccacccacgtctaccttggcggcacccacccctcccaccagcctgcacacaggagtgcggggccatacttgccaagggcgtagagggacagggatccgaacactgccatgagctggggtgtggcccccagagccccacgaacgcctgggggagcaatctcagacacgtacacctgcaagacacagccgccgcaccaggttttgctgaaaatactggttcctaggcccggccgagatgggagagtcagcccctgtgaaccccggaaagtgggaagtggaggctttctggtggggctgagtcctggtcatgactcactgcaagaccttgggcggcctgcctgatctctctctgtcctcagtttccctaactgtgacgtgggtggaagtacgcagctcggaaatgggcagcatgacgctgggaaggaggcccgagggctcccaggcttcagggctgagcaggtgagtccatgcctcccagtgagttttgtctcctctgctgggctcaccaccaggccccgtgtggagtaccacataagataagaaggtcccggggagggtgtagggcagggacttccctctcctacccattgctcaatgcggatttt

SEQ ID NO: 13452 - DNA, 13395 bp, Homo sapiens
tgggccggtgaccacattcatctcacggcccatccctgggggaaggctgaggatgaggggaggtcagagcccgggttccgctccaaattgtttctcgtggctgcagctggggaatgcacgcaacrgcaccaccctgtcccgaggagagagmacctggctgcgctccctgtcccgaggagagagaacccagcacccctccctgtcccctgtgtgcttcccccgcccctgtggagagagaacctkgcccctcggggagggcactgggcattgatgtgagcgcagcctccacaactcacctcccaagctcatcacctgcgggctccatccctgcgctgccagaggtcctggccccgccatggctcccaagtgcaccgcccggggaccacatcacaaaagacccaccttcccagaccccgagccaggtcttccagacctcaactttaaaaacaccgtttcgtagctatttttaaattttttttctggaaatattgataccatgacgctcactgtggctgagtactgcctctcaggaattctgagcaaactgttttgaaagtgcctacactggccgggcgcagtgactgacgcctgtaatcccagcactttgggaggccgaggggggcggatcacctgaggttgggagtttgagaccagcctgaccaatatggtgaagtctcatctctactaaaaacacaaaattagctgggcgtggtggcacacgcctgtaatcccagatacttgggaggctgaggtgggagaattgcttgaacccaggaagcggaggttgtggtgagccgagattatgccattgcactccagcctgggcaacaagagggaaactctgtctcaaaaacaamaaaaaaaagaaagtgcctacatcgtcaccggcagagcgctataccacagtgtgcagtgagacagccttgggccatgtgaaaagttgggggtatgaatgggacgcagaaaggttccattttgtttttttttgttgttgttkttttttttttgagacagggttttactctgttgcccaagctggagtacagtggtgtgatctcagctcactacaacctccacctcccaggtcaagcaattctcccacctcagcctcccaaatagctaggattacaaacgcgcaccaccacagcctggctaatttttgtatttttagtagagacggggtttcaccatattggccaggctggtctcgaactaccgacctcaggtgatccgcccgcctcagtctcccaaaatgctgggattacaggcgtgagccaccgcgcccagccctaattattgtattttttgtagagacaggatttcactatgttgcccaggctggtcttgaactcctgggctcaagtgatcctcgcatctcagcctcccaaagtgctgggattacaggcatgagccacagcacccgaccttgtatcattttaattaatttaaaattaatcgtaagtagccacatgaggctagcrgccaccagaaagcacagccctggtgtgctctgggacccagtcgggcaggcacccctatgctggctggagcctggggtcgccccacttctctcaacactgatgggcatgagcattcctcaccccagggctctgagcacctcacagatggggggttgtgccaccctagcagtccctgccccctgggaggctggggaaccctctcctcggtgggcagatagggagacccaagcctagggaaggaaagtaactaactcagggtcacacagcaggggcaggaatagcaacctgggctgctggactcacaccccaatcattcggaaggtgggcgagcccrragtccctttggcttggggcatgtaggtcattttcaggtaacaaagcacttcccctaagcctctaaataaggaacttattttagataaaatcccccacaagggtcctggggaaattcctgtttcctaagtaagcagaggttgagcattcagacactggagtcagacctggggacacttcgagctccccggcttactctgggtgaccttggcacctaactttaggtctctgagcctcagtttcctcctccatcaatggaaacagaaactacatggcttcacgagattgccacrgctgtgcatagcctcagtgtggggcaagtggcaactctcagcaaccacggggttaygcttatctgggtgtaggaggtgcgggtactgctggagcgkggtaggggggacacggctgctgtctctgcaagaggaagaggataaccagcctgagagcragagtgtgagtggggggtgaggtgggggtggggttgtcgctgtggcaggttccagagctggctaggattcccaatcactgccgctcttgggcmccaggtgaggtacttatctgggagtctyagtttccctgcccgagatyggcaggctacaagtgccccccaggygtttgggcaggaccctgggacccttctctgggctggcaattgggtgtgatcgcgggaagaggcttcttgggcctgctccgtgtctactgtcacctaggctgtaaagatgacagagggccggagyggctctccaggctggggcctggcatttcacagcgctagcgccgtgacttatggaccacaagaagctgtgatttatacaacgtgaggcagagctsctgggctcgtgasttcccttctgtgatgaagtgaagtgccttgcagmagcagcagccgcttagctgatgcgaggggactccgaggcccatccatctccctctctccccatgaggctgggcagcgttttgctgaagtggctgaacacaagtgcatctgttactgtctccagaaaccatcaaagagctgaacttgtccctgagaggcagctcagagggcaggmaggggagacccacccaggccagctgaggcagcttcaggacgctcagggggaagcacttggtaccacgcctggcacagggaggaggctcaggagcaagsttctctctcctggagcgacggcccggagtgcaaacatacccacctccagtgggtgccagcccaagtgtgagctttattggctcattagcccgcacggcatcagcctggttttacagatgagaaaagtgagggtcaggaatgtgaaatggcccgcccaaggcacactccctaagtggcagaaccacgcggaaagcacagccctgactccaccccggtctgttcagcgctggccccaccggcagagaagcaagctggtgctaataattccaccccacgtggaaccggcgcccagaagccccgctggatctttgccgcctcgtcttttggtgatagttgttgtcagggcttccctttaggtgggcgaaaatatctgtttactcaggaatggagcaatttcccaggcgagtctctaactagctaaatgcctggtcctgcctccgtcgcagggaagccgcccactgtgaaacacgagccactcagcagggaaatgtttaagcggcacccgcacccgctgcacaccgggagcagcggggcgggggcgggggygttcccggtgattccacaccccggcccagcatggtgcctgtcccagaagccaggccacacccagtgaggcggaacagggctggcggagggctggaccctggaccactgtgcrggctgtccctgcactgagtcagccgggtttaaatggacgaggtcgtggtccactcggtccagggtaggtcaacagggcacccacaccctctcagccatgcaggggaccctgggggaagaaggctggattggaccgtggtctcaggcaggggcgtggtctggccccttcatcctgggcrtgcagkgctgttccatggggatcgtcgcagagtagagtgcacagtgccggtgtgagcccacagggacagcatggaggagggggaggagtaggtcccccctcagcctttgcccccaccaatgctgacaacggtggggccagcagggcttcggccctggctggtgggrcactgtggggtgggctcttccagtgtggagatgaccttgggcaggggctgcarrttccattcaccctgcaaggaagggggcaggaggtaaactgaggctggargggcaagatgggtggctgcttccccagccacttcccagccacctcttggattcttgccctcaaactcagcttgtctcaaactgaactcactctgctcccccaagttgctttttgggggtcctcacctcagtaaatgccccctcccctggcttcccattcacctagtcaggaacctgggagtcatccaggcctctccccgcctctgtccccacccaatttaatcattcaccctartgtagcaaccagagcccctkgctgcaggctctgatattttttagctatctcttcccctcaaggctacaccaaatgccaagttttcaaccccatcagacgtccaccccacactattctcagcaagccagtattagcccttccttcccttggtgctgaggatgtttgacttagcagttaatcyggctcccaaatgcttctgggaaggatcttcctggatctccaggctgcggcaccttaygcgactaactctgcataggccctggsctcctgaccacagcccagtgggcccaggataaattagatgccttcgaataccagtgggtctcagataaggaggaaaaaaccagctcgcagcttcagactggttcgtttcttaccttcccctcccctrgtgctttatttttaggcaggttagtgcgccctgctcacaccacctgcatttggcattyggtacagtgtggaggtgtcaccagagagggtgcctgccctcccttccttgcctcgttattggttctctctctctccctctctctctctctctctctctcctctctctctcctctctccctctccctctctccctctccctctctcctctctctcctctctctcctctctctcctctctcctctctctctgctggctggctggctgtctaggcctatgtgtcaccacctggcacttgctctcattgtcttgtgcgagtgcttttgccagcagtttggagtgcagrcccatcacccctcactggggccccccatgaggcctgcctgactgcatgccccacccgggcccatggcagcgcacctggaagcggacggctgaggacttgttgcagtgcatggagatgggcgcgaagctgyacagggccttcagtacgtcgcrgttgaaggagttcsagggaacagaggtgaactgctgagacacggacgcctgagggcaggtgcagacatcctcgttgttgaacctgsysgggacaaggaacagccaggctggggagcagctgacgggcagggagcccagtgggcaccagcaacacctccctgcaactcgagtcctgtccctggggcaaccgtcctgccacctcctccccagccccrctgcctccgccaggccaccccagatgctgccttcaccggcaacggcctcacctctcctgtcaccttggcgggtgggtaatggctgctgcaggctgggttgaggaggctctgaagccaaatccagactcagcaggaaacgagtgaggggaggggtgagtgatgccgccacaggtctctgctcctagaacttagcctggactcctccaatctgcccagccgcctaacaggcccgaggttctgtgtcggggttccctgggggcagggagcttgtgcagggagccctcacctgttgatgaggtggaagtacttctgcaggaagccggcgtccacagcgctcttgcagagctccagctgcgtctgggggtagtagtgcacgtagttgacacacatctcctccaggatcccgaagcccccctgcaagttggaggagacccgtcagccccgggccatgccacgcagacrctgccatccagcagctttcgccgcacccacgtgtacactgcgtccactcgtctgttcactgcaccgtgccaggcatgctctggggaaccgagtccctgccctcaaggaattgccaccattggcaggagagacaggcagtgagtgagtgagtcaaccaggaaattcgtatcaggtactgatgatgctgtgaggaaaaatgaaacgggacaagcggatggggtgttattgtgcccattttatgggtacagaaactgagtctcagagcaggcaaggggatgccccgtggtggccacagcatcggtggcacagcctgagtgcacccagcgtcccggccattgtctggaagctgtccccatgacctccagcgagagcctggagccaaggactgcaagggaggccctttccactgcagccccgcaccgtccaccagtcatttctccaacgtggctctgaggggagcagggactctataagacaggaccgtgactagaggccrcgacaacctccagcctctcacggcaaccctayggcctgccatcgcatgggaggggcagggcaggcaccctctgagtccccactgccagctttaagcccctcgctgggttgctgctcttggagctggtgaccgtggagcctcagccataggaggaagaacagcagcagcttggaggagctggggctggagagagcaaagctcccccggcagcagctcagatcccagcaggtcaggggccgggacatgacgccctggccacccttgcccctccaggctccccgctgtttgtgaagctgctgtgggcctggggatttcatctggctggtggggaagaaaggcaatctttactctatggcagaacaaagggactgggcaaagcttggcgtggcacttacaccagctgccgccccctcctcccgtgcagacaaagagcatgggrcagttctgcccagagacgaaacctggcacctgttggccaggacgcgtttttgccagcattgttctctgggccrgattcctcctttcccagcttttctcatccatcccgcccccgtcagatcgggaygattgccctcctgtgtgagttcctgtccctccccaccctctgccaccacagacatcaaaagggaactgagtccgaccctgtgtagaatctgttctcctctttcacctggggaaggaaatcgaatttcaaaggccactgtgtcttggatcagcaggcgagggcttgtcagagtgtgagaagytcaggtccacctggggagctgccctcccctttgatcccacctggtgctgtgatgtggccactgccaagaggasgacatgggccagggaagccacagaactgcccacggggacgctggcaccgagggcctcaacctgcagaacggccatctgagatgtccgcggtgctcaccaggcctggcagccccgaacgccctgggacgtggcgtcagttccgccgccgtgaagccagattgggcagggaatatgcagtctcctcgctggatgcccggcaagaccctcccatcccykgccccggggccrcgcctgcagaatggggctgatggtggggacttgcctggggtgctccacctgcagagccmtctgtttgcgagcccactcagtcactgcacaggtgcttagccgagaggcggcacagtcggggttggcacctgcacccataccagccctgcctcctgttcgctgtgtggcctgagtggctggacctcactgtatctcctggtgggattgctcagaggtctcagcaaggcttggtgtggttaggatgagttattagagcagtgctgagctgtggcaagcacccgacatcagccactgctgtgatatactgagcacctcctctagagagaataaaggactgacaaagctgtcctgycyccaccctgagtttgtgatcaggaacctaggacacttgtcacctgaaatccaagggagacaggaagggtggggtaacagctgtgaggcacaagaccctgggtcaaatcccrgctcagccatctatcagctgtgtgactttggtcaagtgcctgccctctctgagcctttatgtctcacctgtgaaaatacaaacactggctgggtgctatggctcatgcctgtaatcccagcatgagggattacatgaggagtttgagaccagcctggccaacatggtsaaaatccatctctactaaaaatacaaaaaytagccaggcgtggtggtgggtgcctgtagtcccagctattcaggaggctgaggcaggagaatcggttgaactcgggaggtggaggttgcagcaagctgagaacacacagcctgggtgacagagcgagactccgtctcaaaaaaaaataaaatataaaataaaataaaataaaccastggcagtctgggctcagtaaacatcaggtgaatccacattggattaaaacacaaagaatagggctgtgacatggacctgagttcctggcgctgagggatgtcagggtagctgtaacccaggtctgctccacttgagccacacaattcacaggataattattggagaccaccatggttaccgaagcagctggcacrgatccactggcaaggtgkcccatttgscaggacagccctggcttgtgcctgggacccaggtaattgtgaacagcatcccctttggctcccggaagcagccccgctgcgtgatgcatcacgtggctgcccgtgtcctggtgctgcctgcatacccagccttgaaaatagatctctccagtgcagattctccttgaactgtctgcagtccagccaaaatgcatcctcagctgacgctcatcctgcctgacccccacccatgtctccaccctctcctcctctcctttccatcctgagaatgttcttggtcctctgggccttcccgcacgcagcccctgcacagagccttccttcacctcctcccctctcccctgggctccatgtgacagccacatttctgacraggccctcccaggtccccgcacctctgcctcctcaacctggtttttaaagttttgttttgtaattttgcttgttgttagcagcaggtgctccaggcctgtctccctggtgcaccttgagctccacggggcaaaggtcracctcttgtcctacagcttctccccacaccagccccgggtgctgagaagcttcttggtgtgagtgcttctcaaccttgagcaggggtcaacatccgctgggagcttgttaaaacatggattgcccgatgccaccgcctgtgtctctgactcagtgggcctggggtggcacccaggaggttgcattcatcccaagctccctggtgatgctgccactgtggttcagggagctgagaacgactggcttattgaggggacgagcccatgccctaagtgaggagtcaagacctgtcatccttcctcagatggctcaggctgaacaytcgccctgggcaggtgcagggggaagcgggggtgacttaccactgtggccagctcccggtcttcygtgttgtacrtgcaggaggtgatgagcacatctccctgaggaaaagccaatgtgaccatcagcacctgccacctggygttggcaggtgytggaggcctcgcccccataggaccaygccactgtgcatgccacggcacctctggggtacagtccctgtcgtccactacaaggagcccagcagattmatgtgcgaaggtcacaggctgagtgttcccragcaagttataaaccatcagctcctgtgacccagtgggtcacaacagggccagggcccaggccagtgggggtgcagctggtgggccwtgacacatctcaaaggacttgggcaagtccccaccgaggcctgggcttggccytctgtgggatcagggctccactgcctgccttagtgccctcatctcccccaaacactctcgggtttgtggtcggyccatcagactgaggacacgcgtcccctgggagtgtcctgtctgctccactctttccaacgtctctccatgaactcctgagtgagtctccccatgaggtagcccagcccagagccacccacaggcaccctccccctgccctggatggctctccctccccctatcactttctgtgtccctctycttctggtggcacccccagccctctcagccaccccagctggtggcagtgagtgggacagccttcccgctgggcactcaccggatggaccgacacgaccttcttcaacatgcggatctcctggggcaggcagagccgaggggtgggggagaggagacctcagagagctgcagaccagacccccggccactgtgtcctccctcargcctccctgacctctgggggtgtccattttgccccagcctctacagtggaagccagagcccgctaagtgtggcttctggccagggagggcattagattcaaaccagaaggtggttatccaagaccaagattgatgttcccagagggccgcctgggtctcccgaatcccaccaccatctgccatgtgccagaggcctccctacgatcagacaccagacacccaagtggggagcacaggccacatgggtggggggcgggtggggctggcccaggaraaagaagccagcctggagccatccctatggtgtcaggaaacagtagacccaggaggtcgtgtggtggcagggtgtgggggcggggcaggggtggggtgcaggttcctacctggaagtgagggctgtagtgattgtcctggttcacgatctcccactcccggccgtcccggaccagcactgtgaccacctttctcccagtcaggtgtgtgtggagctgagaggcgaagatgtggatcccggagggaggcagtgcctgtggggtcggggggctgcagtgtcagggcctgacccccgaggggaccctcccgtccatggccaggacccggtagggagcagccaccctgggcagtttgcttccctggaacacttgcattttctaggtctttctccccggccaggttagagccaccatcagaaacctcacggggaagagcgaggkggccgcaacagcccccagctcccaaagaagcagcccctagtcccactcaggagcgactttctttccgagtccttcatcctctcctgagcccctgaagcctgacaggttcatcttcactcagtcaacaggcctttaaggcgagcctcccgtggacagggtgtggcaaagccaccaagytgagcagcgcgtggcctctgtgctgaagagcttgctgtccagggaaaagcaagtggcagaaggtggtacttggcaggtcccctacgtggtgggccgagcaggaccttcagctgccctgcgttgtggcttcctttcagcttcaaagcagccaaggctgcattctccctgtgctcagcatcaccccgtgctacagctgggagctgtagctacaactggaaggtggtcatccaggaccaagatggatgtgaccatggggtgctgcagctggacactctgaggctgcaggccggcctcacagaaaagatggcagccctcatctcaagaggtcttatgccatcactggggcatgagagaatcttccagagaacgaaagttttctctaacctaatgctaactttttttagatagaaaatgcatttccatggctgggcatggtggctcatgcttgtaatcccagcactttgggaggctgaggcacatggatcatttgaggtaaggagtttgagaatagtctggccaacatggtaaaaccccgcctctactaaaaatacaaaaattggccgggcatggtggcacgtgcctgtaatcccagctactcaggaggctgagacaggagaatcacttgaacccgggaggcagaggttgcagtgagccaagattgtgccattgcactgcagcctgggcaacaggagcgaaactccatcaaaaaaaaaaaaaaaaagaaaggaaggaagaaagaaaagagaaggaaggaaggaaggaaagaaagaaaggaaagaaaagaaagaaaaagaaaaagaaagaaaaagaaaagaaaggaaagaaaagaaggaaagaaggaaagaaaagaacacgtctttcctgaaatcgagcattttctttgtgagtcagttgtccttttgcccacccgctgccaggctctgcccagtttgttcatgcagtcagcaggtcccagagctcaaggtcccgacagccccatccctgaaggtcccagatggccgagctttttaggactcacttttgctccttccctctcgctcccaagcagcggccgccctgaccttrccgtcgcctatagctttgtgtcccttgcaatgrcttgagaggccaytgtgtgccaggcctgggagcccaaagggtcccaatgcccctttggcccccagaggccgaccctggcccagagatgccaggtgtcggccaggtggagggaggactatgctcttctgggcactctggtccaaagcagcactcttgtcttggcctatttcactgggatagctagactaggccagattttggctgcagaatttgtgcccctcttttatctgccaaaggagagacaagactgaacattctcattctgttacttaaggtagtggaggactctggcaaggggaggcgggtctgtattcctgaggctggagagaggcgttctcacagtcagcggtcagcggggtcgaaggccccaaggccctgcaaggggcagtgagtgctgyctggccggaagccgctcttccccatgagccctggccaaggtgccttttacatgggcccacgcttcaccagtgggcgctttagggaagtgggagagagtgtccacccccgtctgggacaaaaggagctgatttcctgccggagacaatgggtgccatgccggctgagagctccgtctcccttcagccttgaggaacctttgcttggaagactgggatgctctgggggctcasccacatgaagaacaaatcccaatcgacccatttactaggaaggaaaatccactctaaacctcattacaacgaaatctgctgtcacggccacagctttcaaagtcagacagactggtatttgaatcttcmctctgcgtgactgctggcagtgtgatcccagcaagcctcagtctccccatctgtgaaatgggtacgtcaacacttactttgcaggtcactgtgagaagtaaagctaccgcacaggaggaaatgtttgtaacatatacacaaactatgaaataacatccatcatataagaagaactcctagaaaccaacagtaagaaaaacaaaccacctactggaaaaaccgagcayaggaatgaacagaaaacaggaacaaatggccaagaggcagaggaaaagatcctcaagtccacaaatagaaaattcaagttaaacaacactgacatgtcttcctcccaaatgacagaaaatatttacaatattaataatccagtgggtcagtaaaaccgggcaccctctcgtcctatgtgtgggagggagcagaagatgggctttctgaggggcattttgcaagatttactcaagggaacactc

SEQ ID NO: 13453 - DNA, 12405 bp, Homo sapiens
atagagggacagtgaggcctgaggctgcagagggattcaaatcccctggccaggtgtggtggctcacgcatgtaatcccagcactttgggaggatcacctgaggccaggagttcaagactatcctggccaacatggcaaaaccccatctctactaaaaatataaaaattatccaggcatgggggcggggcgcctataatcccagctactctggaggttaaggcaagagaattgcttgaaccaaagaggcggaggttgcagtgaactgagattgtatcactgcactccagcatgggtgacaaagtgagactgtctcaaaaaaaaaaaagaaaaggcagatgactccaaagactctctcaggtgctccgggcctggcacctgctccccaatgctctccacagggctcacctggcagaaggtggggctgtggacagctgacagcgcccggcacagagcgtccacatcgttgaagccaggtggcaggcggtccacacagaggcagcgggagtggagaagggcaggcgtcagttgcccggcatccgtccagtgcacgtagagggtgcgtggtcccagcggcttgcccagcaggtcygacttggcacgggcagccgagtccttcttcatgtactcrgcaaagccatagcccttggattggccagtgcgctcactgtagaccaggaagcagcgctccaggctgccgaagggccgcaccagctcctcgaactgctgctgtgtgaggctggggggcaggttggccacacacagcagggcatccgtgggctgcagctgcaccgacagttcrcgctcccgcaggcggctctggtggaaagcattgattgcggcctcggcctgctccccattcagcagggtcacgaaggctgcggtgggaggagggcagtgcgaggtcagccgggccctgagggcctgcccctccaccccgccaccctgcaaaccaggtgggacctccaaatgctgggcatctcaggtgcctgctgatctgagcagttgccagccttggcgactcacacaggcgagagcgcctgccattgactctaggctccacgaagcccactccctctcccagccctgcgtccacctgcacccacagcagcgctcaccaactgtgggcctggctctgtcctaagaacgctgtgggtcactcgggtgataccaagggcagtggttaagcccatgctcactggggcccagatttaagccccaagccccaggtggctttgggggtatcagtttcctcatctctcaaatggatataacttaatcatcacaatcaccattttgccagagaggaaacgggcccagagcagcacccctgtgccccgagtaggggagcctggacttgaacccaggcagccggactccagaggcccactctacacactgcccacccctgccacctttccaggccaccagtgcccctgaaccctgctgccacgtgctgccccagatttgcgatccacccagcggccgcaggaagctttgttcaaaacgatcacgccacatccatcttgtggcttctagctgcagggtgcagtgcagcctgtgcgggctcgctgacctcccctcccatctcaccgctgccacccggaccacgccaggcacactccagaggggcctttgcagctgctgtttcttgagcatggaacactgagccccacctcctcacctggttaacctggacccacccaggtagaaaccctgtctctactaaaaatacaaaaattagccgggcatggtggcacatgcctgtaatcccagctactcgggaggctgaagcaggggaatgggctgaacccaggaggcggaggttgyagcgagccgagctcgcgccactgcactccagcctggcgacagagcaagactccatctcaaaaaaaaaaaaaaaaagaccacacaagcaggggtgactggctgagtgaggcaagaggggtaagaagagaatgaacccacggccaaacgttgtcaagaattagctcaatgccaagcgagtggagtaggaagagaatcagcccgatgcccagtgttctccaaggagaacatgaaggctgtcccaagatgacaggatgacaggcagattggggcaacctgccatgttggcctggggggcaatactgggcctgaagctcagagcagcagacagtgagcyaggccctcccatcttcagggatggtcactccctgccctggcccrccccatggccccacaaacctgtccctttgtatttgtccacaaaacagtatttgagctcatagtcactgagcaggtcatgtacttcctgtggagatacaagacaaaagacagggagttactggagatggaagggggcaacccagtgccgcttcatagctgccaccagctatgaaggcaggtcaattaccaccccccattttaccaatgaggaaactgaggctcgatgcagtaattttgtcaaggtcattctgctcatacctggcagagatgggattcagaacctagctgcagactgtgctattacccaggcaacatgctcttagagggtatacctttagctggctgggcggggtggcycacgcttataatcccagcattttgggaggccgaggcgggtgaatcacctgaggtcaggagttcgagaccagcctggccaacatggtgaaaccttgtctctactaaaaatacaaaaattagccaggagtggtggcgcacacctgtaatcctagctactcgggaggctgaggtaggagaactgcttgcacccaggaggcagaggttgcagtgtgccactgcactccagcctgggtgacaaagggagacactgtcaacaacaataacaacaaggccgggcgcggtggctcacgcctgtaatcccagcactttgggaggccgaggcgggtggatcacgaggtcaggagatcgagaccatcctggctaacaaggtgaaacyccgtctctactaaaaatacaaaaaaattagccgggcgcggtggcaggcgcctgtattcccagctactcgggaggctgaggcaggagaatggcgtgaacccgggaagcagagcttgcagtgagccgagattgcgccactgcagtccgcagtccagcctgggcgacagagcgagactccgtctcaaaaaaaaaaaaaaaawaaaaaaaaawyamcaacamcaaaaaaaaaaaaaaaaaaagaggccgggctcacgcctgtaattccagcactttggaggctgaggcaggcgggtcacaagatcaagagatcgagaccatcctggccaggaaggtgaaaccccatctttactaaaaatacaaaaatcagctggctgtggtggcgtgcacctgtagtcctagctactcgggagactgaggcaagacaattgcttgaacccgaggggtgaaggttgcagtgagcagacatcaagccactgcactctagcctggcgacagagtgagactccgtctcaaaaaaaaaaaaaaaaaaaaaaaagagtatgcctttagggaagccatttaacctgcatgaacctccttttgcaagattcactgtttccaacaactctgtaagtgaagtattaacaaactcatgttgtatatgagaaaacttaggctaggagaagtgaagagatctgctggaggccatgcagttgggcagcgcagccacccatgggtacctgactggggagcccaccttctagtaagccccacgttgtgtgggttcacatgcctcccaatttcctcctgctgataaagctgccctcttccaagccagctcatttatttttcttttttttagagatagtgtcttgttctgtcacctaggctagagtgtagtagcacaatcatagctcactgcagcctcaacctcctaggctcaagtgatcctcccacctcagcctcctgcgtagctgggactacaggcacgcaccaccatgcctggctaatttttaaaaattttttgtagagatgagggtttcactataccgcccaggctagtctcgaacccttgggctcaatacagcctcttgcctcagcctctcaaagtgctgggattaaagggatgagccaccatgcccagcctctcaagccagctttgaaggcaaagtgctggcgcctgctgggaccagacacactgtgcatcttgcaggagagacaatgtgttcccagctgagagactgcagacactgagaggaagacccagaaagaaacctgaccatccttaatgatccctgtcccgatctgtccccaaattcagcccctcccaacatccctggggttccactagccacgtgcccacccggtgtgctggtgggccggagagcagggaatctcagcagcaggaagcgagaacctatttcacmgccatagggcagggcagtatagatgccatttccctgggtccaaagagcattgggaagcgctgccccatgctggccccatgagaagggcactcctagcaggaagattagccacgaggggctccatagaacacaggcctcgcttccttcctgtaggtctgtaggctggtggcagaagaccccattttcccaaattaatcctgaggttttgggggctgagacccaggggctgctgttaacttccggatttatctctgagagcagtgaataaacgcgtgatatggaggggcgtactctccgcagtcctgaaacttctggatgtgaggycccgccaccctgtggtagagtgggtggagaaaagcatcatccaagcagggggcaactggtggtccaatgtaccagcccattcacaattccccaacaggaccaaagctgtccgcccccttccattccccgcccgcttccatcacttggtgtcgcccaagcctgtggtcgcccctagcaacgccctccctcacttcgcagtcggtttcccctttcatcatcgcccccccacgtcccgctcttggtctctcccgatcccgcgtggatccggtgcttgggcgcccccgccaacgacccccgcgcacctcagcgttggtgtcgcccggttccccccgcgcacgcgcaccgtggtatttcccgccacgctcctacaccgccccccccaatacctggttggtcacgtcccccgggaggccccggatcagtatcttgcggcggttacggaactggcgctcggtgtgttccaggcgtttccggatctcttctggatctagaggcrgcagctcttcttccggcgcccggcgctccgcggcatcgccggcttygacttcggccccagacttagggctcagcgggggccggtgagtaacrgacacgtccgccgccatcttgggaaacccggcgccttctgggaccagcgagccggggcggagcggcatagagcggcaacgagggcgcgcccgtcgattggctgggagaaaccccacctccttcccgccccccttgccccgttggctaagccccagcccacctctcaagagttcaagctgcgtctgcgcgccacaggccccgcccccttccgtcgcagcgacgctactcagtggatgtgcacctgggtgggagagacttgcagcgcgggtggaatcaaaccacagattagggagtttgaaggctttattggtgcggaatctgagggcacagccaagcccccgccaactttgatcccggatcccagcgtcactcagctctggacggttcttcccccattgcttctgtcggctgcatagacgtgaggggcagataggtgstctcctccctaacatggtaactgccgctccgttggtgctccctgaagacgtacattaaggccagtacgatagtcaccacgcccagggtcagtaacaccgccacgaagacggggacaaagtgggagctcccagctgtgcagagaaagcgctaagtcaatatgcgtcccttctgtctccaacccccccgccccccggcttacsggtccagacccgcagccccgtrttagctcaccctcaatgtccatcaccacgaccagggtgtatttgcctcgtgagctggacgcttggcactgataagtaccattatgtgttacgttgacgaagaacgggatccccaccggcacctcccggctggagccttccttcaaacaccgcagctcggggtacgggttgcccctggcttggcactgcaggacgtgtctcgttttatctttccatttcaagtgctgggggcatgtggctcggtcaattttgggaccatctgtggaaccaccatgtgtgatcagacacccaacacacccgaggcacagtggtgcagaggagcgtctaatctttccagggmaggggtggagggattaaaggtcagggtgaccgactcacacaggactcgcagctggacgctactgttcctgtgcaagaactcgccgtccacctcgagagtggcactgcagaagaagctgcgtccgtcgtcactctcggtagcatttagctgaagttgagctggctgccccggggccgcggccggaactccgtccagcgtgacctggactcgagccccagccatgcaactcacggtcactgtggacccctcatgggcggtgggctcgctgaggttcacaatgggtcctaggaagcctaaaggcggggcattgcccaggagcttaatgaacaggaccttcctgtgggtcaagccgctccctccgccctcccctttcctctcggratatccgggccacgctttcggccgttcaagcctcgccctctttccgcgctgtgtccagcttcgggcactcaggcccaacccacgttgcaactgctattggggcaagccaggccccaccttttcggctagtctccgccccctctgccacgcccccagactgctgaggccgygcccccttcccacgcctcctcttactaaagaccgtcaagttctcccgggcctcccgtctctcgccccctagggtcacgttgcagacgatytcccgggcaccctcctgatccgcgcgcgccgtggctgtggctgtggccgttagcgtgtccccgtggttcatgactgtcgcattcagcatctggtcccccagcgccaggtagacctgggcctctgaggctggaaaaagcccgtctagggtgcagtccaccggccacgacgtttccacctccaagaaccggggggccacgaggcgcgggggggtcacgggcaggactggggagaaaggtgggcatagtacaacccccaggactgtgccttccccaggacaccctcatcccccccagtcaggatatcttgctgactgggtcacccttcttcrcaggacacacacacagggccatgaaaacggccttcttcaaagatcccacggctcgggcctcccttccggggccaccttgcccagtggccgggggctttccttcccagaagcctgtgaggtccggggtaccccactctcaggaaccccaaggtcagggcaccgtctaccctggctcagctcgtcacccaccgtctgaagccccttctctcaccaaaggttcggagctggcggggggctgaggtgttcacgaacagtcccagcccctggggctgcatgtccagttctgtgcggcatgagaaaggggctccgtggtcgtctctgctggccagcacagtggcagtgacctccgctggctcctccactgcgggctgccggctcagctcctcctcccagcgaagcagcaccaccgtgaggctggtccggggcgacccaycctccacttggcagcgcagggtgaagttctggcccaccggctgccaaggaggcaggggtgccagctccacacgctccgggagccctgagagaggaggggaggatggcacttagcgggtcctgcaaacccacccactcaccccagggactggggaggagacagggtrgtcctgccgagaactgtgagctttgagttaataaacttagagggcttagagctgggccagtcgaagcgtttgctattatcattagcgcagtgattatcatttcctgtgttgtcagataccttgcaaggcgctaaacaaaactttctgttctcaaagatggcamaataaaaaaaaatgaggatggaagggatgaacgtttatgactatgatatgaatattaaaaattcctgtttatggccagacgtggtggctcacgcctgtaatcccagagctttgggaggccggggtgggtggatcaaraggtcaggattattcagttctctccaatcaggttcagacactcagggctttcctggttcaccagccctgtggcagcctctcaagatactccggcacagtcacaggagacttgacactcccaggctgggtgccctccccagtacacctacaaaacgctgggcctcaggccgggcactgtggctcatgcctgtaatcccagcactttgggaggccaaggtggacggatcacctgagaccaggagttcaagaccagccttgccaacatggtgaaaccccatctctactaaaaatacaaaaattagccaggcatggtagcacgtgcctgtaatcccagctactcaggaggctgaggcacaagaatcgcttgaacccaggaggcaaaatttgcagtgagctkagatagtgccactgcactccagcctggcgacagagagagactctatgtcaaaaaaaaaaaaaaaaaaaaaaaggctgggcaaggtgactcatgcctgtaatcccaccactttgggaggccgagggaggcggatcacttgaggtcaggagtttgagaccaacctggcccatatggcaaaaccctgtctctactaaaaatacaaaaattagccgggcatggtgtcacacgcctgtaatcccagctactaaggaggctaagacaggagaatcacttgaacccaggaggcggaggttgcaatgagctgacatcgcgccattgtactccagcatgggggacaakagcaagactgcgtctcaaagaaaaraaaagtcaaaaagtaggccaggcmtggtggctcacgcttataatcccagcactttgggaggccaaggcgggcagatcatttgaggccaggagtttgagaccagcctgggcaacatggtgaaatcctgtccctactaaaaatacaaaaattagctgggcgtgttggcatgcgcctgtaatcccagctactcaggaggctgaggcaggagaatcgcttgaacccggraggcagaggttgcagtgagccaagattgcgccactgcactctagcctgggggacagagtgagactctgtctcaaaaaaaaaaaaaaagaaaagaaaagaaaaaaaaaartagccaggtacagtggctcaggcctgcaatcccagctactggagagactgaagtgggaggattgcctgagcccaggagtttgagaccaacctaggcaacatagggagatcctgtctctaaaataaaggtataaaaaagtgtaaatgtaaaacctccatttgcctactgctgactgaaaggggtacccccttttttgcttaagagacaagggtcttgcttttttgcacaggctggagtgcagtggtgcaattatagctcactacagccttgaactcctgggctcaagcgattctcccaccttggtcccccaagtagctgggacttcaggcatgtgccaccatgcccagctaatattttttatttatttttgtagagacggggtgtccctatattgctctgcctggtcttaaatttccggactcaagcaatcctcctgcctyggcctcccaargtgttgggattattgttggggccaggcgcagtggctcacacttgtaatcccagcactttgagaggctgakgtgggcggaacaccccgtctctamtaaaaatacaaaacttagctgggcattagctggacctgggaggcagaggtcgcagtgagccgagattgcaccactgcactccagcctgggctacagagtaagagacgccatctcaaaaaaaaaaaaaagcttgttggggccgggcgcagtggcccatgcctgtaatcccagcactttgggaggctgaggtgggcggatcgcctgaggtcaggagtwcaagaccagactggccaacatggtgaaatgccatctcaactaaaaatacaaaatttgctgggtgtggtggcgtgcatgtgtaatctcagccactcgggaggctgaggcaggagaatcacttgaacccaggagkcgaaggttgcagtgagccgacatcgtgccactgcactccagcctaggcaaaaagagcgaaactctgtctcaaaaaaaaaaaaaaaatgcttgttggggcccaagttaattgatttcacaactgctgccttggcatgagattgagatgcgtctctatatctctgtctctgtctctgtgtctctgtctctgtctrtctttgtatctcacacacaaatgtccaggtctgagctctgggtcagaacygtggtccattctttgcaaactgagggtccccactctcctgagccattggccacttgcccacaccactacccaagaccagtcccacctccggacacgtygactcacygtacacggtgatgttagaggagcctgttatctgrgagccattgcagtacactgagcagaggatccgactgttgccagtcacgttgctgagattgaaggctgcccagcccatgccactggccaccagctcctttgatagggacgtctccaaggcgattttctcagagctgggacaatcagtactgcagttcacaaacagggaccctccagcagagagcacagggttctggggctccacccgcaaaaggaactcctgcccctggacaccttcaggaacatgaagaagtcctggtgtttgtttccttgtyccccaacccacgcatcaacaggccccaccatttaacacctctctccttgtgccgagacagaagggttcctgccttcatggtccagkgggaaaggtagaatccatcagagaccrgggagaactcagaaggaggccagaagaggctctgatccagcataggaggaggtgagtcagggaaggcttcctggaagcggggaccattgcagcccgaaactgaaggctaagtaggagttagcaagtgaaagggacaggtgatcctggcagagggaagcacatacgcaaagggcaaatttcaggagttcagatggagcaggaagcatgaggggtgtgtgtgtgtgtgttaggggagagggatggcgtacaagcctatgctggggcctgaccacctgaaggctgaactaaggaaccagaactttctcccgaggatacagagtcagcggccaggtcgcagtgtggcaggatgtgaacagcgttgcgttctattcctctaccctctactgatccccaaaacgcagccctctccagccctccccggcttgactggtctcacctggggtcagcagacagcagaccagcagagtccagcaggccctgggccacaacacggatggtaccatggtrgccattctgacagaggaaggtgccttcctgaggtgcccgaagggcaggcaggggaaaaggcggggcctcccactgcgacggaagcacagcggttaagattgcagaagtctggggactgcaccttgcccaggcctgtgggtggaaggggatgctgtggcccttgggggccagggtgggggacccagacggggctctgcaaagtggccagcactgctgagtctcccccagggaatgggctggtcccagttgcactgctggcccccatttgaattcacaggaaatgctaactaaactggtttcttttgttctcagcactgggaagcctgggtgggggggatgaggcatctccttctggctgaacttaggtgggtaggggaatattctgtccccagagaggaagttaatggggaaaactgtaggcaccattgtgtagatgttaaggtgggatttcgaggaaacattaaaaaacaaaaacaaaaacagaaacagaagcagagtcttgctatgttgccccgactggtcttgaactcctggccttaagatggcctcctctcatcttgacctcccaaagtgttgcgattacaggcgtgagccaccacgcctggccacctttgaagatcttgaggatacctccctatctttgaagatcttggggatcccccatcccctgcacaaagagctaaggtaggtgatttggggacagctgaktccctgagccactgtctatccaggattctacttggtttttgtttgtttgttttgagacagagtctcactctgtcacccaggytggagtgcagtggcgggatctcggctcactgcagcctctgcctcccgggttcaaacgattttcctgcctcagcctcccgagtagctgggattacaggcatgtgccaccacgcccggctaatttttgtactttttggtagagacggggtttcaccatgttggccaagctggtctcaaacttctgacctcaagtgagctgcccgccttggcctcccaaagtgttggg

SEQ ID NO: 13454 - DNA, 12657 bp, Homo sapiens
tcgcgccactgcactccagcctggcgacagagcaagactccatctcaaaaaaaaaaaaaaaaagaccacacaagcaggggtgactggctgagtgaggcaagaggggtaagaagagaatgaacccacggccaaacgttgtcaagaattagctcaatgccaagcgagtggagtaggaagagaatcagcccgatgcccagtgttctccaaggagaacatgaaggctgtcccaagatgacaggatgacaggcagattggggcaacctgccatgttggcctggggggcaatactgggcctgaagctcagagcagcagacagtgagcyaggccctcccatcttcagggatggtcactccctgccctggcccrccccatggccccacaaacctgtccctttgtatttgtccacaaaacagtatttgagctcatagtcactgagcaggtcatgtacttcctgtggagatacaagacaaaagacagggagttactggagatggaagggggcaacccagtgccgcttcatagctgccaccagctatgaaggcaggtcaattaccaccccccattttaccaatgaggaaactgaggctcgatgcagtaattttgtcaaggtcattctgctcatacctggcagagatgggattcagaacctagctgcagactgtgctattacccaggcaacatgctcttagagggtatacctttagctggctgggcggggtggcycacgcttataatcccagcattttgggaggccgaggcgggtgaatcacctgaggtcaggagttcgagaccagcctggccaacatggtgaaaccttgtctctactaaaaatacaaaaattagccaggagtggtggcgcacacctgtaatcctagctactcgggaggctgaggtaggagaactgcttgcacccaggaggcagaggttgcagtgtgccactgcactccagcctgggtgacaaagggagacactgtcaacaacaataacaacaaggccgggcgcggtggctcacgcctgtaatcccagcactttgggaggccgaggcgggtggatcacgaggtcaggagatcgagaccatcctggctaacaaggtgaaacyccgtctctactaaaaatacaaaaaaattagccgggcgcggtggcaggcgcctgtattcccagctactcgggaggctgaggcaggagaatggcgtgaacccgggaagcagagcttgcagtgagccgagattgcgccactgcagtccgcagtccagcctgggcgacagagcgagactccgtctcaaaaaaaaaaaaaaaawaaaaaaaaawyamcaacamcaaaaaaaaaaaaaaaaaaagaggccgggctcacgcctgtaattccagcactttggaggctgaggcaggcgggtcacaagatcaagagatcgagaccatcctggccaggaaggtgaaaccccatctttactaaaaatacaaaaatcagctggctgtggtggcgtgcacctgtagtcctagctactcgggagactgaggcaagacaattgcttgaacccgaggggtgaaggttgcagtgagcagacatcaagccactgcactctagcctggcgacagagtgagactccgtctcaaaaaaaaaaaaaaaaaaaaaaaagagtatgcctttagggaagccatttaacctgcatgaacctccttttgcaagattcactgtttccaacaactctgtaagtgaagtattaacaaactcatgttgtatatgagaaaacttaggctaggagaagtgaagagatctgctggaggccatgcagttgggcagcgcagccacccatgggtacctgactggggagcccaccttctagtaagccccacgttgtgtgggttcacatgcctcccaatttcctcctgctgataaagctgccctcttccaagccagctcatttatttttcttttttttagagatagtgtcttgttctgtcacctaggctagagtgtagtagcacaatcatagctcactgcagcctcaacctcctaggctcaagtgatcctcccacctcagcctcctgcgtagctgggactacaggcacgcaccaccatgcctggctaatttttaaaaattttttgtagagatgagggtttcactataccgcccaggctagtctcgaacccttgggctcaatacagcctcttgcctcagcctctcaaagtgctgggattaaagggatgagccaccatgcccagcctctcaagccagctttgaaggcaaagtgctggcgcctgctgggaccagacacactgtgcatcttgcaggagagacaatgtgttcccagctgagagactgcagacactgagaggaagacccagaaagaaacctgaccatccttaatgatccctgtcccgatctgtccccaaattcagcccctcccaacatccctggggttccactagccacgtgcccacccggtgtgctggtgggccggagagcagggaatctcagcagcaggaagcgagaacctatttcacmgccatagggcagggcagtatagatgccatttccctgggtccaaagagcattgggaagcgctgccccatgctggccccatgagaagggcactcctagcaggaagattagccacgaggggctccatagaacacaggcctcgcttccttcctgtaggtctgtaggctggtggcagaagaccccattttcccaaattaatcctgaggttttgggggctgagacccaggggctgctgttaacttccggatttatctctgagagcagtgaataaacgcgtgatatggaggggcgtactctccgcagtcctgaaacttctggatgtgaggycccgccaccctgtggtagagtgggtggagaaaagcatcatccaagcagggggcaactggtggtccaatgtaccagcccattcacaattccccaacaggaccaaagctgtccgcccccttccattccccgcccgcttccatcacttggtgtcgcccaagcctgtggtcgcccctagcaacgccctccctcacttcgcagtcggtttcccctttcatcatcgcccccccacgtcccgctcttggtctctcccgatcccgcgtggatccggtgcttgggcgcccccgccaacgacccccgcgcacctcagcgttggtgtcgcccggttccccccgcgcacgcgcaccgtggtatttcccgccacgctcctacaccgccccccccaatacctggttggtcacgtcccccgggaggccccggatcagtatcttgcggcggttacggaactggcgctcggtgtgttccaggcgtttccggatctcttctggatctagaggcrgcagctcttcttccggcgcccggcgctccgcggcatcgccggcttygacttcggccccagacttagggctcagcgggggccggtgagtaacrgacacgtccgccgccatcttgggaaacccggcgccttctgggaccagcgagccggggcggagcggcatagagcggcaacgagggcgcgcccgtcgattggctgggagaaaccccacctccttcccgccccccttgccccgttggctaagccccagcccacctctcaagagttcaagctgcgtctgcgcgccacaggccccgcccccttccgtcgcagcgacgctactcagtggatgtgcacctgggtgggagagacttgcagcgcgggtggaatcaaaccacagattagggagtttgaaggctttattggtgcggaatctgagggcacagccaagcccccgccaactttgatcccggatcccagcgtcactcagctctggacggttcttcccccattgcttctgtcggctgcatagacgtgaggggcagataggtgstctcctccctaacatggtaactgccgctccgttggtgctccctgaagacgtacattaaggccagtacgatagtcaccacgcccagggtcagtaacaccgccacgaagacggggacaaagtgggagctcccagctgtgcagagaaagcgctaagtcaatatgcgtcccttctgtctccaacccccccgccccccggcttacsggtccagacccgcagccccgtrttagctcaccctcaatgtccatcaccacgaccagggtgtatttgcctcgtgagctggacgcttggcactgataagtaccattatgtgttacgttgacgaagaacgggatccccaccggcacctcccggctggagccttccttcaaacaccgcagctcggggtacgggttgcccctggcttggcactgcaggacgtgtctcgttttatctttccatttcaagtgctgggggcatgtggctcggtcaattttgggaccatctgtggaaccaccatgtgtgatcagacacccaacacacccgaggcacagtggtgcagaggagcgtctaatctttccagggmaggggtggagggattaaaggtcagggtgaccgactcacacaggactcgcagctggacgctactgttcctgtgcaagaactcgccgtccacctcgagagtggcactgcagaagaagctgcgtccgtcgtcactctcggtagcatttagctgaagttgagctggctgccccggggccgcggccggaactccgtccagcgtgacctggactcgagccccagccatgcaactcacggtcactgtggacccctcatgggcggtgggctcgctgaggttcacaatgggtcctaggaagcctaaaggcggggcattgcccaggagcttaatgaacaggaccttcctgtgggtcaagccgctccctccgccctcccctttcctctcggratatccgggccacgctttcggccgttcaagcctcgccctctttccgcgctgtgtccagcttcgggcactcaggcccaacccacgttgcaactgctattggggcaagccaggccccaccttttcggctagtctccgccccctctgccacgcccccagactgctgaggccgygcccccttcccacgcctcctcttactaaagaccgtcaagttctcccgggcctcccgtctctcgccccctagggtcacgttgcagacgatytcccgggcaccctcctgatccgcgcgcgccgtggctgtggctgtggccgttagcgtgtccccgtggttcatgactgtcgcattcagcatctggtcccccagcgccaggtagacctgggcctctgaggctggaaaaagcccgtctagggtgcagtccaccggccacgacgtttccacctccaagaaccggggggccacgaggcgcgggggggtcacgggcaggactggggagaaaggtgggcatagtacaacccccaggactgtgccttccccaggacaccctcatcccccccagtcaggatatcttgctgactgggtcacccttcttcrcaggacacacacacagggccatgaaaacggccttcttcaaagatcccacggctcgggcctcccttccggggccaccttgcccagtggccgggggctttccttcccagaagcctgtgaggtccggggtaccccactctcaggaaccccaaggtcagggcaccgtctaccctggctcagctcgtcacccaccgtctgaagccccttctctcaccaaaggttcggagctggcggggggctgaggtgttcacgaacagtcccagcccctggggctgcatgtccagttctgtgcggcatgagaaaggggctccgtggtcgtctctgctggccagcacagtggcagtgacctccgctggctcctccactgcgggctgccggctcagctcctcctcccagcgaagcagcaccaccgtgaggctggtccggggcgacccaycctccacttggcagcgcagggtgaagttctggcccaccggctgccaaggaggcaggggtgccagctccacacgctccgggagccctgagagaggaggggaggatggcacttagcgggtcctgcaaacccacccactcaccccagggactggggaggagacagggtrgtcctgccgagaactgtgagctttgagttaataaacttagagggcttagagctgggccagtcgaagcgtttgctattatcattagcgcagtgattatcatttcctgtgttgtcagataccttgcaaggcgctaaacaaaactttctgttctcaaagatggcamaataaaaaaaaatgaggatggaagggatgaacgtttatgactatgatatgaatattaaaaattcctgtttatggccagacgtggtggctcacgcctgtaatcccagagctttgggaggccggggtgggtggatcaaraggtcaggattattcagttctctccaatcaggttcagacactcagggctttcctggttcaccagccctgtggcagcctctcaagatactccggcacagtcacaggagacttgacactcccaggctgggtgccctccccagtacacctacaaaacgctgggcctcaggccgggcactgtggctcatgcctgtaatcccagcactttgggaggccaaggtggacggatcacctgagaccaggagttcaagaccagccttgccaacatggtgaaaccccatctctactaaaaatacaaaaattagccaggcatggtagcacgtgcctgtaatcccagctactcaggaggctgaggcacaagaatcgcttgaacccaggaggcaaaatttgcagtgagctkagatagtgccactgcactccagcctggcgacagagagagactctatgtcaaaaaaaaaaaaaaaaaaaaaaaggctgggcaaggtgactcatgcctgtaatcccaccactttgggaggccgagggaggcggatcacttgaggtcaggagtttgagaccaacctggcccatatggcaaaaccctgtctctactaaaaatacaaaaattagccgggcatggtgtcacacgcctgtaatcccagctactaaggaggctaagacaggagaatcacttgaacccaggaggcggaggttgcaatgagctgacatcgcgccattgtactccagcatgggggacaakagcaagactgcgtctcaaagaaaaraaaagtcaaaaagtaggccaggcmtggtggctcacgcttataatcccagcactttgggaggccaaggcgggcagatcatttgaggccaggagtttgagaccagcctgggcaacatggtgaaatcctgtccctactaaaaatacaaaaattagctgggcgtgttggcatgcgcctgtaatcccagctactcaggaggctgaggcaggagaatcgcttgaacccggraggcagaggttgcagtgagccaagattgcgccactgcactctagcctgggggacagagtgagactctgtctcaaaaaaaaaaaaaaagaaaagaaaagaaaaaaaaaartagccaggtacagtggctcaggcctgcaatcccagctactggagagactgaagtgggaggattgcctgagcccaggagtttgagaccaacctaggcaacatagggagatcctgtctctaaaataaaggtataaaaaagtgtaaatgtaaaacctccatttgcctactgctgactgaaaggggtacccccttttttgcttaagagacaagggtcttgcttttttgcacaggctggagtgcagtggtgcaattatagctcactacagccttgaactcctgggctcaagcgattctcccaccttggtcccccaagtagctgggacttcaggcatgtgccaccatgcccagctaatattttttatttatttttgtagagacggggtgtccctatattgctctgcctggtcttaaatttccggactcaagcaatcctcctgcctyggcctcccaargtgttgggattattgttggggccaggcgcagtggctcacacttgtaatcccagcactttgagaggctgakgtgggcggaacaccccgtctctamtaaaaatacaaaacttagctgggcattagctggacctgggaggcagaggtcgcagtgagccgagattgcaccactgcactccagcctgggctacagagtaagagacgccatctcaaaaaaaaaaaaaagcttgttggggccgggcgcagtggcccatgcctgtaatcccagcactttgggaggctgaggtgggcggatcgcctgaggtcaggagtwcaagaccagactggccaacatggtgaaatgccatctcaactaaaaatacaaaatttgctgggtgtggtggcgtgcatgtgtaatctcagccactcgggaggctgaggcaggagaatcacttgaacccaggagkcgaaggttgcagtgagccgacatcgtgccactgcactccagcctaggcaaaaagagcgaaactctgtctcaaaaaaaaaaaaaaaatgcttgttggggcccaagttaattgatttcacaactgctgccttggcatgagattgagatgcgtctctatatctctgtctctgtctctgtgtctctgtctctgtctrtctttgtatctcacacacaaatgtccaggtctgagctctgggtcagaacygtggtccattctttgcaaactgagggtccccactctcctgagccattggccacttgcccacaccactacccaagaccagtcccacctccggacacgtygactcacygtacacggtgatgttagaggagcctgttatctgrgagccattgcagtacactgagcagaggatccgactgttgccagtcacgttgctgagattgaaggctgcccagcccatgccactggccaccagctcctttgatagggacgtctccaaggcgattttctcagagctgggacaatcagtactgcagttcacaaacagggaccctccagcagagagcacagggttctggggctccacccgcaaaaggaactcctgcccctggacaccttcaggaacatgaagaagtcctggtgtttgtttccttgtyccccaacccacgcatcaacaggccccaccatttaacacctctctccttgtgccgagacagaagggttcctgccttcatggtccagkgggaaaggtagaatccatcagagaccrgggagaactcagaaggaggccagaagaggctctgatccagcataggaggaggtgagtcagggaaggcttcctggaagcggggaccattgcagcccgaaactgaaggctaagtaggagttagcaagtgaaagggacaggtgatcctggcagagggaagcacatacgcaaagggcaaatttcaggagttcagatggagcaggaagcatgaggggtgtgtgtgtgtgtgttaggggagagggatggcgtacaagcctatgctggggcctgaccacctgaaggctgaactaaggaaccagaactttctcccgaggatacagagtcagcggccaggtcgcagtgtggcaggatgtgaacagcgttgcgttctattcctctaccctctactgatccccaaaacgcagccctctccagccctccccggcttgactggtctcacctggggtcagcagacagcagaccagcagagtccagcaggccctgggccacaacacggatggtaccatggtrgccattctgacagaggaaggtgccttcctgaggtgcccgaagggcaggcaggggaaaaggcggggcctcccactgcgacggaagcacagcggttaagattgcagaagtctggggactgcaccttgcccaggcctgtgggtggaaggggatgctgtggcccttgggggccagggtgggggacccagacggggctctgcaaagtggccagcactgctgagtctcccccagggaatgggctggtcccagttgcactgctggcccccatttgaattcacaggaaatgctaactaaactggtttcttttgttctcagcactgggaagcctgggtgggggggatgaggcatctccttctggctgaacttaggtgggtaggggaatattctgtccccagagaggaagttaatggggaaaactgtaggcaccattgtgtagatgttaaggtgggatttcgaggaaacattaaaaaacaaaaacaaaaacagaaacagaagcagagtcttgctatgttgccccgactggtcttgaactcctggccttaagatggcctcctctcatcttgacctcccaaagtgttgcgattacaggcgtgagccaccacgcctggccacctttgaagatcttgaggatacctccctatctttgaagatcttggggatcccccatcccctgcacaaagagctaaggtaggtgatttggggacagctgaktccctgagccactgtctatccaggattctacttggtttttgtttgtttgttttgagacagagtctcactctgtcacccaggytggagtgcagtggcgggatctcggctcactgcagcctctgcctcccgggttcaaacgattttcctgcctcagcctcccgagtagctgggattacaggcatgtgccaccacgcccggctaatttttgtactttttggtagagacggggtttcaccatgttggccaagctggtctcaaacttctgacctcaagtgagctgcccgccttggcctcccaaagtgttgggattacaggcgtgagccactgcgcccggccttccaggattctacttgtaactggcctttaccccatcctgttgtccccttgcccacccttccaggcagctggtcactgcattccargggaaggcgccaaggggaccaggtgggacccccacctttgacctgcctctgacctcaggcctctgacctgccttctgggcttcacatctgagctccagagagagaggccttgttgagagccttgatggggccctgcactcacccactttccccagaccttgaggtcacagcacctcctctctcatctagagcacccccaccttcctaagcaggtccctcctctattcctctaccttccgaacaatccatttcccacctggtgttgagagagcagctaaaacccaagtctagtgtatttgtaaacagcagggaccagtagcatgggcctggtgcctgtagtcccagctccttggaaggctgaggtgagaggatcgcttgagcctgggaggtcaaagctgcagtgagtcgagattgtgcccctgcactccagcctgggagacacagtgagaccctgtttccacaaaaaaaaaaaaaaaaaaaaaagatgtcggacttactggctcacgtctgtaatcctagcagcactttgggaggctgaggtaggtggatgacgaggtcaggaaatcgagaccatcctggctaacacagtgaaaccccatctccaccaaaaatataaaaaattagctgggcattgtggcgggcacctgtagtcccagttactcaggaggctgaggcaggagaatcacttgaacccaagaggcggaggttgcagtgagtggagattgtgccgctgcactccagcctgggtgacagagcaagactctgtctcagaaaaacaaacaaacaaacaaacatatatatataatttataatacttacgtaatagtgagaccctgtctctaaaaataaaaaagaaagaaatatttgtaaataagtcatatttcttttttgttttttgaaacagagtctcaccgtgtcgcctaggctggagtgcaggggcacratctcagctaactgcaatctcagcctcctgggttcaagtgatcctcccacctcagcctccctaggagctgagaccacaggtacacaccactgtgcctggctaattttctgtagagacggctttcaccatattgcccaggttggtcttgaactcctaagcttaagggatctgcctgcctcgacctcccaaagtgctgggattataggcgtgccctgctacacccgycagtaatatttctgataaagaagtatttctgggccaggtgtggtagctcacgcctgtaatcctagcactttgggaggctgaggcgggcagatcacgaggtaaggagatcgagaccatcctggttaacacggtgaaaccccatctctactaaaaatacaaaaaaaaattagccccgtctctactaaaaatamaaaaaaaaatggtggcaggtgcctgtagtcccagctactcgggaggctgaggcaggagaatggcgtgaacccagaaggcggagcttgcagtgagccgagatcgcgccactgcactccatccaggctgggcaacagagtgagactccatctcaaaaaaaaaaaaaaagagtatttctgggccaggcgtggtggctcacacctgtaatcttaacactttgggaggcctagacaggcggatcccttgaggtcgggagttccagaccagcctgggcagcatgccaaaaccctgtctctactaaaaatacaaaaaatcggccaggtgcagtggctcacgcctgtaatcccagcactttgggaggccgaggcgggcggatcacgaggtcaggagatcgagaccatcctggctaacacggtgaaaccccgtctctactaaaaaaaatacaaaaattagctgggcatggtggcgggcgcctgtagtaccagctacttgggaggctgaggcaggagaatagtgtgaacccgggaggcagagcttgcagtgagctgagattgcgccactgcactccagcctgggcgacagagcgagactccatctcgaaaaaaaaaaaaaaagtacaaa

SEQ ID NO: 13455 - DNA, 45517 bp, Homo sapiens
tcataaactgcaaaattgagggtaagggtagtagccgagtggctgaggaatcttgactgtggcacctttagccacccacttcttcaaggtcaaggatttacagggtgacagaagctgctttttggtcaattaaggggtgcaaaggagagccaaccgcacagtgcaggggtaatgggggccttctgcactgtggatgggacgtcaaagaagcttgttttgagagtcttacattcttttaatccttggggcaacgtcaggaagtagacagttctcatcatccctactgcacagaaaggaaagtgaagctaacttttccaaggccacacaagcatccctgccccttaacctctattctaccaacctctactgagtcaattagaggagaagggagccatttgcttccactccaaggaccctcctctgtactaggccagctttccttctagaagattcttcatgcaaataggggatgtaacagggaaccacagacctctgctcaaaaccccactacccaaatcccaaactgcctgatcccaactcccctgatggacaaggacagacacttatttgcaaaccacatccccaatcaggtgccatgaccatagtagttggctgccagctctgggctctgctgcactatcgctgcaacctgcccaacagcctggctggggtcctagctgaaggtcccagcctctctggaactccgacctctcctgcacaggcttccagaatcaatccagctatgacagtcaagtttccatgtaacttttgagcaacctgcactttggagttcattacaggcaaattttttttttttttctttctgagatgaagttttgctcttgttgcccaggctggagtgcaatggcgccatcttggctcactggctcactgcaacctcctcctcccaggttcaagccattctcctgtctcagcctctggagtagctgggattacaggcatgggccaccatgcccagctaattttgtatttttagtagagatggggtttcaccatgttagtcaggctggtctccaactcctgatctcaggtgatcctcctgcctsggcctcccaaagtcctaggattacaggcatgagccaccacgccctgcccagacaaatctttttaagcacaaaagggcctacatgtatttaatctacaggacaaagtaaaagtcttatccatgttaacttagtaaccaagaagacctgcccttcactatggtaagcaaattattttcacaaaaacagttcttctagccctgtagctaaatgtacagccaaggttccaaacttttatctttgatcactaggataaattctaattttaagtctcaagattataagccagctcccaaaggtacagcctggataaacacaaacatcacttttttattcaatgagtactttctaagtacctatttattaaaacttaccatgtaccaacaacttctctaaatgctttataggtattaaactcatttaattctaacaaccttatgagttaggtgacattactaccccaatatacagaagctaaggcacagaggtaaattgcatgacccagtgatgcacagaggaggcagcaccgtgcttaggctctggagctaccatccacagcgagcttacaaatatacccaacttgccctgcacttsgccagcaaacactcgcagcacctactcaaaccatctgcctcttcacaaccagtctctttagaaaggagacttaatcaagaaaaatgccaccaatggagagarcaggcttaattatagcaaactaagggaaggaaaaaccaaacaaatcatataaatgtagtaagcccccctttgaaaggcccacttatagaacaactatgctttcttgcctacaaagcaaggtgggtcttccaacactaatgcacatccttctcccactttgcataatcttttaaaagacaccacccttctgcccagggcagggtcaggttcctctactcaggagcctccactcggtcagcttctcacagggccattgccattgaccccccaaagcagtaagttagtaactggtgaggacaaaggtctatggcacaggctgtgtttttggtcaggagctatttccctcacaacattggcaggcttaaggctccacctccttcaagtctttgcccgtaagtcacttttacaaagactatgactcccatatttaaaattgcagccaccataccacagaaactcctgtccctcttttctgctctggtgttctctttgtgcttcccaccagctcacaatgtgtttcacctatttaaatgtctgtctctacccatcagtatgcaagtttcatgagggtagggatttgggctgttttgttcactattagactctcagagctttgaagattgcctggcttaggggacacatacagctacttgttgagtaagtgaataaatacccacaaagaacagatacttgtctctaactctcagaccttcccccggttgtcaaattcaggctgcaaacttagaattccccgtgagggagaaaaggggctgttacttccaaagaaagataatttggcaactaaatccatcatgtaagtacccagtttcccacagagtagagcaggtagagaaggaatctggaatgctgaactttgttgatgtccgagctcccaggaaggcataaaaggagaataataatagaagaggacgagtcagggatagcattctcagcagggtgggaaacatgctaatgagaggaagactgtaaagaaaaagcaaagcgccagcgggggcgcagtggctcacacctgtaatcctagcactttaggaggtggaggtggacagatcacttgaggtcaggagttcaagaccagcttgaccaacatggcgaaaccccatctctactaaaaattcaaaaattagccgggcatagtagtgcatgcccgtagtcccagctacctgggaggctgaggcaggagaatcgtttgaacccaggaagtggaggttacagtgagacaacatcgtgccattgcactccagcctgagcaacagagcaagaccttgtctgaaaaataaaaagaaagaaagaaagaaaagaaaaagaaaagcttacgaaattccttttagcaagtagtaagtgctggttagaatgaaaaacatcatatactgggtgaagaccttagttttagttgagccattgccattcacccttggacaaatcacatcacttttctggcctcaaatgatttcctaatccgcaggatggaatgtgggaagtgggctggatttttaagaaattctaggaccggtgcagtggctcatgcctgtaatcccagcactttgggaggccgaggtgggtggatcacatggggtcaggagttacagaccagcctgaccaacatggtgaaagcccgtctctactaaaaatacaaaaattagccggacggggtggcacacacctgtagtctcagctactcgggaggctgaggcaggagaatcgcttgaacctgggaggyggaggttgcagtgagccaagatcatgccattgcactccagcctgggcaacaagagtgaaactctgtctcaaacaaacaaacaaactagctggacatggtggcggacgcctgtaatcccagctacttgggaggctgaggcaggagaatcgcttgaacccaggaggcagaggttgcagtgagccgagatcaygccattgtactccagtctgggcgacgagtgaaactccatctcaaaaaaaaaaattagctaggcgtgatggcgggcacctgtaatcccaggtactcaggaggctgatatgagagaattgcttgtatgcaggaggcagaggttgcagtgagccaagattggacacagcmagacttcatctcaaaaaaaaaaatagatctcaaggcagcagctaccatgtaaaaaaaaaaaaagataatgaatcattcatatatacattaactaattactgattattaatacaacatatatcgaatacttattatgtgccaggaagaattataaatgatcatctgttaggaacccatttaattctactaacatcccaatgacctagacattacttttacttaacatttgaggaaactttggcacagaaaggttaattaatttgcttaaaaccacacaagtagtaaggcaggaaacagggtttccaggtgtttaggatatagacaaaaataagacaatacatgtatttgcccttatggagttgataaacatatttaatttgctctccaattaacgaaagtatattcagtgagcacctattctcagtactggcccagatgcattattattgtactaaattatctgcactattattatgcactaaattatctcttcacaatcagtctttctaaaaggaagatttttatattaaaacaaaaagccactggaaaaggaagtaagtttgaatacaagcaaacaaaaacagaaagtaaagcagaaatacagtttagcaagccacatgttgaaaagcactaagcagtaagtattgtgatttctttttttttttttcttagacggagtttcgctcttgttgcccaggctggagtgcaatggcgcatctcagctcactgcaacctctgccccccaggttcaagtgattctcctgcctcagcctcccaagtagctgggattacagatgcctgccaccacactcggctaattttttgtatttttagtagagatggggtttcaccattttggataggctggtcttgaactccagacctcaggtgatccacccacctcggcctcccaaagtgctgggattacaggcatgagccactgggcccggacttttcaccaccgatgactttgtaattcactcaaaaacctattacaaagttaggagttacaggacaattacaatttagtaactgctgtggctggcaacagttacttacataacgggtgatgtgaaaggtcccaagagcaaactcagtaaggtcacacagaatatatctttccctccttcatctactagagggaatatatttttccctcttccttctactctcatttttcctcaccagtcacctcccagacaaaaagcagccagtgttacttcctgggagtaaagctggcaacgatacccactaattaagcattcagatgtcccgcaagggtagaacaggcagaggtcaagwggaatgcagaatattctcaggactcaggagccaaattacgtttcaagtaactctaggaccagggcagagagayggctgttagagagaagcacgagattgaagagaaaggaaaaatgtattagatttcacttagcgtatgataagactatggtatagtgggaaaagctatgagctggaaggaccctctgtcattatcagccttgtagtcttgtcaagccttgtcacctcactagtctccatctactcacctccaaattaacgggaattaagtagattggatttctgagttctgactaggggggctccaggaagccgcaactacccactctcccggcagaaagtcaccagcagctgcgcgtttgggagcayagtcggcacaggacttttccccgaagcacaggagccagcggctacagccactaggcagtccacttgcaaacgcaggttgtgcccgggttctctttctttggctgcaggtcttcaggtgttatgggcctaactcttccgctacaagtgtccctcccgcaaaaaatgggtccgggggacctgcacaccctcagagccctcgtccacagccccacactcaacaacaatgtcaggtgcttacgcggagatctccttcccgttcaggatttctgctggcgccatggcctttattagtccgctgcccacgatggacaccaccaatatcgaggttccactccctccgcagccaagcaggacaacccaacccacgtgcttagggactggccrggggatcacactactgcgcctgcgcccctgcccgcttctcccccygcagacgcggtggcgcatgcgcagttcggaaggacccgagtcccttaactaaccgagagctaacaggtcggggactgcgggacggaagagggaggggaagatgaagaaaatcggtgatgaatggctggcggaaatgattggcggaaagaaagagccagttcacagtgcgcctttgtattcggcgggaaacccggccgaagagggagctggaaaggactccggaatscggccgtaattccagccmatcagggagtagagttgcggggcggggttggggcggggmagtctcgcgggagatagtttcgcgggttcgggaggcgagwctccggtttccgcccagtctctggggacgcggtggcggggtctgaatcgcctggcttccagggagttttgggcgggtccccgcacgggagcgtggcaggcgctggactcgacagcagatgtggaactggagagcttggcgcgccctcatactttgtcacacacctacgccaccagactggggtcgggcccctccgcgttctgctctggagggcctgggtctgggcccagcatagcgcttttagaatctcctcagctgaatctgacgctcagccgtaggtgaagcttagcccgctgtttcaggccccgccgatctggaaggagtgtcagagctggagcgcgcgtggcctcatcggtgttggggtcaccccggggttgccagggctcatggagggtcgtagtctggattttgtcacccccacgtccccgccccgcagcaagtctggggttggagaactcacgcggtcttcgtaagctacatgccagttgaccctcgaggagggatgctccctccccttaagcgtccacgctggagaaggagtaagatggacaattgcctggggagcctgacagggcggtggcagctgggatgctggagaggactggccccttgtgttactgagtccaaggaatatgcttgctctgctctaggaaccgcgttcaggttacagtcatcccagtagagtcctgaagatgcgtggttcaggtcacttaggacttgaccagataccgggtttcttttacaagccgtttactactggcagagctcatctaaaactttttttgtttgtttgtttgagacggagtctcattctgtcgcccaggctggagtgcagtggcacgattttggctcactgcaacctccgcttcccgggttcaagcagttctctgcctcagcctcccgagtagctgggattacaggcaccacctaattagcccgccaccacgcccggctaatttttgtatttttagtagagacggggtttcaccatcttggcyaggmtggtcttgaactcctgacctcgtgatccacccgcctcggcctcccagagtgctgggattacaggcgtgagccaccgcacctggcctaaaactgattttttattaattttggggcttttaatatttttttcttatttctaaattctgaggttatttatagtagccccatatacgggattagataatctcttgtgattttctatttctggtaattatttctaatatatgtttttttgtttttgagacggagtctcgctatgtcgctcagggtggagtgcagtggcatgatctccgctctttgtagcctctgcctcccgggttcaaatgatcctcccacctcagccccccgagtagcttggaccacaggtgcatgccaccacgccggctaatttttctatttttggtagagttggggtttcactatgttgaccagactggtctagatctcaagggattagtctcccttggcctcccaaaatgctgggataatgggcatgagccaccgtgcgtggccttaaagttactattcttaaagtttgcacaagtgatatgttaaaggcacagacttagtaatataatgtcattataataataaccctaaaacacattgtctcatattgtgttgtacctaaacaagtgaaattaagaagaaaattgaaggaaatgtttctggtaaattgcagatagtgaatcttttgtcttatactatcaaataggtattgactattccagctttcttatttgttgaggaagatggcagaaatcccrttttacagagggatagactttgaaggataatacccaaagctgcatagctgtggctggtataggccccaaacctgatgtttcttctctaaatctactgcctttgccatctcaacagcctggtttttgacagttatctatgtatgagttgcataaatcgttcattcatggagcaaataattattgagtggccactatgccaacagcactgctatagatgctagagataccctagtgaaccagcaaagtttctgctctcagctcatattctggtggaggagacaacgatcaagttaaagaaatacataggctaattttagagattatgacatgctatattttaaaaataggcaagctaagaggataggcagtgatgctgggaggtgggaaagttttgtctcagaaatgtggtaagagatttctttgggcatctgacttcagcagaaaccttaatgaagagaggaacttggaatgtaaaagaaagaaagcagggatttgctctgagcaactggaaagatggaattgccattcgctgagttgaaataaagtaaaatgtaggactaggttttggggttaagattatgaattcggctttagacatttttagatttctcttagacatccaaatggagagaagatatttaaatccatgggattgaatgagatccaaccaagggtattgtaggtagagagaggaccaaagactgacacctagaacctttcagtgttcagaatgcaaggagacaggaggaaccaagagggaagattgaaaaggagagtccagctgggagctgtggctacacctttactaatcccagcactttgggagaccaaatacaggaagatcacttgaatccaggagtttgtagaacagccttagcaacatagcaagaccctgtctctacaaaaataaaaattaaaaaatttgcctgtaatccgagcattttggaggccgaggtgggtggatcagctgaggtcaggagtttgagaccaacttggccaacacagtgaaaccccgtctctactaaaaatacaaaaattagctgggcgtgatggctggcacctgtaatcccagctactcgggaggccgaggcaggagaatcccttgaacctaggaggcagaggttgcagtgagccgagatcacgccactgcactccagcctgggagacagagcgagactccatctcaaaataaataaataaataaaaatttaaaaagttagctgggcgtggtggcatgtacctgtagtcccagttactcagaaggctgaggtgggaggatcctgtgagcctaggagttggaaacttcagtaagctataatcatcacactgcactccaacctaggcaacagagcaagaccctgtctcttaaaaggaaaggagagtccagtgtgttctaaggaaaaccccaagagcatcccaccttagaakacaagtgaggaggcctggcatggtgtctcatgcctgtaatcccagcactttgggaggccaaggtgggtggatcacttgaggtcaggagttctagaccagcctgacaaacatggcgaaacctccgtctctataaaaatacaaaaattagccaggtgtggtagcgcgtgcctgtaatcccagctaytagggaggctgaggcaggagaactgcttgaactcagggggcagagtttgcagtgagccgagatagtgccactgcactccagcctgagcaacagagtgagactctgtctcaaaaacaaacaagtaaacaaacaaaaaaaaaaaacaagacaagtgaagaatgtgtttcatggaaaaagaggtaattaattctgtcaagtgttgcaaattggtcaaataaagaatgaaaatcaacctttcacagcaaatagaaggaaaaaatatttttatttaaatgcttataaaggcagttgctagaaaaaatgtttactttttgcagaggccccgtttttacaacctttttcaggggtaatttgatatgataatatctacgggaaaaaaatgtttttttttttgagtcgctctgtcaccaggctggagtgcagtggcatgatctcggctcactgaaacctccgcctcccaggttcaagcaattcttctgcctcagcctcccaagtagctgggactacaggtgggcgccaccacacccagctaatttttgtatttttagtagagacggggtttcaccatgttggccaggatggtctcaatcttgacctcgtgatctgccttccttggcctcccaaagtgctgggattggtacaggtgtgaaccaccatacctggcccgaaaattttaaatttgtattttctttgacattgtaattccacttccaggattttttttttttggacaggattttactctgtcacccasgctggagtgcagtaacacaatcagctcactgcaaccctgaactcctgggctaaagtgatccttctgagtagttgggactataggcacatgccaccacccctgaytaattaaaaaattttcctgtagagatagtcttgctatgttgcccagactggtctccarctcctggcctcaaaccatcctcccaccttgaccttccaaaacgttgggattacaggcgtgagccacctctcccagtttaggaatttatcttaaagtaatatttacatataaagaaagatgtataggctgggtgcagtggttcacgcctgtaatcccagcactttggaaggccgaggctggtggatcaactgaggtcaggagttcaagaccaacctggctaacatggcgaaaccccatctctactaaaaatacaaaaattagctgggcgtggtggccagcccctgtaatcccagctactcgggaggctgaggcaggaggatagcttaaacccaggrgacgaaggttgcagtgagccaagattacaccattgcactccagcctgagcaacaaaagcgaaactccatctcaaaaaaacaaaarctaaaactaaacaaaacaaaaaaaccatgtgtaaaactgttaatcacaacactgatttcaatagcaaaaaacaaaatttctgtcaggatggatgcagttgttaaaggaacagcagatacatatgtatagacatgtaagatagctttcatacttttttttttgagatggaatttcgttcttgtcacccaggctggaatgcaatggtgagatctaggctccgcttctcaggttcaagtgattctcctgcctcagcctcctgagtaagctgggaatacaggcgcccgccaccacgcccaggtaatttttgtatgtttagtagagacagggtttcgccatattggcgaggcttgtctcaaactcctgacctcaggtgatccacccacctccaaaagtgttgggattacaggcatcacccaccacgcgtgaccagcttttatacatttttaaatgataaagacaggttaataaaatgtataatattatgttgctatatccaaaaaaaggccttctttgattacactatcaaaagttacctctccatytacatccccattactatctcattaacctgttttattcatagcacttactaccatctaaaatgactttatttctttatatttttgtttgctacctgtcttttacaccagaatttaatttttaagctttttttgtttgtttgtttgtttgtttgttttgagatggagtcttgctctgttgcccagactggagtgcagtggtgcgatctcagctcactgcaacctctgcctcctgggttcaatcaatcctcctgcctcagcctcccaagtagctgggattacaggcatgtgccaccatgcccagctaatttttgcatttttagtacagcagggtktcaccatgttggtcargctggtctcaaactcctgacctcaggagatccgtcagccttggcctcccaaagtgttgggattacaggcgtgagccacagcacccagccagaatttaaactttataagagatttcctgtcttgttcatacttatatacctgcagcttcgaaacatatatatatgtttaatatatataatagatatattttaaattatatatagagagatggagtttcactcttgttgcccagactggagtgcaatggcgtgatctcggctcaccacaacctctgccccccgggttcaagcaattctcctgcctcagcctccagagtagttggaattacaggcacgtgccaccatgcctggctaattttgtatttttagtagagacagagtttctccatgttggtcaggctggtctcgagctcttgacctcaggtagtcygcctgcctcggcctcacaaagtgctgggattacaagcatgagtcactgtgccctgccagaatttaagctttataagagatttcctgtctgtttatacttaaatacctgcagcttggaaacatatatatgtttatatgtatatattacatacattatatatatatttttatatattataattataaactcctgacctcaggtgatccacctgcctcagtctctcaaatgctgggattacaggcgtgagccaccacgccaggccagaaacatatttttaaaaatcttgttttagaggaaaaacagagtatttctttttttttttttattagatggattctcactctattgcccaggctggagtacagtggcacaatcttggctcaccgcaacctcagcctcccgggttcaagcaattctcctgcctcagcctcccgagtagttggaactataggcgtgagccaccatgccctgctaatttttgtatttttagtrcagatggggtttcactatgttggccaggctggtctcgaactcctgaccttgtgatctgcccacctcggcctcccaaagtgctgggattacaggtgtgagccactgcgcccggcctatttcttcttctctttgtttagttattatctatwactctcattcctatgaacataacttgtttctccccmcttaatttttatcatacatrattgtagacagtgggcactgtcttcaattatagtgaatttagcagtaaattcacattagaccaacttgtatagctttaaaaaatatatttatgtctaggttccacccttgaccaactaagtcagaacttgggtgggttcaaggttcattattctttgaagataagatgatgtttgaataaaattcctggtgattctggtatcaaaaatacaaatttgggacatactttttctgctgtaaaaatattttcctaaggccaggcgcagtggctcacgcctgtaatcctagcactttgggagacggaggcggcrgatcacttgaggccaggagttcaagaccagtctggccaacatggtgaaacccagtctctactaaaaatagaaaaaattagccaggcatggtggcacgtgcctgtagtcccagctactcaagaggctgaggcaggagaatcctttgaacccgggaggcagaggttgcagtgagcygatattgcagcactgcactccagcctgggtgacagatcaaaactctgtctcagaaaaaaaaaaaaaaaaaaaaagaatttcctagaattagaatcgcaggggttttttttgttttgtttgtttgtttgtttgtttgtttttgagacagagtttcactcctgtcgcccaggctggagtgcaatgccatgatctcggctcattgcaacctctgcctcctgagttcaagcaatcctcctgcctcagcctcccgaatagctgggattacaggcacctgccaccatgcccagctaatttttgtatttttagtagagactgggttttaccatgttggccaagctggtctcgaactcctgacgtcaggtgatccacccagctcattctcccaaagtgctggaattacaagcatgagccactgcactcggcctttatttatttatttatttttgagatgaagtcttgctctgttgcccaagctggagtgcaatggcatgatctcggctcactgcaacctccacctcccaggttcaagcaattctcctgcctcagccccctgagtagctgggattacaggcgtgcaccaccacgcctggctaatttttgtatttttagtagagacagggtttcactatgttggtcaggttagtctcgagctcctgacttcgtgatccgcccgcctcagccttccaaagtgttgggattacaggcgtgagccaccgcgcctggccagaatcccagttttttaacacatctaatgctttaggaatagtaaatggaaacatcatttccccttctttcgaagyacttctaccttgatgagatgtatgtattggagtacaatatttgacctagccaagaatttcacaaaagaagcccaaaatatgattttcacgtttactggactgttcacttttggkgggatcactttcttaagattacttaaagtactaatgcttgatgaaaatcatttgtgttttcacttcattaattggagaaagagctacatgtttttgttgttgttgttgttgttttgagatggtgtcttgctctgtctcccaggctggagtgcaatggcgtgatctcagctcactgcaacctccgcctcccgggttcaagcgattytcctgcctcagcctccygagtagctgggactacaggcgcctgccaccacgcccagctaatttttatacttttaatagagacagggtttcaccatattggccaggatggtctcaatctcttgaccttgtgatccacccgccttggcctcccaaagtgctgggattacaggcgtgagccactgcgcccagccagagctacaggttttactgtaacactttagaaggtcctttttctttgtacctctgtgatgtgttcacctagcaacagcttctttgatatgcaaacattctacaggcaaattgctcagagcagctactcatgttggacaattcaggtctcttctggaaactggccttgtatttggaattttctccagagtctgatgtggtaaaaatttatacttttcacttcttactaaatgcagcatagcatactacatcttttgagtgtgtaaaaaataaagtagtcatgtacaaacctaaaatcacagaataatcatgtaayggtgctatattttatttttactttagattcctaatacatttttattgtatctttataaggttagtttgggagaatagcactatcatcatctatattagttaactttgcattaaggtttttcattaaggtttttcccctgtttggttctttcattttacgatccatattttttgtgcctggtatgggatgataaagataacagaaatagctcctgtttttaggtacctttatttgtttgtttgtttggagacagggtcttactctgtcacccaggctggtggcacaatcatagcttactacagactaactcctggctcaagccatcctccacctcagcctcccaagtaactgagattacaggtgcacaccaccacctctggctaattattaaaattttcatagagacaggatctcacttggttggccagactgatctcaaactcctggtctcaagtgatcctcccaccccagcctcctgaagtactaggattgcaggcatgaaccactgccctggcctagatacatttaatgtagtagaggagatgagatttttacatagtataatattgaatgagacaacagtcaaaagaaaatcacatactataagagaagagattacccttaccttttaggaatcaagaaaactccctggaggagatggtacttgaacttatactggaggatttatatgttcatccttcttggtttatattttgtcccacacggtagcttgtttcttttttcttttttttctttttcttttttwttttttgaggcagagttttgctctgttgcccaggctagagtgcagtggcgcgatctcggctcactgcaacctccrcctcctgggttcaagcgattctcctgcctcagcctccctagtagcttgtttcttagagacagtgtgagtgaaactcattaagtaaagtcaatacagcacaagtttcataaaatggtaaagaaatagaaataaaagtaaaggatgaaattcttaagaactttgtcaggccrggcgtggtggctcatgcctgtaatcccagcactttgggaggccgaggtgggtggatcacctgaggtcaggagtttgagaccagcctggccaacatggcaaaaccctgtctctctaaaaatacaaaaattagctgggcatgctggcgggtgcctataatcccagctactcgggaggctgaggcaggagaatcgcttgaacccaggaggcggaggttgcagtgagccgagatcacatcattccactccagcctgggtgccaagagcaaaaaactccatcttgaaaaataaagaaytttgtctccagtatcattcttgttctaggactgagaaacagttcattcttcattttcgtctactaaaatttaagttctttgattttcttctttaggtcttggaaaaagaattaatagagtaattttcttaggtatcaagtaatgaaaatgagaaaagagactagtctcattatagatttttttttttattcttattttattttatttgagacaaggtctcgctctgtcacccaggctggagtgtagtggctccattatggttccctgcagccttgaactcaggggcccaagcaatcctcccacctcagcatcccgagcagctgggactacaggtgcatgccaccatgcctggctaatttttgtgctttttcgtgtataaagatgagatttcgccatgttgcccaggctggtctcaaactcctgggmtcaagagatctgtccacctcagcctcctaaagcgctgagattacaggcatgagccaccacgtccagcctagagatatttatactttaatagctgcctgcaataccaatacacctagaatgaattagaagaatttgaaaacagatttcaggattagtaaaagaaagtcaagccctatgcctcctgttctacattcctcaaatcacataatcctgattttttcctcttcgtatgaaaattcctctcattttgggcctgtttgattttttgggagacaccacccagcagaaacacaccgcacttacatgcaacccctccattgcacagtttctaaatgcccccccscytttttttccattctctgatcctaaaaaaagaaatccagtggcacaatcacggatctctgcagccttgatctcttagcctcaagtgattctcctgcctcagcttcctragtagctgggaccacaggtgcttgccaccatgcccagctatttttttttctttgtttttttgtaaagatgtgtctcactatcttgcccaggctgatattgaattcctgggctcaagtgatcctcctaccttggcctcccaaagtgctgggattttatatatatatatatatatatatatatatatatatatatttccattttacttatgttaatgctttccctcttttggcatagaaaagctaataaagcttaaacttaaatggaacttgtataaacacaatatatctgatgatacctttgagagatgtcttacatttgtcttttctttcagcaaaatgtgatgccagtccctgaaatgtgtagcaatttaattatgggtagcattcttytttccctgtacttactatagtattaacttactactaatgctaagaagtttataatttttgataattcagatttggattagattaagatttatgtctatgcataattcattaaaaactttttaaaccaaattgtcaaaaaagattgtaggtaccttgtttaaagaaaatatataagctagtttcaagaattccaaaatattttttaaaagcagctctgtacatgtcgataartyatttgctcattgtaattttttgaatctgtttgtcaaagcaaatgtagacgggctcgaactcctgacctcaaatgatccacccgcctcagtctcccaaatgctggtattacaggcatgagccacygctcatggcctgttatcatttttaattgaaaattttactgagataattgtagattcacttgccattataagaaataattcagagatatcacttgtatacttagcccagtgtcccccaaaggtaaaattttgcaaaattatagtctaatgtaacagcrtgaatattgacattaatacaatccactgagtttattcagatttccccagttttacttgtattcaattgtgtgtttgtgtattaagttcgatataactagtcaatatactgaacagttctaacatcacaagtatccttcaggtagcccttttgtatccacatccacttccttctcatccccarctattgacaaccactaatcccttttccatttctaaaatgtgatttcaaaaatgttacatacttggctgggggcrgtggctcatgcctgtwatcccagcactttggatatackgtctctactaaaaatacaaaaattagctgggagtggttgtgcacacctgtaatcccaggtgcttgggaagctgaggcaggagaattgcttgaacccaggaggcagagcttgcagtgagccgagagtgtgccacttcactccagcctgggcaacagagtgagactctgtttcaaaaataaataaataaataaataaaatggtcttcatacagcctttgctgctaggaaatatagtttctaattaatgtaattttttgtcaaatacaaaatgcttctgaacgtttctggttatcaagctggtaatctttcacagtgtcctcaatttttttttctactctcttactagttctccagatcacatgcaggctattaagaaatgtgaactaacaagttaaagtagcaggacgggcgctgtggctcacacctataatcccagcactttgggaagctgaggcaggtggatcacttgaggtcaggagtttgagagcagcctggccaacaaggtgaaaccacatctctactaaaaaaaaaaaaaatttgccaggtgtggtggtgcatacctgtaatcctagctatttgggaggctgaggcatgagaatcgcttgaacccaggaggcagaggctgcggggagccaggatcatagcactgcactccagcctgggtgacagagctagaccctgtctgaaaaaaaaaaaaaatgttagtagcagcagagcacagtggctcatgcctgtaatcccaacactatgggagtctgaggcrggaggatctcttgagcttaggagttcaagaccagcctgacaacatagtaagactccatctctacaaataatcattaaaaaaattagccgggcgtagtggcacctacctgtagtcccagctactggggaggctgagatgggaggatcacctgrgcctgggaggtcaaggctgcagtgagctgtgatcgccattgtactccaaactgggtgacaagagtgagaccatgcctcaaaaataataataataaatgtataatttaaatgtgacctaacattatgaagtttttaaaaacaaaattataaatgattttaacactttctcattagctaagaaatcttcagaacaaacttttcataaaagaaacttcactgcaagagttgaagcctgagctagaaagttacaaagaaaataatgtacgacagtcgttccagataatgtccctgaaagataatatcaaggacctacagaaacttactgcttctctaaccagaattaaatatttgagaaacaccaatattcagaggcttcaaagaggcaactggaatttaactaaatgaattattgagctagaaactgtctaaggtagggatttttccagtttgttttcaaacatgtcttttgttgtaagcttgcaaatagcatatgaactccatactcctgattgatcatagaatttaaatctgcagaatttcacttaatacctgacccaacattattatattttgtattgagatataacttaaatacctcgggccaggtgtggtggctcatgcctataatcccagcactttgggaggccagggctggtgaatcacttgaggtcaggagttcaaaaccagcctggccaacatgacaaaaccctgtctctactaaaaatacaaaaaattagctgggcatggtggcatgcacctgtaatcccagctactcaggaggctgaggtagaagaatcacttgaatccaggaggtgcgagactctgtctaaaaaaaaaaaatccaatttgagatataacttacatacctcaagattcagttaaagtgtacaattcaatggttgtacaatcatcaccactrtctaatttcagaacaatttcatcacacctccccaccccccactgcaaaaaaaaacccatgcccggctgggcacggtggctcatgcctgagatcccagcactttgggaggccgagacaggcggatcacaaggtcaggagttcgagaccagcctggccaacatggcgaaaccccatctctactaactacaggcaggtgcctgtaatcccagctactcaggaggctgaggcaggagaatagcttaaatccaggaggckgaggttgtggtgagctgagatcatgccattgcactccagcctgagcagcaagagtgaaaykctgtctcaaaaaaaaaaaaaaaaaaaaaaaaaagatttaatgattgacctgctggattttgaacttgcatggggcctatagcctctttcttttggccaaattctcccttttggaatgagagtatttacccaatgcctgcaattcccattatatttcggaagtcactaacttgttttgttgttgttgttgttgttgttgtttgagacagagtcttgctctgttgcccaggctggaatgcaatggcacaatctcggctcactgcaacctctgcctcccgggttcaagtgattctcctgcctcggcctcccaagtagctgagatcacaggcatgcaccaccacccccggctaatttttgtatttttagcagagatgggggtttcaccatgttggccaggctagtctccaactcctgacttcaggtgatccaccggccttggcctcccaaagtgctgggattacaggcatgagccaccgtgcccagcccgaagttactaacttgttttggattttacgggctcacaggcagaagggacttgccttgtytcagatgagactttgttctttgggcttttgagttaatgctggaatgagttagaactttgggggaactgttgggaaggcagattgtattttgaaatgtgagaaggacatgagatttgagagggcccagtgggagaatgggataaggcttgagtctgtgtccctgcccaaatctgatgtcaaagtataatccccagtgttagggcctggtgggagctgattggatcatgggggtgtatttcccctttggtgctgttctcatgatagtgagtgagttaccatgagatctggttgtttaaaagtgtgtagcacctctcacctcactctattccttctgctctggccatgtaagatgtgcctgcttccccytcaccttctgccatgattgtaagtttcctgaggcttccctagccatgcttcccatgcagcctgtggaactgtgagccaattaaacctcttttctttgtaaattacctagtctgaagcatttctttacagaagtgcaagaacagactaatacattgaacatctcttcatgtgcttattggccatgtgtatatcttctttgtagaaatacctattcatatttgttgtcccttttaaaattgggttgkctttttattgctgagttgtaagtgttctttatattttctggatactggacttttattaagtgtataatttgtaaatattttctcccaatttgtgggtcatctttccactttcctaaaagtgtcatttcaagcaaaaattttaatttkgatggagttgtgtgtgtgtgtgtgtgtgkatgtgtatgtgtgtctttggtgtcatagctgagaaattattgtcaaatccaggatcatgaaagatttacatctatattttcttttaagagttatagttttggccgggcgtggtggctcatgcctgtaattccagcactttgggaggccaaggcaggtggagttcgagaccagcctggccaacatggtgaaactccgtccctactaaaaatacaaaaattagctgagcatggtggcacacgcctgtaatcccagctgctcgtgaggctgaggcagaagaatagcttgagcccgggagacagaggttgcagtgggccaaaatcatgccacggcactccagcctggccgacagactctgtctcaaaaaaaaaaaaagatttatagttttggctgggcgtggtggctcatgcctataatcccagcatttkgggaggccaaggcaggtggataactttaggccaggagtttgagaccagccgggctgacataacaaaacctgatctctactaaaagtacaaaacttaggctgggcacagtgactcatgcctgtaatcccagcactctgggaggccgagatgggcagataatttgaggccaggcattggagaccagcctggccaacatggtaaaaccctgtctctactaaaaatacaaaaatcagctgggcgtggtggcacgcacctgtaatttcagctactcgggaggctgaggcgggagaattgcttgaacccaggaggcagaggtggcagtgaattgagatcatgccactacacttcagcccgggtgatagaacgagactctgtctcaaaataayaataataataataataataataataataatagctggacatggtggtgcacacctgtagtcccagctacgtggaaggctgaagcaggagaattgcttgaacccagaaggtggaggttgcagtgagccaagattgtgccactgcactccagcctgggtgacagagcaagacaggtgtactccagactgggtgactgcaccccagcctgggtgacactgcactccagcctgggtgacagagcaactaactaactaactaactaaaactacagttagtttatatatagtttttagttaaaactatagttagtttgagccaggcgcggtgsctcacgcctgtaatcccagcactttgggaggccgaggcgggcggatcacgagaataaggagatcgagaccatcctggctaacaaggtgaaaccccgtctctactaaaaaatacaaaaaattaggcgggcgtggtggcgggcgcctgtggtcccagctagtcgggaggctgaggcaggagaatggcgtgaacccgggaggcggggcttgcagtgagccgagatcgcaccaatgcacctccagcctgggcggcagagcgagactccgtctcaaaaaaaaaaacaaaaacaaaaacaaaaaaaaagccatagtctttctaaaactatagttagtttataattaactatagttttagttataaaatataactataaagttatagttttagcacttacatttatgtctttgacttcttttggcaaatttttatgtatgatgtgaggtaggagtccagattcattgtttttcatataaatatccagttgtccttagcacctctgtggaactatcttggcattcttgccaagaatcaattgaccataaatgtatgggtttatctttgggcacccaattctatttcattggtctgtatgtctgtccttataccagcaccacactgtcttgattaatgtagctttgtagtaagttttgaaatgggtaagtgtgaaaaattccaacttaatytcatttttttcaagatcattctggctattttgggtcccttgcttttccatatgtattttaagatcagcttttccatgaacatggaatatttttccatttatttaagtcttctttaatttctttttttttttttccccgagatggcgtcatgctctgtcgtccaggctggagtgcagtggcacgatctcggctcactgcaacctctgcctcctgggttcaagcaattctcctgcctcagcctcctgaattgctaggattacagatgctcaccaccatgcccagctaatttttgtatttttagtagagacagggtttcaccatgttagccagactggtcttgaactcctgaccttgtgatccacccgccttggcctcccaaagtgctgggattacaggcgtgagccaccgcgcctggccttctttttctttttcttagagacagggtctcactctgttacccaggctgcagtgcagtggcacaatcatagttcagtgtaatcttgaattcctgggctcaagcaatcctcctgcctcagcttcccaagtagataggactacagatgcatgcctccatgcttggctaatttttaattttttttttatatagatttggggtcttgctgtgttacccaggctggtctcaaactcctggcctcaatcaatcttactgccttggccttccaaagcactgagattacaggcatgcaccaccacacccagcctctttaaattgttttaacaatgttttgtagttttcagtgtatgtgtgttacatttcttttgttaaatttattactaatattttattccttttatgcattgtaaatgaaactgtttccatatttcattttttgattgtttatttttagagagtagaaatacaattgattcgtgtatatcagtctttgtcctgcaagcttgctgaactcacttattagctctagggtttttttggtatgtgtgtgtggtttccttgggattttctccatacaagactatgaatctgcaaatatgtgggtttttaaaaatttactattattattatttttgagatggagtcatactctgtcatccaggctggagtgcagtggcacgatcacagctcacaacaacttctgcctcccaggctcaagcaattcccctgcctcagcctcctgtagctgagattacaggagtgaaccaccatgcctgactaatttttgcatttttagtagagatggggttttgccatgttgcctaggcttgtctcaaactcctgggttcaggctacccacttgccttggcctcccaaagtgctggaattataggcgtgagccaccacacccaaatattgttgagtgtttttaatcacaaaagtgtgttggattttttgtccaatgctttttttttttttgcatcttactgaaataatcatgtgattttatcctctatagaatttgttattgttagacttattgtattagttggtatacagagagaggagatatttgataatgtgccctcagttgacaggagaaacaaagtcattaatttttcctcttataataagaataatatttgagaaactcacacaatatgaaaagctattctattcagatgtgcacactactgtagcctatttctattttgtattggttagtatgyatcaggtcatctcataggttggggctcttctgagtcttgcatttctcaaaacacttttttttcttttgctgtatttataccaagtcactttttgtttgtttgttggttggttggttggttggttggttggttggttkgttkkagtcggaatctcactctgtygccgaggctggagtgcagtagagtgatcttggctcactgcaacctctgcctcccaggttcaagcgattctcctgcctcagcctcccaagtagctgggacgacaggtgcacgccactctgcccagctaatttttgtatttttagtagagatggggtttcaccatgttggccaggctggtctcgaactcctgacctcaggcaagccacccacctcagactttcaaagtgctgggattacaggcgtaaaccactgcgcccagactactttttaaaagaaattatataggagactaaaattgaaaaaagaaacaaacctttactcagattgagatattagttaaacttaagggcctgaaacaaggaaaatggggtttgcttttttctggttgtgcagagagtgtatgaataaaaagawctcacaaagttcaagtgaaagactgattaaaagaaattcatcatccaaatatcttctcagtgttaagcaagcacatgaagttagctatagctcgacccttaacagctaatcaggtaaactcttcaactcagttttgaacgtaacatagtatactacagactttttgtttttgtcctcagagstaaagagaaacaatggctatatggcatactatgaggattaattttatatgtctacttgactgggccatagggtgcccaatatatggtcaaacattattttaggtgtttctgtgagagtgttttggataattttaacatttaaattggtatactgagtaaagcagatgatactccctattgtgagtaggcctcatccactgagttaaaggcctgaatagaacaaaaagattaaccctcccccaggtaagagcgaattcttcctgcctgatggccttcaaaatgggacatcagctctttttcctgcctttggactcaaaccattggctcttsctgggtcttgagcctgctgrcctttggactggagctacactatyagctctcttgattttcaggccttcaaacttagactcaaactacattattggctcccctgggtctcccagatcccagcagatcttgggaattgccagccttcataattgctgaggcagttcctttttttgagatgggatcttcctctgtcacccacactggagtgtagtggtacgatcatggcttactgcaacctcaaacacctgggcataagtgatgctcctgactcagcctcctgagtagcagggaccacaggcacatgccaccatgcccagctaattttttaaaaattttttgtagatacaaggtctcactttgttgcccaggctggtcttgaactgctgggctcaagctatccttccacctcagcctcccaaggtgctgggattataggcatgagccactgtgcccagccaaaagtcagaagataattgaatggcatcttaaagtgctgaaagaaaaaatactgacaacccagaatctatactcagtgaaattatccttcaaaattgaagatgaggccgggcgcggtggctcacgcctgtaatcctagcactttgggaggccgaggcgggcggatcacgaggtcaggagatcgagatcatcctggctaacatggtgaaaccccgtcagtactaaaaatacaaaaaaaattagccgggcatggtaacgggtgcctgtagtcccagctactcgggaggctgaggcgggagaatggcgtgaacccaggaggcggagcttgcagtgagccgagatcgcgccactgcactccagcctgggcgagagtgagactccgtctcaaaaaaaaaaaaaaaaaaaaaaaaaaattgaagatgaaataaacatggtttcagaagaaaaaaaaagaaatcatttattgtcagaagaactacactattaagaaacacaccaggcaatttttcaggatgaaggaaaatgatccttggtggctacagagaaatgtagggtagaataaggagtaaagaaagggtaaatagaaattaatactgacaattaatttttaaaaatcctatacaatttataatatatgaaaragtaaaacatatcagtagtacaagggcaagaaatggtaaatggagttaagctatcataagtgttttatttagggagtatcacaaaagtattaaagtagaatgtaataggccgggcggggtagctcacacctgtaatccgagtaccttgggaggctaaggagggcggatcacttgaggtcaagagttcgagatcagcctggccaacatggtgaaaccccacctctactaaaaatacaaaaattagccaggtgtggtggcacacgtctgtaatcccagctacttgggaggctgaagcatgagaatagcttgcacgtgggaggcggaggttgcagtgagccgagatcctgtcactgcactccagcctgggcgacaaagcgagactctcaaaaaaaaaaaaaaaaaargcaygtaataaatcaaatatgcattatgtaatcacaaaatccagcttaacaactaaataataatttaaaagatattaaaaacttaatatggaagaaaaatgaaataaaaaactttattaatccaaggccgggcgcggtggctcatgcctgtaatcccagcactttgggaggccgaggcgggtggaccacttgaggccaggagttccagaccagcctggccaacatgatgaaaccccgtctctactaaaaatacctgggcaaagtagagcatgcctggccgggcgcagtggctcatgcctgtaatcccagcactttgggaggctgagacrggtggatcakgaggtcaggagatcgagaccatcctggccaacatggtgaaaccctgtctctactaaaaatacaagaattaactgggcatggtggcacatgcctgtaattccagctactctggaagctgaggcaggagaattgcttgaaccagggaatcaggttgcagtgagctgagatcatgccactgcattgcaatctggcgacagagcgagattctgtctcaaaaaaaaaaaaaaaaattagagcatgcctataatctgagctactcaggaggctgagacacgagaatcacttgaacccagggmggcggaggtgcagtgagcagcgatcacaccactgcattccagcctgggcgacagagtgagactccctctcaaaaaacaaacaaacaaacaaacaaaaactttattaatccaaattaaaatggtagagtagtagtaaaggaacagagaatagatggtaaaaacaataaataacatgataaacccgacaatttcaataataactttaaagatagatggtattgtaactgcccaatgggttcaccttgcccgctgcctagacagagacgatttctcaagacaggggaattgcaatagagaaagataaattcacgcagagctggctgtatgggagaccagagttttattattactcaaatcagtatccacaagcattccgccttcagaatttttaaggacaacatgttgggtgggaggaagccagtragctgggagtgctgattggtcagagctgaaatcatagggaatggaagctgtcttcttragctgagtcaattcctgggtggggactgcaagatcagatgagtcaggttatcaatctacgtggtgccagctgacccatcaaatgcagggtctgcaaaatatctcaagcactgatcttaggagcagtttagggagggtcagaatcttgtagcctccagctgcaagactcctaaaccataatttctaatcttgtggttaatgttagtcctaccaaggcaatctagtctccaggcaagaaggaggkctgctttgggaaagggctgtcatctttgttttaaactataaactataaagtaagtttctcccaaagttagttcagcctacacccaggaatgcacaaggacagtttggaggttagaaacaagatggggtcagttaagttagatctctttcactgtctcaggcataattttgcacaggcggtttcagtataatcatttcagtacaagacaagatttwaaaaaagaaaactaatgctaagcatttttcaagaaacatactgtaggccgggtgcagtggctcacgcctgtaattccagcaccttgggaggctgaggcgggcggatcacgaggtcaggagatcgagaccatcctggctaacatggtgaaaccccgtctctactaaaaacacaaaaaaattagccgggtgtggtggygggcacctgtagtcccagctactcrggaggctgaggcaggagaatgggtcaacccaggaggcagagcttgcagtgagccaagatcctgccactgcactccagcctgggtgacagagcgagactctgtctcaaataaaaaaaaagaaggaaacatactgtagccagacgccacctatagtcccagatacttgggaggctgaggcaggaggatagcttgggaccagtttgagaccagcctgagcaacatagcaagaccctgtctccaaaatttaaaaatgtttaaaaagagatatattttacatataagaacacagaaagatgttattaaaaataaaaaaatgacatttgggtaatgtgaatattaccctaaagaaagctgcatctatgtggaactgttaccgggaatgggtcccaatctagaccccaagagagggttcttggacctyacgcaagaaagaattaggggcaaatccataaagtgaaagcaagtttattgggaaagtaaaggaataaagaatggctactccataggtagagtcacagtatgggctgcttaactgagtatactcagttatttcttgattatatgctaaacaaggggtggattattcatcagttttctggaaaaggggcaggcatttstcggaactgagggttccttctttttttagactgtatagggtaacttcctgatgttgccatggtatttataaactgtcatggccctagtgggagagtcttttarcatgctaatgcattataattagtgtataatgagcactgaggacaaccagaggtcacctttgtcaccatcttggttttggtaggtttgggctatctttatcgcattctgtttcatcagcagggtctttgtggtctgtatcttgtgctgacctcctatctcatcctgtgactaagaatgcctaagctcctgggaatgcagccagtagttctgagccttactttacccagcccctattcaagatggagttgctctggttctaatgcctctgacagaacctcctgattgtcacaatattaccagtagcagcaggcagctattcacacccaaatttcaccttaaaaagaatggcttcaaaattgacctcccccatgggaaatattgcaggacttaacacagrattgtttttctcttcatttctctacgatttctttctttctttttttttccttttttccgaggtggagtttctctctttttgcccaggctggagtgcactggtgcaatcttggctcaccacaacctctgtctccygggttcaagcaattctcctgcctcagcctcccgagtagctgggattacaggcatgcgccaccacgccaggctaattttgtatttttagtagagacggtgtttctccatgttgcaacctcaggtgacccgcccacctcggcctcccaaagtgctgggattacaggcgtgagccactgcacccagcctaccatttctttttgggacagggtcttgctgtgttgcccaggctggtttctaactcctgggctcaagcgatccactggcctcagcctcctgaagtgctgggattacaggagtsagccactgcaycaggcccatttctctaccatttctgatctctctctagaaacacttggataactgcacagctcctttcataagaaatatattttagggccrggtgtggtggcttatgcctgtaatctcagcactttgggaggccgcggcaggtggatcaaccgaggtcaggagttcaagaccagcctggccaagatggtgaaaccccatctccactaaaaatacaaaaaattagtcaggagtggtggtgcatgcctgtaatcccagctactcaggaggctgaggcaggagaatcacctgaacccaggaggcggaggttgcagtgacccaacattgcgccattgcatgccagtctgagcaacaagagtgaaactttgtctcaaaaaacaaataaacaaatgaacaaacaaacaaaaaatcattgttattcctcagagtaagagcaaagatcatcccctgcagaagcttaggaactatgcacagaactttacagaacaggggcgatgctttaactgaaggctgactactgaccagagaatggaattctgagagggctcaaggaataaaagraaactaggcagggaaagggaaggcgcccatctgaagcaaacttcagcggccatcaggatatcttgtggtggtcacaagttgtaggctctgtttttggaaggtttgggtatagcgcaggattccatttgtctacttggctacacctctgcctgaggtacactgttgccagaaaagagggtcccaatccagaccccaagagcaggttactggatcttgcacaggaaataattcaagggaagtcacacagcacagagaaaaagcaagttcatacaatgttactgagtwagttatcgccagaaagcaggaggaggaacacgccatccttgttagtgtctctatttataagaaacttatgagaagctataattaaacttggaacatgcagatgtgctcactaaaggtaggggctattggtgttatagatgaccattaatctttcaacctaagcctgctcattaatggcatctttaatraagtgggctacactcttaggacatctggacattctgcaggattggtgggagatgttctgtatggccaccaatattctgtaattataattggtggtcagcttgggatgtggctattttcagaccacaagcattaaccttacagagtgcctagctactcatttcaaggtggagtcactctggccatgttttaccaaaccagaggtctggtaaggagaggttcctctaacaccatgaggtcaacgtcactcaagttcctggccagccaaactctgaaagcaaggagtcccaaattgaggatcaagttcctccagaaatcattgctatgggtggcaaagcagtagattccctgaagccaatctcccacattgtctggaattttgggagcttcatttgcccagttggcagtgccaatggggaccccgctggaagccatagtagcacctttgggctctgcataggacttgctcaatacaccatattggagtcgttggctctttttgttattttaagttgaaatttgaagattggctgagttggtttcatgatattgttgcctactgatatcttacacagagtacgagtacatctggttgaaagagaaaaggcagagagaaaagcagactttttggagttgttgttctcaggcactaacagattcatcccttatatgcatatgaatggacaataagatttcttggatattttcatggcaaaggtgaggagaaatttttattgctttttgaagaaacatgatttttattaccttgggttattccaggagataattgataaatgttgagtagtttgttggtcttcttcttaaaggaggatcaagagaagcagtacagcatggcagactagaagcatttctgtttttttgttttgttttgtttgagatgaagtctcgctctgttgccgaggctggagtgcagtggagtgatctytgctcactgcaagctccgcctcctgggttcaagtgattctcctgcctcagcctccaaagtatctgggattacaggcatgtgccaccacgcccggctaatttttacatttctagtagagacggggtttcaccatgttagccaggctggtctcaaactcctgaccttaaatgatccacccacctcggcctcccaaagtgctgggattacaggcatgagccaccgcacctggctgaagggtcttcagtatcatctctgtgatagataaattgtttagtgggttatctacattggccattgacatctagaattagggtatgagttgggtttagaagaaggaaatgaggctggtctccaatagacagtgattcatatgataagcagaaagtgttacagaagtctggtagaggaggatgggagacagattattgtcaaggagatagtaaaagtttattttgaaatccttagactatgccgggctcagtgggtcacacctgtaatcccagcactttgggaggccgaggcgggcggatcacctgaggtcaggagttcgagaccagcctgaccaacatgaagaaactcggtctttattaaaaatacaaaattagccaggcgtggtggtgcatgcctgtaatcccagctacttgggaggctgaggcaggagaatcacttgaatctgggaggcggaggttgtggtgagccaagatcgcgccattgcactcctgcctgggcaataagggcgaaactccatctcaaaaaaaagaaagaaatccttagactataagtttgttatatratctgcatgtaaaacaaggtcctatatgactyaaataatgtgcagggttccctttaaaaagttcagcaactactttcctttttttttttttgagatggagtctcactctgtcacccaggctggagtgggttggtgcaatcttggctcactgaaacctctgcctcctgggctcaagccatcttctcacctcagcatcctcrgtaatttagttgggactactggcgtgcgccaccatgcccggctaattttcctgtattttgtggagagacggggtttcaccatgttgcccaggcttgtctcaaactcctgggctcaagtgatcctcctgccttgatctcccaaagtgctaggattacaggcgtgagccaccacacctggccaatgactttcaaatttgtttaaagtaatcccaatctttatttgcctctctcaagtaattaatgataacactttctttaaaaaaaaaatgctgtcactaggctgggtgcggtggctcacatctgtaatcccagcactttgggaagccgaggcgggtggatcacctgaggtcaggagttcgagaccagcctgaccaacacggkgaaaccctgtctctactaaatacaaaaattagccaggtatggtggtgggcacctgtaattccagctacttaggaggctgaggaaggagaatcrcttgaaccccgggaggtggaggttgcattgagccgagatggcaccattgcactccagcctgggcaacaagagcaaaactgtctcaaaaaaaaaaaaaaaaaaaaaaaaaaacagaccgggcatggtggctcacacctgtaatcccagcactttgggaggcagaggcaggtggatcacctgaagtcaggagtttgagaccagcctggccaacatggcaaaaccccacctctactaaaaatacaaaaaaattagctgggcacrgtggcaggtgcctgtaatctcatctactagggaagctgaagcaggggaatcgcttgaacctgggagacggaggttgcagtgagctgaggttgtgccattgcactccagcctgggagacagagcaagactccatctcaaaaaaaaaaaaaaaaawawgtcactaatctctaagatctctgaataactctctcagaattagagtccatacagctctgatcttttcttcttttatgctgcttgtttttccaaggcttttagtgatgcaaacttatcattactttaacaattccagctttccttytatgtcttggttttacacgacaagaagcccagaaactgaacttgcttactcagctcccgaggttgaaggtggcaagaaggtggtaagaatcctagacaggctaggcctggtggctcacgcctataatcctaacaatttgggaggccaagrcaggaggatcgcttgaggccaggagttcgagactagcctggggaacatagtgagaccctgtctctacaaaaaaaaaaaagaaaaaattagctgggtgtggtagtgcacacctgtggtcccagctactcaggaggccaagttgggaggattgcttgagcccaggaggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatgattacaagagtgcaggggaaaggttggggaaaagaaatgtgacttctttcacttttacattattgaaattgttatttaaattgtattctataaccataattaaatcttcataaacttttcacttaatgatcttagcattcattgatggtctttgcctgaatcttatttcaaaaggcaaggcatttcaaaaatgctgatttttaaaatttctatcatttcttatacacttattagctcacatttttctgtaatgagtttacccttatcaagtgggactctttkkttagctgctcctctaagctaattttcttgtattctcaaagcagtttctccatactatcatttcaatacctcttgctgttctagtttgctgttttgagtatgtccttgtcttacttatgtgattgactttttttttgagatggagtttctctctcgtcgcccaggctggagtgcaatggcaccatctctgctcactgcaacctccgcctcccaagttcaagcaattctcctacctcagcttcccgaataactgggattacaggcacctgccaccacacccagataatttttgtatttttagtagagacggggtttcaccatgctggtcaggctggtcttgaactcctgacctcagaggatccacccgccttggccccacaaagtgctgggattccaggcrtgagccacagtgcctggccatgactaactcattccattgagggtcttttctcctgaagttttgtgctatgacttgatatttcaaaagaagggaaatagatgtctcagtattaaatttcaaacgggaagtttaacctgtatattggcttatttagggtaagagtgaagctatcctggacaagaactttgacaggacaatactattcactctgaaggaccaaaaaatgagcagaaaatttgggataaatgtcaacaagatttgaaccctaaagaaaagcaagcatcgagttagacagacgtccatattcattcaactgggaaaataaaactgcagtcccaacatcagaatttccttggtcagttggttattgcgggacagcattcttctgcatgacagtattgtctccttaccagccacagaggaggctgtgagagagaggatttgggaaattggtgcaaatgagaaatcttggaaatctgtaagtatatagatataaaagttattctttccagtttgattyttttatgatgtagattttaatatcmgtcaatttaggaaactctgtggctctgaattatagttataattctagttttactattacagtgaaagaagagaagaggctgttcattattatattggaagtagtgtagcatgtttattaagagtgcagagccccagcatgaagcctagctctgccatttgccagctgtgtgtgctcttgggcagactacttatcctctctgtgcctcattttcatttgtgaagtaggggacggtgtgtagttcccacctcacagagtggttgcaaggaccaaatgggttaatacatgataaatgcttagtttagtgtaagttcaataaatatcaaaatagtggtatgttaaagatagtgtttacatgataacctaaaattaattgccagtttgttttaatttactggtcaagtctatcaaatgattgaatcagcatgtttaagtggatatatctcatttrtgtccagatcattttagtatattcatgactcctcactttaaaattcaaatgataataggtacagttagtcctccatatctgtggattcaaccaagtaaaaataaaaaattgcatcacaacaaggcatggtggctcacatctgtagtcccagcactttgggaggctgaggcgggtggaccgcttgaggccaggagtttgagaccagcctggccaacatgacaaaaacccatctctactaaaaatacaaaaatcagctgggtggtggtggcttgcacttgtagtcccagctactcgggaggctgagggatgagaattgcttgaacccaggaggtggaggttgcaatgggccgacatctcaccactacactctagcccgggcaacaaatcaagactgtctctttttttttttttttttgagacgaagtctcgctcastcgcccaggctagagcgcagtggcgcaatctcggctcactgcaagctccgcctcccaggttcacgccattctcctgcctcagcctcccaagtagctgggactacaggcgcccaccaccacgcctggctaattttttgtatttttagtagagacggggtttcaccgtgttagccaggatggtctcgatctcctgacctcgtgatccgcccgtctcggcctcccaaagtgctgggattacaagcgtgagccaccgtgcccggccaagactgtctcaaaaaaaaaaaaaaattgcatctgtactgaacatgtacagacattcttccttttcattattctctaaacaacagagtacaactatttacataacatttacgttatattaggtattataaaagtctcccgagagacagaggttgcagtgagccgagatcgcgccattgcactccagcccgggggaccagagcgagtcttcctctcaaaaaaaaaaaaaaaaaaaattgagatgatttaaagtgtacaggaggatgtgaataggttagatacaagcacaataccattttgtatcaaagacttgagtattcataaattttggcatctctaggaggttctgacaccagtctcccagggacgctagggacgcctgtatatggcttagattcagtgtgttagtgaaacctgctacacagtagcctgtttagagttccccatttttaaaaatactctgctyttttaaaattcattatacagccttatttctcagtactgactaaaatgtcttatttttatatatcgaagctttctatttattttttaaaccaatgtatacatgtcaaatcctaaaatcgcctgtattaatctacttagtaacttaatgccactccaatgtggatataaatagaacttgcacatagttttgaaactacgtagaaagcatggaggctgggtgcgtaggctcacgcctgtaatcccagcactttgggaggctaaggtgggcagatcacctgaattcaggagttcgagaccagcctgaccaatatggcaaaaccccgtctctaccaaaaatacaaaaattagcctggcatggtggcatgcacctgtagtgccagctacttgggaggctgagacaggataattgcttgaacctgggaggcggaggttaccgtgagccaacgtggcaccactgcactccagcctgggtgaaagagcgagactctgtcttaagaaagaaagaaagcgggcgggggggcggggggaagggcaagcaagcatagagcatgaggaagtttttaatgtctttttcttacagagaactaaagcctttcagcaggaaatccagatgctcactaagtgactagagcagctgcatcatctttaagaagaaggtgctcaagaatcatcccaagctgaagaaaaaagtattgggaacaaaaaagacccttgaaatgtctagaaagaaaaattgagatcaaggactttttcaagagagattagacttggacaggaagaaagtaagaatttcctgaagtataagcattcctttgataatgaaaatgattgcattttattcataactttaactttatctaatgtttgaagctgttaatactgttaatacttttctccacattgggaaaggggggaaatttgctacaaactctgaaagcttccgattttattttatttatttatttatattttttgagagagagtctcgctctgtcaccagactggagtgcagtgacgctatcttggctcactgcaacctctgcctcctgggttcaagcgattctcctgcctcagcctcccgagtagctgggactacaggcacgcgccaccatgcccagctaatttttgtatttttagtagagacgaggtttcaccattttagccaggatggtctcaatctcttgaccttatgatccacctgcctcagcctcccaaagtgctgggattacaggcatgagccactgccctggcctctgattttatttttaaaagcctcttctctctccgtatctccatgtctcttttgtgtacttatttgatgtttgttgtgagggcatctgtttacatatatatctcaatgtactttaaggagaggattagaagaaaaggagctcaaaggaataactctctttttttcttttttttcagatggagtctcactctgtcacccagggtggagtgcaatggtgtgatctcggctcactgcaacctccgcctcccaggttcaagcgattttcctgcctcagcctcccaagtagctgggattacaggtgctcaccacccgcccggctaacttttgtatttttagtagagacaaggtttcaccatgttggccagtctggtctcaaactcctgactgcaggtgatctgcctgccttggccttccaaagtgctgggattacatgtgtgagccactgtgcccggccaaaggaataactctctaatggggaaattttaggaattgtgacaggcagatataatgagcattgatgaggggccattgatgatgtctctcaataatcactgtataagtcattctcttctctactctctgcttccctgaatctgtaaggaaaaaggcagtcctaaaagttggatagaaataggtaggttgcaatacaatttattttcaggagattctctattttactacctcttcatagaattgcctatcatagccgggcacagtggctcacacmtrtaatccyagcaytttgggaggctgagacaggcggatcacgaggtcaggagattgagaccatcctggccaacatggtgaaactctgtctctactaaaaatacaataattagctggatgtggtggcacacacctataatcccagctactctggaggctgaggcaggagaattgcttgaactcaggaggcagaaattgcagtgagccaaggtagtgccgctacattgcagcctggtgacagagcaagactccatctcaagaaaagaaaaaaaaaaaaaaaaaagaattgcctatcataaccaaattacgttatagtatttctataattgctatggtccaaagtggaatcttgctcactcatttaccatttactcatttagtcttttttttttttttttttctgagactgagtctcactccatcacccaggctggagtgcagtggcgcaatctcggctcactgcaacctccacctcccaggttccaatgattctcctgcctcagcctcccgagtagctgggactataggtgtgtgccaccacacccagctaatttttgcagtttttagtagagatgcagggtttcaccatgttggccaggctggtcttgaactcctgacctcgttatctgcctgcctcagcctcccaaagtgctgggattataggcatgagccactgcgcccagccttcatttagtcttttggctcattcatttgtttatccaatatttattgagcattcagttttcttttcttttcttttttgagacggagttttgcccttgttgcctaggctggagtgcaatggcgcgatcttggctcactgcaatctctgcctcccgagctcaagcgattctcctgcctcagtctcctgagtagctgggatwacaggcatgcgccaccacacctgtctaattttgtatttttagtagtgacagtgtttctccatgttgttcaggctggtctcgaactcccgacctcagatgaccagcccaccttggcctcccaaagtgctgggattacaggtgtgagccaccatgcccggcctaatagttttctttactagagttcttgggttttctggatttcactgtatattgtcaaattgtttcctaggaaataatgtatttttaaaatttcacttatttattttataaataatttgattctaaaggtggaacagtttggaccagctcatgggagaactgtctttttttttttttttttgagacagtcttgctctgcctcccaggctggaatgtggtgttaccatcacgattcactgtagcctcaacctcctaaggctcaagtgctcctcttgcctcagactcccgagtagctgggaccacaggtgcacaccactatgcccagctaatttttgtagaaatggggtctttccatgttgctcaggctggtcttgaactccttgtggctcaaatgatccgcccatctctgcctcccaaagtactggaattayagcctttatttcttttagattttcaatttactgcccctaagttgcaaaatgttctcttagaattatttttatctttgcattctgtatccattctgtatgcatatctatatattctgtatattcctcctttctaatattgtgtattttcactttctctctttcctttttaaccaggcttgcctgaggcatctattttatctttccaaagaaccagtggttctttttgagacagggtctggctctgtctattgtccaggctggagtgcagtggcrtgattatggctcactgaagcctcaaccttcagggctccagtgatcctcctgcctcagcctcccagatagctggaactataggtgcacgcctccacgcctggctagctttttgaagtttttgtagagatgaggtttcgccatgttgcccaggctggtctcaaactgctgagctcaagtgattctcccgcctcggcctcccaaagtgctagtattacaggcatgattcaccgtgcctggccagttctttttttaaaatatacgttttatggcctggcacgctggctcaccctgtaatcccagcattttgggaggctgaggtgggcagatcacttgaggtcaggaattcgagaccagcctgaccaacgtggtaaaaccctgtctctactaaaaatgcaaaagttaactgggcatggtggtgtgcacctctaatctcagctacttgggaggctgaggcaggagaatcacttgaaccagggaggtggaggttgcattgagctgagattgtggcactgcactccagcctgggcaacagagcgagactgtctcaaaaataaataaataaataaataaatacacattttattagtttattttggtttatatgtaatgaatatatatagtatgtttattaaatctgcaccctactttctcttttcccttcttaagtaaatgtgctttttttgtcttttgtttttaaatcagaaaaagagtaagtactattgaatgttcctctgtagcttgtccaatagatttttataagaaatgtttcttttcactgtgttctatgtatttttgtaattttagtgttgatttccattttttggctgaaggtattcagaatttttgtttgtttgttttttgtttttgagacggagtttcactcttgttgccaaggctggagtgaagtggtgcaatctcggctcactgcaacctctgcctcccagattcaagcaattctcctgcctcagcctccctagtagctgggattacaggtgtgcaccaccatgcccagtgaatttttgtatttttagtagaggtggggtttcaccaccttggccaggctggtctcgaattcctgacctcaggtgatccccatgcctcgacctcccaaagtgctgggattacaggcgtgagccaccgcacccagcctagaatttttttaaccctttatacacacacacacacacacacacacacacamttttcaaaatcaaatataccaagagtcttttattgaaaaggagcagccctcttctgtacctctcttatttcccagagggaactctttaactcttttagctgtttctgatagtaacttccattttcctaaacaattttaaactgccttatctcgagttatctatattagacatgttgttgatttcctgttatatgatagatgaaatttcatctctcataccactttcctacctgctcctttcatcttcccaatctggttatattgatattttaagctaaatgcataatcagcatttactttaccgtgatactaaatgtttacaaaagcatgaagtactatattcttggtacattttctttcttgtattgcattttatttttcctacagttaataccttccttatattttcatacgtttaattttcagtgttcatttatyaaggtttttttcctgcctaaatctgtatcagatgatcctttagtctttaaaaatctcccattttttctctcccaaagtccttcattcccttgcttcagtctggattttactctgtgggcctgagcacagccatgatgccatgactttccttctctaatctcctggttaggtttcattgtttgccgaatcacatttcttcctcttttttggtttcctttcttattttactggaacacatcctccaatggcttcctaagaaatggtgccttggagagcgacattttttgaggtccttgtgtgaatgacaatgtctttttttgtttgaatcatcatactcaattgatagctgggtttagactttattttcacacacggacttcattgtcttctaatctctagggttgttattgaggaaaatatgccattctgattcttgttccttaatatgttatttcttktaatggattaaaacatttaccataacttttttgtaataacattttataactaatttttttctcataataaaattaattcagctgggcatagtggctcatgtccgtaattccagcacttagggaggctgaggtgggtggatagctggaacccaggaatttgagatcagcctggacaacatggcaacaccccatctctacaaaaaatttaagaactagccaggcatgrtgcacacttgtagtcccagttactggggaggcttaggtgggaggatgggttgagcacgggaggtcgaggctgcagtgtgctgtgattgcaccactgcactccagcctgagcggcagggtgagaccctgtctcaaaaaattaaaaaatcatgtgtattagtgaagatttgtaaagtagaaaataatagaaataaaattgaaatcaccagtaatcccaccattttgcgataactagtattaaatataggtatatttccctctgattattttccatgtatatttttatcatcattgagatgtacatagtttttcttaatcctgcttttttcattaactacatcattgttaatttttcttaataaatatttttgaaaacttaatttctagggaataatctatcatataataatttttcttttttgacatttgcattgtttcagttttttctattatgaataatgttgtaaagaatatctttgtgggccaggtgcggtggctcatgcctgtaatctcagcagtttgggaggccaaggtgggcggatcacctgaggtcaggagtttgcgatcagcctggccaacatggtgaaaccctgtctctactaaaaataaaaaaattagccaggcatggtgacaagcgcctgtaattccagctactcgggaagctgaggctggggaatcacttgaacctaggaggcggagattgcatttagccaagattatgccattgcactcca

SEQ ID NO: 13456 - DNA, 12666 bp, Homo sapiens
ttatgatcaggaaagcaaatggctgagactgggtaaaaggtaagatcagtgataaagaggaggtccagaaaatgacaggtcagtgtatctgaaggatcttctctaaggatactgaaatcatccaagaatcatgatggaagtaatggtgargaaagtaacagtaagctagtggcaaaatgttttcaaaaagccaaaaagaagccaggcatggtggcatgtgtctgtagtcccagctactcgggaggctgaggcaggaggatcctttgaccccaggggtctgargatgcagtgagctgtgattgctccaccgcatactccagctccaacctgggcaagagaacaagaccccayctctaaaagaaaaaaaraaaagtgaaagagagtgatccaggaatcaggagaggtagaggatgggatattgtgacaaaatgagatttcaacttagatatttttagggaggaggaaaggagaatagcagtgaaggacaatggagrcacctatcccaccaacagaggccctatggtgaaaaggttttgagaataaaattagcaaccgttcaccggggcattacgggaagttgtgtcatccaggagcaccagattttgatttagtgctagaaagccaagagaaccttcacasaagagactgaagacataaacgaaaccacagtggcagacgaaagcttctgatcttgatacacatatcttaagtacagctgacagaagaataaagagaaggaaaaaggagaaaggagaaaggaggaggaggagggaagaaagaagaaagcagaataaagcagcttttgcacaaattcaagcaagagtaaaagagaagagagaaggagagaggagggtaaaacatacagacggcaaataagcatatgaaaagatgctcaacatcatatgycatcaggaaactgcaaattaaaacataccactacacacctattagaatgactaaaatccaaagtactggcaacaccaaatgttagcaaggatgtggagcatcaaaaatgctcattcattgctagcgggaatgcaaaatggtatagccactttggaagacagtttggcaatttcttacaaaacaaacaaaaaacatgttcttaccacacaatccagcaattgtgctccttgatattyacccaaacaattggaaaatgcatgtccacacaaaaacctgcacacaaatgttttcagcagttttatatataattgccaaaagttggaagcaaccaagatgtgcttcaataggtaagtggataagcaaactgtgaatttatggmctaaactgtgtcctccaaaattcgtatgttgaagccctaaccccaaatattactatatcgagagatacwgtctttaggaggtaattaaagttaaatgaggtcattaaagtggggcactaatctgataggactgtggccttataagaagaagaagattctctctctcagtgccrtgtgaggacacaagaagaaggcagccatgtgcatgcaagccaggaagagagccctaaccagaacctgaaggtgcggccatcttgatcttgaactctaacctccagaactgggagaaaataaatttccattgtttaaaccacgcagtctgtggtgttgtcttatggcagcctaggcagactaataggctatagaacatacatactattttttgtaacactgtaaatagtatttttgtaatactatttagtgctaagaagaaatgagctatcaagccatgaaaagacatggagggaccttaagtgcatattgctaagtgaaagaagccaattcaaaaatgctacatactgtatgattccaactatatgacattctgcaaaaggcaaaaccatggagacagtgaaaagatcagtggttacctgaccagaggtagggaagaggaaggaggaaaaaataggtagagcatagggcttttttagggcagtgaaactattctatataatactgtaatwatggatacatgtcattatacctttgtcaaaacccatagaacagtggttcccaaccctgttgggaaccaggccacacagcaggaggtgagcagcaggtgggtgagtgagcgaagcttcatctgtatttacagccactccccatcacttgcattaccgcctgagctccacgacctgtcagatcagcagcagcattagattctcataggagtgtgaaccctactgtgaactgcacatgtgagggatctagagtgcacgctccttatgagaatctaacgcctgatgatctaatcactgtctcccatcacccccagatgagaccatctagttgcaggaaaacaagctcagggctcccactaattctgtattatgttgagttatataattatttcattatatattacagtgtaataacaatacaaataaagtgcacaataaatgtaatgcacttgaatcatcctgaaaacatttcctgtgcctccctgtccccacctcctgtggaaaaattgtctttcatgaaaccagtccctggtgccaaaaggctggggatccctgccatagaatgtacaacagagtgaactttaaatgatgggcttagttaataataatgtaycaatactggctcatcaattgtaaccaatgtaccacactaatgcaagatgttaccaataggagaagctggggatgaaggggaagtatgtggactctttgtactatctgctcaattattgtgtaaatctataattatactaaaaaagtaggcttattatttaaaataattatgtgaaattcaaatttcagtgtctataaagctttatagaaacacagccatgctcacttgtttatgctgtctctggctgctcctgcactatcacagcagacttgagtagttgcaacagtgaccatgtaatcacaaagcctaaaatatttactatctgaacctttacagaaaatgtttgaagactcttgctctaartttcattacctaagttaaaaagaaaaaggaaagcacatccctcacaggctgttctgagttaatcactttatttaaattatttagagttgttaaaatcacaggacatactaattacataatctgatttttaaattttaactagatagtgtctaatattaaaaaaaaatcaaggctagacacagtggcttgagcctgtaatcccatcacctgggaggttgaggcaggatgactgaggccagttggagaccagtctgggcaacacagcaagacccctgtctctacaaaaaattcaaaaattaaaaattaaccaggcatggtagcrgtgtgcacctgtagtcctagcgactcrggaggctcagatggaaggatcacttgagcccaggagttccaggtcacagtgaactatgattgcatcaccgcactccagcctgggcgacagagcaagaccctgtctctaaaagaaacaacaacaacaacaacaaaatcaagtaaatcagtgaagtacttgaacatccaaaacagcaactgtcacagaacgaaacactatcagacagtagtgtttcactctattgccaacaaaatctatcckacttactgaacacctaaggaattaaattaaagtcttcaaagaagagaagactgttaacagtttgaaaagggaaacctggaaaacaatggaaatgggcacattcagggagggacagggcaggatacccgatagaagtgagtcggtgaactgactacaaagaactgaatgctctgtyagagaacattaagtcaagtgatcagataagtctggaaaatgcagcctgggtatcagaagacgacataaaattatgctaccaggaagtgtcccacagttatactttaagaaatgtcactggccgggcacagtggctcacacccgtaatcccagcactttgggaggccgaggtgggcggatcacctgaggtccagagctccagaccagcctaaccaacatggagaaacctcgtctctactaaaaatacaaaattagccgggcgtggtggtgcatgcctgtaatcccagctactcgggaggctgaggcaggagaatcgctcaaacccgagtgrcggaggttgcggtgagccaagattgcgccattacactctagcctgggcaacaaaagcgaaactccatctcaaaaaaagaggtaaagaaaagaaatgtcatgaaaatataatagctgactagctgacaaaataaatcataactacccaatatattcaagtagtcttattaataaccagggatcttaggaagaataaaatctgtagacatgagttaggaaagcattatagaatagatgctaggggtacagactttggaggtagaaaaacctggtctgatccttcttctgccactaactagctctaagaatctgagcacaaattctgttagcctcagtttcctcatctctaaaataaacagtacctcattggactgttggtaggattaaacaaaatacttcatgtcaagagtttaacagggtccctgacacaaagagctaaataaatggttactgtcactaatgcatttggcttgggaaaatgggaataaaaaatcttaagttttccagcaactcttaaaaaatctacccaaggattaaaataaatctccaatagaatatagttttagagaacatctgtccttgaaacaattaaatgactttgttcaataaaaagttgagattccttccactcctgctattgagaatgctgatccaagggagaaagataaactgggttccccccagttccaaggctgatgagtggtgtaggctcactagcgggcccatttgggaacctacacaatcccaaattcatattggaacctaagaacaatattactattatatcttgcaatcaagaggagaataaaagtctcctctaaatacttagataacaaagtttcttcattctcatttccacttcatcccattccacccttcctgaccaccaaaaccaaacaaaatatccattaacaagaaaattaagagctgtatctggagagcagtcaggattacaccataagtattaggtgtagctaagcagggacccgaggtcaggtgcttgggtgttttgcttttctgccaagacrgacatcaggcttaaaccaatagtaaaagctgtaagattagaatttcttgtatataaccacattctctcatatacaccaaacacacaaaaacccactccattgtgctcaccgcccacatttcacactcaggaaatagcytgtagcctttttggcggtcccagccattttgctctaaacctcctaaagacgtccagtgttagccacacaaaaagatcacccggtacttccccagygggaatagtgaaaaacgacagttaactccagttagacaatattctactctccctgtggccaggacagaagccgaacgatactcccagactcttccagggrcacgaacaggagtgacgaggggcctcactccccaggcagggttggtccacacctgtcaccacgagtgggcggaagtagggaggaagaaacctttagacgcraacccgagccacmctggtacattctcagatcccactcaccccaatcttcatccagcctgtgaragagtcccgggctaaaaggtgactccatggtgccggcaaccccagccggctcccccatttcacaagttccttctccctggaactccgtgattaatatctgggacggcggcggcaggcggacaaaatactccgtaacgctgacgagacggtggcctaktaaagacaaactacttytgccrcacgagggatttgtacgacacaggaaaacgtcagagactaagcaaatttgaatagacctctgagtaaatatttcccttttggagttttcaggactttctgtcccgctgttttatggggaaggcgggggaagacacgcagacatcaattcgactaaacaaagtttatcaataatattaaaaataaaaagtaaagcccctttctgaacattatggcttattccttgattatccttcttaatgccacagcgtggctatctcagaacaaaattagagactaacagtaaatttactttaatttttacgaataattctctatcaatgtaaaaatttttcatatacgcgtgtatgaaagaaaaacactactatttttccacattcgtgaaaactgcttaactgggacagtaaccgaggtaagtggtactataaaacatacttctagaaagactacttttatttaaataaattgaaacaaagcaaatataaaaagataaaccccccaaatttatctcctaaagataaatttctaaagcatagtatttagtcaaagtccaagcgagtctaccctaagacctacagtaatcgaagttcccaatatttgtattactaaagattcgggttttatttaaaggaaawtcacatacatcacgaactccaactgaaaatatgaactgagtttgataaagcagtttcaagaacgctacttaagagaatttctttttcatccattttaaatttcagcggccagtgaatatttaaaatactgtaaccgacgaatacgtatgcttctaggaccacgtggaatctttcccatggtaggtaagcaaaacaaatgtgcttcccagaaccctccaaactgctcgtgggtatattactacagattacataatgcagcagcgttccgggacgcaagcccagaaaaagataattaaatccccttacgtcagatgtaactacttttgtcattagaaaactaataaattttcacttaaggtgaaatttataacactttaattctcacccaattacaaattcaaaaattgacataaaaaactaaaataaggccgggcgcggtggctcacgcctgtaatcccagcactttgggaggccgaggcgggcggatcacgaggtcaggagttcgagaccagcctggccaacatagtgaaaccctgtctccactaaaaatacaaaaagttagccaggcgtggtggcgggcaagtagctgtaatcccagctactcgggaggctgaggcaggagaatcgcatgaacgcgggaggcagaggttgcagcgagcggagatcgcaccactgcacaccagcctggtcgacattgcgagactgcgtctcaaaaaaaaaaaaaaaaaaaaaacctaaaataaaataaaatcatcgagtcttctgtatcccactagacaccttagtcttttaagaaaatcaccatgacaaatcgccaatttttttaatttccaaaagattttatttttattcaaaaagtgcaagtaattatgaaacaaacatttgtgacctatcaccaagaatttaaaaatttaacatttttcatttttgtcccagatttttcataagaaattaaatactacagaattgaattcctctttcctccctgcttcattttcctcccttggcgtaggccacttctaccatgaattttatgggtataaaattttattttataaaaataaaagtgtaattctagtccacttttatttttagttttacggtgcttaaacatgtttatagacacatgcatttagtgtcatttgggtttttttaatgtatgtaaactttaatgttctccaaatcatttttcttattggatattaaggatctacccatggtatttccttgaatgaatctcaatttctctctctctctccctctttttttttttttttttttttttgagacaggggctcactttgtcccctaggctggattgcagtggagccatctcagctcactgcagcttgacctcccaggtttaagcgatcctcatgcctctccccacaatagctgagactacgggaacccaccaccacacccgactaatttttgtattttttgtagagacaggatttcaccatgttgcccaggctggtctcaaaacttctgaattcaagcagtccgcccgcctctgcctcccaaactgttgagattacaggcgtgagccaccgcacccagcctcaagaatgtcttaaataatgtatgtactattttatcagtttacaccctcactagcattgatgagttctctttgttccacattctctccaacacaagatatggtcagactcttaccatttttaccgctgtgaaaattgcaatttacatttccctaacaaagtggtgcattcttccatacttatgaaaccttatttcctcttctgtgaactgtccactcttaccttttataaagtttgctatggagttttctttcacaaatgatgtgtacgtcattagatagcctgctctattcattcacctgtataaagtaaaactaaactcctaagtccgccaccaacagaataggcccccttgtggccaaggggatcctagaaaaccttaaaactgagttctagaccacgatgggacaggttagacacaccttgttatactccctcccttttgtagtttaacacaacaactggccagcattaatgttaaaacagagatgataagactgacagracagactctggcaataagatgccaaattataaaaaagacctaaagccattccaggcaaggttttagtcccacacccctatacttaaagaataaactgtgttctaactgccacaagattcttctctagcagctaaacaagtactggcctaaagataaacaatattaaaataatgtgcagctccacgagatgctgacttactgacccccagtccccgttccaccagccatagctacagctttcattggacaactttttgttgatttcagtaactttctccagrtaagaagaccactggccatggactggttctggctggtctacagaggtcgcacatttgcatggcttcatgtcctgaaagaccttttgacgtatagggctcgtaatacatttaaatgttaagtcttggctgggtgtggtggctcacgcctgtaatcccagcactttgggaggcccaggtgggaagatcacgaggtcaggagcttgagaccagcctggccaacatggggaaaccccatctctactaaaaatacgaaaattagccaggcgtgggggcaggttcctgtaatcccagctactcaggaggctgaggcaggagtatcgcttgaaaccgggaagtggaggttacagtgagctgagatcacatcgttgcagtccagcctgggtgacagagcaagactccgtctgaacaacaacaacaaaaaagttaagtctccatcccaaagtgaatatgggtcatatgttacatgagtttttgttcaatacgcatgtgtcaggaccactttcatgaatattcatagctcttcctgtaacctggtgaaaatgtaggtttagccaacctgttcagcctgaactacactccaagccctcctccttcaaagcgcctgtttctggaggcacgcttcccagcctgcaggatggccaccttgcaggccataaagtctccccttcttttctaaatttattcattgtggggctttttaatatatacatttttaaaagagagagagagacagagtctcgctttgttgcccgggctggtctcaaactcctaggctcaagctatccttctgcctcagcctcccaaagtgctgggattacaggcatgagccaccgcacccagcccattgttgggcttttttaagttaacgcttggtatatgttataaataccttctcccaggttgacacttgtcgtctttgtttacggtgatttgttctctagattttaatttcaatgtagtcaaatttatcaatctgttgttatgatagctgacttgtagctttcttaagaaatccttccctctcctgaggtcactaagattttcattttcattttcatagttttatagttttgtttttcacatctttttttttctatttggctattattggggtatagcaacactgtggatttttgtacagcaatcttgtaccaaaaaccttgttgaattctgttattctagtattttgtctgtgccaggaacagtggtacacacctgtaatcccagcttcttgagaggctgaggcaggaggattgcttgaacccaggtgttcaaggctagcctgggcaatatagcaagattctgtctctaaaaaaaaaaatcatattatggtagatggaractagtatgtgataaaataaaaatgactttaaaaaaatttgtctaaagttctttaggattttttatttagcagaacattatgcaaacaccaaccttttaaattctattttatttaatgttttaatttgtaaaataaacttagtatgaaaattttcaaacaaatacaagagatgatataataaatccctgtgttcctatcatccagcttcagcttaaacaatttgccattcttgttttatctatcctacctctcctctccacaacttttttcattttgttctgtgtttttcccagaatttttttttttttttgagacggagtctctctctgtcacccaggctggagtgcaatggcgtgagctcggctcactgcaacttctgcctcccacaatcaagcgattctcctgcctcagcctcccaagtagctggaattacaggtgcctgccaccatgcccagctaatttttgtatttttagtagagatagggtttcaccaagctggccaggctagtcttgaactcctgacctaaggtgatccacctgcctcggcctcccaaagtgctgggattacaggcgtgagccaccttgcccagccttcctggagtattttaaagcatatctagatatattatttcacccataaatacttcaatgtatatctctaagagacaaggccttttttttttttttgagatggagtcttgctctgtcgccaggctggagtgcagtggcgtgatcactgcaacctctgcctcctgggttcaagcgattcttctgcctcagcctcccgagtagctgggactacaggcgcgcgccaccacgcccagctactttttgtatttttttagtagagatggggtttcaccatgttggccaggatggtctcgatctcttgaccttgtgatccatccgtttcagcctcccaaaatgctgggattacaggcatgagccactgcacctagcctgccttttcttatttttaaaaaacatactgataatcccattatcatacccaacaaaattaataattccttaatatcatctgatacctgttccatgttcagttttctgtctcaaaaatgcccttccttccacagttagttaaaatcaggatccaacaagattgtcacattgcatttagttcacatgacaattccctctccatttcttcccccctgccatttgttgaagaatctaagtcattggtcctatagaatttcccacttcatgattctgctgattacatcttcatggtgatgcttaatttgttccagaaactgccagtgacatctagaggcttgattagtttttggttttttgtttgcttttgcaagaatacttcataggtacttccttgcatcatagcagaaggcatatacatactgtcccacttttagagatgtcgagatttattagtgagttcagatttttttcctacgtcttaaactgtttagccccttgttttactgcaatggttaggccctctaatacgatacagaaggtaggggstagacatcttttaacttacttctaaattttaatgtgaatgtttgaaaagttttaccactaaataagattttttcccatatatttttcacagctgctctgattaaggaagcttccttccactctagttaccaggcttttctttttaaatcattaaatgttggatgttatggaattctttttcttgaatctactcattcattttcaacttaaacccttggaatagaaatacaatttgaaaaagaaccttatgtctagagacaataccactctttggtctaggtaagaggagcccctacsctggaccgacactttagaagactttactctgacctctggctctgccccacaggataagaatccatactgccaacgtgatgtgcccagctagaacagatgcccccttctagaagtgcatctaacacccaaatagcccaaatagctccaagcckgcttccagggcttgctctggcctcatacctcttacgagtgaaatgggctaatggtatacaccagggctgtagccagatcttatacatataggtgggggacccacatatatatatatgcaccaggctcttcatgatgcagaacaaatcaaggggtggggaaataaaggaggcacccagtgggcgggggccacctctccctgcattgccatgctttgtcatggaatctgataaaatcagagaattctgaattcaaacctggtctgacaggtcattatgaagggatatttgtcaagataatagaataaaacattttatttaacagatagcttgatttataattttatttttttaagacagagtcttgctctgtcgcccaggctggagtgcagtggcgcgatctcggctcactgcaaactccgcctcccaggttcaagcaattctcctgcctccccgcctcccaagtagctgggattacaggggcccaccaccatgcctggctaattttatatttttagtagagatggggtttccctatgttggccaggctggtctcaaactcctgacctgcagtgatccaccccccttggcctcccaaagtgctgggattacaagcgtgagccactgcacccggccaatttatgttttaa

SEQ ID NO: 13457 - DNA, 23082 bp, Homo sapiens
  misc_feature (1)...(23082): n = A,T,C or G, or insertion/deletion polymorphism (see Tables 1-2)
tcactgaacacctcctgcttaccaggcatgtgacctcatttaatcctcacatttaatctccgaaaaggagggcctagtatcatcctcacaaccattcatccaggaggcgacagctgggatgtaaaaaccaggtgtgtctgagttgtgactttgacatgggtctctaagtaactcaaatcctgtatctcagcctggaggcaatggggtgtcagggaaggcttcctagaggaggtgacacctgcaccggatctcttaggatgataaaatgaatccagccagtgagggagcagggtgtccggcaggaggaatagcacacacaaaggcctggaggtgagaagcagcaggagggtgagagtgtggcagaagctaatttggtgtcacaggctcacaggaagaggcgggaagaggttgcagggaagtgggtaacaggagcaggtcacagagggccaaatacagaggagtctacactgactttattctctggatagttgggagccccaggaggactctggatggtggagttgcccggtcaggtgaagacggggaggttcagaaaggagccacactgtcgtcagatggctccatccacgaaggagatgaggctgggtccagtgtcaggagcacacgtccaggccgcacactgagggccagatgcgggctacagcacaggcagggagctgtggccgagctttaattatttatgaggctgtttcccagyaagactcagcactcctgcagcctggccttgcccagctaatgaactctcagccatgggagacctccctgtggccactctttattaaacctgggatggaggggtgatgggtgctgggataacaaaagagtccaaagaagcctgaacaaagtcgaggtcagtgagcacaaaactggtccacctgtctacccagcctttccgcgagaagcacagaacttcctagaggaggaagcgaggtggagtagccttaagatgtcatctcaagacagggaaatgaaggcctgggaaggacctacctaagtcaccagccagtacttgagacagtacaagttccatagctggtcacccrcattcacaccccagcagttctacacccttgggccagttacgtaacccgtctgtgcctcgatgagataggactatttcaggtacttcatagtgttgccccattttatagaatagaggaacgaggggcgatgtgtggacaatctcagcacgatgcccggtccacagcaagtgcccagacagcgttcatcggcgctatggttactgttgtgactctgggagtaaaggccaggccagagaccggaatctctgcctctgcccccagacactagggagcaacaggaaactgaggcccaggggccagctggcctacgtgacccaggcccacagccaggaatcccacccgacttcccctggctgggcttccttgggcctggctctctagcttccagctccttcctccactttgaaggttctttgagctgagaactaaagccccaggagcttttccctcttccatcccgcaagctccatctgtgtctccaaagagccaagtcccagccactgtggatgaggctcgggacttagaaggcctcagtttgagttccagctccaaccctgaggagctctgtgactttgggggagtcacttcacctctccaagcctatgtcctctataatataggaacaataccacctgtttttaaatggtaaactcygggggaatgctattagttaccatctttcaggcctagttcagcagtctcctcctccaggaagcctttcttggcttccttaaaagttccctccttccagcctcttggtattcaggggctgcattctggcccctttgggaacttggactcattttgcctcacgcagactctatctacaaattccaacccccattttgcaggcccagagatgtacaaaggtggggcagctcaagccctcttgcagggtggtgtgccaaagagggtggtcaggggtaaggcacggagactgctcagggaggagcagattttgttatcccagcacctatcacccctccatcccaggtttaataaagagctcctcagggacgagccaacagctctctctcctgcagggagaacagttcaaagaaattcagtctgggcaggtggcctagaatgcgggaagggctgaggaaagaacattttccagcacctggccccaacacagccacgtaagccccactccgtttcttcagtttccctttatggctaccagsagtccgtttctaaaggccgtggaggtgggaacactcatccatccgttcccttcttgccagccctgtgtgtctatgtgcacagccagcgttggagggacagctgcccctgtttggcagatgaggaaacaagctcagaaaagccaagccatgtgtgattactacttggtactatcagcagcgccgccaccctttccactccaagcttgacgtcattcacttttgtttaataactccctgcctatgactctaccccatgcatctcagagccatgcaggagcccagcttggccattggagctctcttggcccacctgagcgtcactcagcacccagctactttactcctccatctcgtccaaagcctcacatggagctgaaacgcaccaggcctaacatttaaagcccgtctttccagctcctagatcacactcctggtgctttccgcaccacactccccacctcagcagacagtgccctsaactcgaggcaggcagagatcctgaccaagttctgtcatcctgagctgtgtgaccttgcataagtcactcaacttctctgaggaggcatccttatctagaaagtagaatgacaagaaaatttctgcttttcacagccatcctcacaaggacagttgttataaagagccagggagataaggcataaccagcccagacacgcagtttctattccttgcctcgtcctcagtactcccactctaaggagaccacagaacaactcccagtgaggaaactcactgcaatattttaccaaggcacagccattttcataacctcaacagcactgggaaatggtccagggtcatgattagactaagaactctagagttagatgcttaagttcaggctcctacttaacaactcagtagctgctaagcaggtaacttcacagttcagtgcctcagtttttgttggtttgtttgttttgttttttaatctctaaaataggactgttatgaagattaaaggagtttatacaagataagtacttactgcagtgcttggcacagttaatggtcagcacacattagtctcattacttccaatttcgcttctagaactggtcctcaaaacagtccaatgatgttgctggggcaggaattatgtgaacccaagtggtcaggtgaggaaactgaggcaggagggaaagatgtgctagagacatagactcagtcagtctagttctgccacgcacaagacacaaagccaactttgggttaggtctgaaagtgaacgggagggtgactggcaaacagtcaaaaaccaaaacgattcaacagagagggtgcctgtccaagtgtcccgtgacccttcctgtgcagtgtggggctgtgggcctgtccacctgtcgccctcctccctcagaccccgtcagtgctccctggctggcagggctggcctgtcttggagggcgccccagcgcctggcacgcagcagatgctcccgaatgatgaatgaatgactgcccgggtctatgtctctaggagagccctgtttttctgttcccggagctacatttcttccaccgtgacaactgcctgctaactagctcccggtcccgcagacactctgaaaccctgtgcactctgagaagaaacttctaaatcagtcgcgcacgcccagcaaaggcggccggcagccgtttcacgcgtggcctcgggcttctcgggccccttccaggaaacaaactctccctcctggtaccctccttcctggtgtgccacatgactcagagccgggcagggctagcaggaaagcgcggtctgctaaccagggtggctcaaaaaggtcttcactgtgactcggcagaaaagcggcgcccgagccccgcctgcacctaccaccctaaggatatgcgcgggggtgtggccggggcggggccggggcagggcagggcggtgcccccgcgcccagggaaccsgaatactacacatccgtctgctccgcgattggccgctccggccacgggggcctatggggtggtcctcgcccagccaatcaggggccctggggagcccattcattcacaaaaactgakcaggaaaaggagcgcagtgcggcccggagctgcgtggaactttgaaacacgcgcgcgtcccgcggggccgaggcaagagtccgagagggccgtgtttcgggaagctagacctttgcagggactgccgcgtccccgcccacagctccggttcagtctccccagcatggtgcgccttcctcctccggcacactgcccggggctccgccccggccccaccagracacgccagctttcctgcccgctccgggtcgctaagagccacccggccccgagggaggcggtgcccaggcggtttcccggtcgcaggctccggcggcaagtcccgcgcaggtggcagcgcsgcggctgcagccacgtgcgcgccaagcatggtgccccccaccgttccttttctctccccgggtctgagctccctggcccgccactcacggcagtcgtcctcgtcgctgtggtctaagcagtcatcgtcctcgtcgcatctccacacagaggggatgcagcgctcgttccggcactggaattggtccttttcgcamtccttggccggccctgcgagggggagggagcgtgagctggatcagcggactcggccccactccccaccatgcagtccgggccacccggaaggacccgctggggaggaggaaagggggcgattatggagaccccgggggcttcaggcacactccatccaaagggagggcacgatggcaggggttccgtggatgtcgggccgctcggtggcacggcgagaccaggcacctacttaaagtgtcacacgacctgggtatamcctccattcagacgcactcacccgcacacgcgacccatagtcagagatctgctcagatacagcccayagggagtccccgcgcccgcgcgccaggcgcagtgggagccgcaggcacatcaccctggcaggcagccccctctctctccgccgcgcgcaggggtctgcggaaacgcattgtcaagcggagaagccgcccggctctgctcattaccgccgcggagcgcgcgtgtcaaataaaccccaacggcgagaatcacacagytcatccggaaccatgaatggccgcccctccggcaaagttccccgctggccaagcccccctgcacccctcccccaagakccgctgcccagagggcagagccctcaacaccgaggcccgcgggggcggggggccgagggcaaattcaggaatagccgcttcgcgtggagcctgtccgcccgggagcccccgatagccccgggttctggacccctccccgctccggcctcccggccgcgctttgttggtggctagggcggagcagagccgagtcagagaccttttgcacgcaccttggccgccgagcagcggatcagccgctgccgccgcaagatgctggagcygcagcagcagcagcagcagcagcagcagcagcagcgccagaagccggagagggcccggctcggggaggcccatggcgggcccggggctccggccgccgcgccccgcgctccccgcgccgccgnnnnnnnnnnnnnnnnnnnncaggttcggtgacgctcggcggcggggcgggctcaggctgggcgcgcggccccggccctgggcggccgccgccagcgcgcgcgctccctcccgctgccgcctccgccccacgctccccctgccgccgcctcctcgccctcctccctcctgtctttcgtccactcttctctcagcgggcgctccacggccctgctctgggctcgcctgagtgctgggctctgcagacgcagggatgggccaggcgagcccctcaccacggaggtagcaggtccagaggaagcagcagaggcttcctggaggaggtgacaggcggatcagaggctgagggatgtctaggagtgagcctgggcgggaggggaaatgatgttacaggacgaacaggcctgtgcagtgtgcgcgtggggcgggggagggagggataggggtgagatcccaagatgtggatgagcagggagaagctgggggcgcagggctggacccctgcacctgtcatgggctccggctgggatattataaatccctgtggctggtttggtttccgtgccatgtgcatctgtgcatgttgcacgctcatgtgatcatggggacgtgaggcaggtggattgggcctggtgcacagactattcatcgtcgttaagtacgctccaggcccctagtcagaggggcaaccagggggggcccgcagggaagacaaggaatcctcgctgtgatggagaaagacgaggtctgtggggcgggccgggcgggggggaaggggagggcacggaagggatgccatccctgccgctaggggccgcgcacctaggcccgcgctgtccgcccctgctgtcttctgcaggaaggagaaggcacctcttcctctggagggctgcagcccgcctcacccacactggggagaatgggtgcggagagcgagctgggattcgatttcagcctcagacttgtgagccgggtccaacccacacaaccttctttagagaatgagattccagggcattggccactcaaaacaaccggcctgcaggtgccaagagccagtgttaggtccaccctccctcccctcttgccccttcacctccctcgcggatgggcaggtgctgttagcccttggcctggaaaccaccctgtctcctcagcagcctcctgagccgtagtcccccaaagggcagcccagcggcaatatctgtggccaccccaccagaaagggacttagatccccagagagcccggcacggtgctcctgccatcatcacccctcctgtcccttgttcattcagtcattcagcaagcatttcaggccctgttctgtgccaaccctgtgctgggcctgcgggtaccaaggtgaatcaggcatggtgccagccccggagaggtccctgacctgtggggagacagaccattagcacacagacaacgaaatgcaggcgtcctttcacctatatgtgccaaacgcccttcaaggctcaaggatacagtggaaacagataaggttcctccctgctctcctgcagttatgtcttagttggaagagatacacacaaaagcaggaaaacaaaagattatttcaggtcatcataacttctatggaaaaaacaaaacagacccaggtgagagcaatgggggtaactgtagaggtgatcaggcaaggcctcacagaggaggtgacatttcactgaatggcaagatggatcctgacccatgaagatcaggcggaagggcattcttggcaaagggaatggcaatcaaggtgggccggggcctgatgacagggaaggagtgggtgcctcaggtgaggctggagggagttggcaaggccctgatcaccagggctttgtaggccacagctgggagtttggattctgtgtcaagcacaatggtgcctgggactgtgggataaagatagaagcccgtcttgctgcccaaactgacctatccaactcagtccctcctcctcctccactctgtggtcttaggaaagtcaatcctatctcccagtctcactttcttatctgggaaatggaagagataaggaatttctgaggttcattccaactgtaagattagtatgtgggccgaagtctagaggcagcagatgaagaaaagaaaagaaaggaaaagaggccgggcgtggtggctcgcacctgtaatcccagcactttgggaggccgaggcgggcggatcatgaggtcaggagattgagaccatcctggctaacacggtgaaaccctgtctctactaaaatacaaaaaattagccgggcatggtgtcgggcacctgtagtcccagctactcaggaagctgaggcaagagaatggcgtgaacccgggaggcggaggttgcagtgagccgagatsgcgccactgcactccagcctgggccacaggaccagactctgtctcaaaaaaaaaaaaagaaagaaagaaaaagaaagaaaggaaggaaggaaggaaggaaggaaggaaggaaaaaagagagaaatggagagcatgggcctgtgggtgagactgcctgggtctgagtctgttccttccctttctagttatgtgaacttgggcaactcaatctctgtggctctaaatgtgaaaaatgagaaaggtgatagtactcacctcacagcattgtggtgaggatatgagatgagattgtgtacgcacagcatacagtatatagtagctgcatgagaaatgttagttattgttactattattcaaacataattccctgttcacaaaaccctgatggctttccaatacccagaatcaagactgagcccaggcatcccccgacctccccaagggagaaggatgccagttgccaaagtgggcaaatccttgtctctcaacagtcccctcagcagaggtccttctggctcctctcagcctccacccactttgggccacttccccgggctcctgcagtccctgggcttccctttgccgcagccctgaccaccctgtgttgccacagtctgcttatgcaactgtctccctcgtcactctgtgagctgctggaggacaggagcccgctctcctgcattyctggattcttggcacagggcacatttgaccaatgcttgtttctgcctttattgaaggatttgtacccctaggaggactatgtcytcctcatctttgtcttcagaggataaatacaagrcctgacacataacaagcatkaggtaagttatatttacttgaaaaagttaaaagaaaaccacataaaataacaacaatagccaatatttattgtatacttgctgggggtcaggcaccattctaaatgttttaaattctttttcctctttgatccttacgacatctccatcaggcaggttttgtgtttatcccattttacagatgagtaagctaagcagcagagaggtcacacagctagtaagtgactgagccagcatgcgaacccagagggtggaagtgggaatttttcagggcacataaactggttaatttctgtgaggggcaaagggagaaagctcagtccttgaaacacacaagacaccaaatggacactgaggtcctggtaaagcttcggccacccaggtgactttggttctcccctaccctgcctctccatcctgggctgactcaagcttacagaccctgcctaccctgagtttccaaagaaaactcccaaaccyaacccaaaatgtaatgaattccccatgagacagatgtaggtgatatttcacctgctgtcaatatggcaccctgccactcccaagtcccatgttggtctccagagccatgggagccccagcagcctactctttcacactgccccccaggaactggagcttcagaactttgccaggctgtgmcctctgctaggccatgccctctgcctagaacactcccgcatgggttggcttctgtttaccgtttgggcctcacctcaaatgcctcctcctctgggaagacttctcgcctmctccacagagatcctccctgctcctctgggcccccacggcactgtgtgtcccaatctccctgatcacactggcctgtcgttgttggctcctccatccaatgggagctcctccagtaacaaacagcatcatcctggttctcactctgtccccagtgatgatgcctctccagtaccagggccagaggaccttctgtgttcacctcgcccagcctgctctggcaggccttatgctaggtgagggacacagacgaacaagactccaccttttccctggaggagctctggtctggaggcagagagagcctgggacagagagtgtcagcacagggggacaagagccagggaggggtctgctcaggggygccagattccacccccaggtaccttaggctgtgtcaccagcccagccagggtcggagaccagcagccccaagccaaacacagccaggctgcaagggcaagggtgctctctaccatccttcactttcctcttcacttacacttcacttcacttctccactgccttcactttacagaagggcagccccagtccttcacatggtactgtgagcccacggcgcacttctccatgtcactgtctctctgtgtttgtgtctctgtctctttccctctctccctctgagcaggcaaagtgtcctgattcctgtaaaagagagattctaatttattactgaactttacrtagatccaaactgccatggtttaaacgacttgttacctgtgtgacctggggcaagttacttttatgcctcaattccctcatctgcaaaacattgttagcattagctaatgtttcctaatgctatcaattacctattgctgcaaaacaaattacccaaaacttagcagcttcaaacagaaataaacatgtattatctctcccagtgtctgtgggccaggaattggggagcagcttagttgcatgggtctagctctgggtctctcacgaagttgcagtcaagatgttggtgaggccacagtcttccaaaggtttaactggggctggagtgtctgggccggctcagtcacaaggttggcaagtcccttttggctggtggcaggaggactccatttttcaccatgtggctcactccagaggactgctcgagtgtccacattgacatagctggctttccttagggagacagatcaaagaaagagaaagcaatgaagtcacaatgtcttgtatgacctgaccatggaagtcacgctccctcatctctgcaatatcctgttggttacatagatcagccctattctatgtggaagggaactacataggattgtgactcccaggaggtctgtctgggggctgtcttggaggctggctgccacacactgtcgtaggatttgtgaggatgaattaatacagtcctccctctgtatccatgggggactggttccaggacctcctgcagataccaaaatcctcagatgctcaagtgcttgatagaaaatgatacaatatttgcatataatctgtacacatcctcccgtatactttacatcatctctagattatttataatacctatacaatgtaaatgctatgtaaatagttgttacgatgtattgtttagggaatartgaccaggataaaaagcctgtacatgttcagtacagatgcaattattttttcctgaatatttctgatctgcagttgattgaatccaggattyggaacccatggatagagmgrgccaactatgtatacacttatatagtgtgtactatgtactaaaaacccttctaagaacttaagtacacactatataagtcattgctattattattgcctttgtggttgtttctgccacatagtaagaactctgtaagaattatctgcagttaccattaatattagctgcattattgctattagctgcacaatcccttcatcttgcagaggaaaggagaggatgaaggtggttcaggggttcgtagaaaagcaggacagacccagcctcggtttcttgcctcttggctgtgtgctttcaggagggtgggctcacaactgcctcctcctccactgtcttatgtaggagactgagtgggtccttctscctctctaggcctggggtgtccatccctaacctgaggggctgaactaggtcagtatatcccataactgcagccattctcatccacttgaatgagtttctctatttccccttacctgctactgtcatcccagggttccccttaaatcctttcacttagtagatttagcttcatcctaagcaataatctccatgaaatcacaggctttatatgctcattatatttttccaatacatattaaattaaatgtatggctattcacataaacaatgggcctctgtgcacccagatgtgtctcttttctctaagggccatcagctctgagctccctgtttattccaggacagatggagggcaggagccctgaccactctgcccatgatgacaggcattcctcaaggtgacttgcaggtggctcaggccctgggtgcccaccccctgagtcacatggctttcgggggcagactcagtacttttctgtttgcctttattttgggttagtttttattttttaaattgttttttatgtttttattgattgactgattgattgattgattggttgagacagggtctcgctctgtcacccaggctggggtgcagtggcaccatctcagctcactgcaacctctgccacccccaccctccaccagccccaggctcaagcaatcctcccacctcagcctcctgagtagctgggactacagatgcacaccaccacacccggctaattttttttttttaagtctttttaaagagacagtgtttcgccatattgcccaggttggtcttgagctcctgagctcaggctatccacctgcctcagcctcctaaagtgctgggagtacgggcgtgagacacctcgaaatccccttccttcctccccgccagccccagaaaccatattctacttcctgtatttatgaatttgactactctaggcaccttaggtaagtgcactcatgcaatatttacccttttgtgagtggcttatttcacttagcataacatcgtcaaggttcatccatgttgtagcacgtgtcacaatgtccttcctttttaaggatcgggaatactccattgtatatctgttccacattttgtttcttcattcatccatcaagggacagttgggttggttccacattttagctactgcgtataatgttgctataaacatgagtgtacaaatatctcttcaagtccttgccttcagttcttttgaatatactcagaagtggaattgctggatcatactgtgattctagtttttattttttgaggaaccaccatagtgttttccacagcagttgtatcattttacgttcctaccaacaatgtgtaagagttccagtttctccatgtcctggccaaaacttgttgttttctgcttttgttgttgtggttgttgtttctttgtttgttttaacacagatcctaatgaatgtgaggttttttttctcactgcggttttcatttgcatttccttgataattagtgatactgagcctcttttcatgtacttattggccatttgtatatcttcttcggagaaatgtmtattaaattcctttgcccatttttcaattgggttgtttagtgttttgttgttgagttgtaggaattcttatatattttagctattaaccccttatcagatatatggtttgcaaatattttctcccatcccattggcagccttttcactctattgattctgtcctttgatacacagaatttttcaattttgatgtagttcaatctgttttttcttttgttgtctgtgcttttggtgtcatattctgaacatacttatatgtgatcgtaatacaataaatgctatttgtagtgtgccatgattaatacttttttcctgcatgcctttgtgttttccctggaattaataattgttaccttttgctttattgctttatttctttcttagctttctatgtatttatctctctttcctccctaaactctccctcatttgtgtaaatctcctcttactacaatcacccacattcaatacagtaatccccacttatccgaagtttcactttccgcagattaatttacccgaggtcaaccacggtccaaagatattaaatggaaaattccagaaataaacaatgtgtaagttttcagttgcatgctattctgagtagcaggatgaaatctcgtgctgtccggcttcgtcccacctgggatgtgaatcatccctttgtccagtggatccgygctatagacactactctcccatcagtcactcagcagctgcytcagttcccagatcaactgtcgcaggatcgcagtgcttctgttcaagtaatccttattttacttcattatgggctccaaagcacaagaggagtgttgctggtgattccgatatgccaaaggaaagctgtaaagtacttcctttaagtagaaaggtgaaagtacttgacttaataagaaaatttaaaaaacaaaattgtatgctgtggttgctaagatctacagtaagaatgattctattcatgaaatcgtgaagaaggaaagaaatttgtgctagttttgctgttgcaactcaagctgcaaaagttacaacacctgtgtgtgatgagtgcttagtaatgatggaaaagccattaaatttgtgggtgcaagacacggacagaaacgttctgattgacggcartcaggttccaytgggggtattggaacacatccctgaggataatgggggactactgtattctaccaacttattcctcttgaagaattccctttcggatttctgactgctgagtcctggactggttgatggcaaggccagctgccctggttgtcacctggagactgtgctgcacttttctcctgggtcgaacccctcaattcctagatcccacgtcttccccttctgggttcactaccttatytgggggaacatatacccatagctttctttttgttttattttttgtttacctatttatttatcttattttattttttgagacggagtctccctctgttgcccagtctggagtgcagtggtgtgacctcgtctcactgcagcctccaccccccaggttcaagcaattctcctgcttcagcctcccaagtagctgggactacaggtacgtgccaccatgtctggctaatttttgtatttctagtagagatggggtttctccatgttggccaggctagtctcaaattcctgacctcaggtgatccaaccgccttggcctcccaaagtgctgggattgcaggcataagccactgcgcctggccccatgtatacctatacttttctaaaaggatgtgtttggggtgaaatcttaagaccttgcctttctaaaagtgcctcacatttaatcagatagtttgaccaggtataaatttctaaactggaaatatttttccctctgaattttgaaggcttgctccattgtcttccagtttctgctgaaaagtctgaggccattctgtttcctaatcttttctagagactctgttctctctttctggaagctgtgtcctcagtgggtcttttcttttaagagaagggatcccatcgccaccgaggctggagttcagtggcacaatcatcgctcactgcagccttgacctcctgggctcaaggatcctcctgccccagcctcctgagtagttaggactacaggctcataccaccatgcctgctcagccttagtgtgtcttgaagtgaatcgatttccattcactgtgctgggtacccagtgagtcctcacggacaaactaatcatcttcattttggagaaaatttaaragaagtacctctataatgattttattttttctttcaggaactccttaattattcaaatactggccctyctggagcagttctctatatttcttatatcctttttccacctatttttcatcccattttgctcttcattctggaaatgttcttcaactcttcaacagttttttgttgtttttcaaaaatttatcttatcatatttccaaaagccttttgtttgttctttgactattcctttttttagagtatctcrttcttttctcacggatgcaatattttctcttrtttctttgaggatgttagtaatgttttgttgttgtttctgttgaagtgtttctcaccatgcctaatctcttctttgtccaagttaatttttttttctgattgttgaaaagacaagccacatactgggagaatatattacagcacaaataacgcacaaagcattactatccggaatacataagtaattcttacaaattggtaagaagacaactcaattaaaaaagagcaaaagatatgaatgagcatttcacagcagaaaaatatgaatgaaaaataaaccacaagaaaagattctcagccttatagaaatcaggaaaatgtaaattaagaccacaggaagattttccatggaaaagaagtcccatagtggcaagtattggagaggcaggaatcaacagggatccttatatgctcctaatgcagtgtaaattgctgcaaccactttagaatattgcgatttcattactaagtgtaaaccctggagatacacttgcatgcaagcacccagagacaggtgcaaggatattcatagcagtgctgtttattatggtaaaaacatggaaaccaccctaatgtccttaacagtaaaattaattaattgtggcatcaccatataatgaaatcctatacagcagtggcaatgagtctaacatagctgtggctggatacagaaggaatcatagaattataatgcggagtgagaaaagcctgttgcagaagactacatacaacaggatttgacacttgtaaggctccaaaacaaagaaaattaaatgatattgtttaggttttcatacataggtgataaaagtgtgtttctttgtttttaatgagaaaattagtcacagaatttaagatcttagttacttctatagggaaggcaggggaatgggacaaggaggaagcccacagcattggtcatgctctcatgttgaagttgggttcaaaggtgttcattattaaaatgcttcataatgatgaccatacatttggtatttctaggacaatcttggtttacatctattgtctcaacataattattcagtgcaagcctttcctttctcagaaaggtcctaatgtagataataaattattttggccaacttatttcttataaaatgcaacatgcatctcttttgtatgtatctattattccataatctatacaggtgtttttgtttttttgtttttgtttttgttgtcattgttgttgtttgtttgtttttttgagacaagcctctctctgttgcccaagctagagtaaagtggcacgatctgagctcactgcaacctccgcctccgggttcaagcgattcttgtgcctcagcttatcaggtagctgggactacaggcacccaccaccacatctggctaaatttttgtatatttagtagagacagggttttgccatgttgcccaggctgatctcgaactcctggcctcaagtgatctgcccacctcagcctcccaaggctaggattacgctaagattatagacataaatcagcgcacctggcctccataatcgatatagtttttaatactggggccacagcctggccacagtctcatgggatgtttgtggtttgaccctaacaaccttgtgaaccagcctgggtaactgtccttggggcctcaatgaaccaagccctggagcacccagtccccagatccttctggccactctgactccctgtgccctggaccccacacctcacctgtcctgggccccactctgtcctctcctccacttctcactgcctgtggagccatcttccaggggccctgaaacctcacccacaatccaggtccacccagggcccctgtgccaggccccatgctgggtgatattggggaaccatcttgggggcagctggagatggaaaccgtgacaacccagtggatcaaggctatggcacagaccaggctgtgacactgcagaggagagggcttagcccaacctggggcccagggaaggctgcctggagctgttttgaagtctgacgggagtgagctgggtagggaragtggggggaagagtgctccgggcagacaggacaaagtgcagacagtagggtaaggaggcacrgtgggggacgcagctcacatgttgctgtgagcagagcacagagcacagggcagtgcctggcagaagtgggtctggaaagggtgcctcctggagccatgaatgccaagcccagggtcttggactgtatcctgaaggcagcaaggaggcactgaaggcattagagcgaagcaaggagaactgtcaggccaggtgagtcatatcaagtgaggtgagagtgaaattgggagagagaagcggaaagagacaaggcagcagagacattttattgttctgcttcrtcctggaaacccactccctgacagcctcctccccctgtcctgcacccaccacccccacacctatccatacacacactgcagagccggtaggggaggaatagctctgtggtcttgtgtgcaggtgctgctatgggacttcctgggttcacatcccaaccttgccacttgtcctacctgtgtaactttgggcagtggctcaatgtctccatgtgtccagtttccctgtaaaatgaggatgatggaagtacttacctcactgaagcttaactgagtcacaggggcctggcacatagtaagctctcaatcactgtgagccgtcatggtcactggggtgacaccacctgctctcctccaaaacagaggagactatacccaaggaagaagaaaccagagaaaggacaggaaggtttggtggcagcgactagtctcgagacggcagtccccagaacagggctggatgtgtccccaccagtagacaggcccagatgcaaggcctctgatgtgtctgccgctgcagcctccattcctagggtggtgactcaataaatatgtgctgaatgaatgaatgaatgaatgaaatgtcatgacttccaggtaccccactgatgtggtttgactgtgtcaccacctaaatctcatcttgaattgtagctcccacaatcaggtgttgtgggagggacgtgaatcatgggggtgggtttttcccatgctgttctcgtgatagtgactaagtctcacaagatctgatggttttataaagggcagttcccctacacacgctttcttgcctgccaccatgtaagatgtgcctttgctcctccttcatcttccgccatgattgtgaggcctcctcagccatgtggaattgtgagtccattaaacctctttttctttataaattatcaagtctcaggtatgtatttatagcagcataagaacagactaatacacccacctacaaataaagccctgaggtctcttccccgcccttgcttgggtgggtgcagtgagtggaatgtgtagtccctgatgcaccatctccggcccttacagtttatggctcctcactgggctgtgtccagcaacatctatcctgctgtttcccctactctgggcygtccctgctcttgccgctttcctggggagtgggtgaggactgagggacactcagccccagcctggggacccagggacgaggagacacctcgggagggctgggtcacttcaggcaattaccttcacctctctaagcctcttgaaaatgggcagaatgatccctaggtgtcagaggtatggagagcatcatgggagatgacatccctgaagtgaggcacactgtgatctgtgtgtcagcattgscaggctgggaatagggtgaacctgtgaggcacctggggtgcaagttctccctgggtctggccctgtgcttggtaaatgctgccttttactacataagggrcaagtctgtcaagagtgcctgagcaatggcctgcagccgggcctggggacagggctttcctgggctggtgatggtctgaagcccaagtggcaagaagaaaactggagccaagaggcccctyccactcaggaccagcctctccccacccctcaccccatactccccaggagcccaatagacacatcatttctcttcccctccatgagtgagctccggcggggggtggtggcctggtttcccaggccctgcccctgggacccccaacctgtctcggaggagatgccttcccagcctcaggccatagcccgcccagcccaccctgggactgactccagcacagacaccagatggcacctctgtgtgtgagcccactgtggggtgttgcrtgtttctgcatgactgtacatgtgtgtgcatatccatgtgtggagagggctatttcttcatgtggtcttgcatgggtagctgagtctgtgtgcgcttggaagtatgctatgagwgtgtgtgtgtgtgtgtgtgtgtgtgtgtgtgtaaactcccagatgtcaacttgttgcttgtgtcaccattagcatgtatctgggtgtcctggttagagggtcatgtgtatgtgcctgtgcctttgtgtaattggcccttggggtgtctgggtgtatctagatgaagagagctttgytatacatctgtgtggttgcatacttctgagtgtgttgctgtgcatttggaggggtttgtgtaaaattactaggtgcctagtctaggacttgagacaaacaagacaatcacagtggtgtgtgatgctgtggggccatggrgtttcagagaaagggaggacgaaccctacctgcagggagatggaagtctttctggargagagtgagagagccttcaggcggacggaaccgyggaacaggtgcagaagttggaaagcatgtattgaagcaaggctggagacgtctcctcacttaagaagacytgraatggcgggatataggacaggagaagtcaaaragtatgttcagtatggtcatggcttccrtggggcctgctgtgggatcccagatctaggctctggaaactgagagaaagggacagccctggtgaggatggagaacaggcagcattagctggaccagccctgccccaggtttctagggagatggatggcatagctcccacatcgttcttgggctgatacttctctttcccaggggtgatggcctgtgcacccaaccagacccaaccagatcctgtggtggggctggagtgaggtggatggggagctgtctgggacaggaatccctgtgtcctgcatcctcattgctggctctgctgctgacatcataaygctggaggtaggagaagagcccatgtggatttcgggtccagcatgccccatcaggctggtgctctgcgctcatgagtagtgggtaaaaaaaacaaggacttgggagctgaaggcttggatttaaaccctgactctaccacacacttgtctgtgaccttgggcaaatcacctaacttgtgctttcagtttctctgtgcctcagtttcctgatctataatcaggggatgataatagcattgatgcccgtcaatagtatcratgtgcagattaaactagtaatatgttaaaaatgcttataatagcaccttttccaataaccaaaagtgatggaaacattagctactatggtattattatttccttacattctcacaacgactgtatgaggcccacattatttccttcacttcaataacacaggctttggacttacccaggtctcggtctgaatcctgactctgaatccacccctagctgtgtgaacccgggaaagctgcttcccctctctgcgtttcagagtccycatgcatggaatgaggttgctgtcaggaatgaatggaatgatacatgcaaggctctgagccgggtgcctggggcagggtacacacttctgacgggtcataaaaggtgaggacccagaaccagtgtggttaagcagcttggccagggtctcagggccagtaaggagcagggccgggactggaacatggagggtctgaccagaggcccaggtgcctctcccctgccaggctgcctctcctctgggtcttggtgtctccatctgtaaggtgagttgctacactgagagggcctgctggatgggtcagcgaggagggagggtgctgggttcagactgcagggctggaaggkagtggaggaggcccaaacccccaacccggaccagaattatggtcccgtgaccacagccttctgctctaccagagatctgccccttcacccagcccctcaccagaacaggctccctggtggaggcccccartgccacatatttctccatctgttccctaccaatcatcctgtgaacytgggtgartctctcaacctccccagcttcagcagcctcatctrggcaccacacaagctcactgcttgtggaagtgcctgacttgtgtatcaatgactagcacttgctgggcacctgctgggtgccacgctcttttctaggcactttacctgcattaattaagttaatcatcccaccagccctgtaagtggcatactgctcccaggatgggatgagatcctgcaccctggggagggacaaattagataatggaagaaaattgctatgaacggggctgggcacctggtaaatgctacatacgtgtttattttcttgttattattcttcccaggacttccaagttggtttttgttttgttttattttagagatgaggtctcactatgttgttcaggctagattcaaactctgggctcaagcaatcyccttgcttcagcttcttgagtagctggggctacaggtgtgagccaccacrctcagctccggcactttcaagtttacaaaacaccaggacctccatgcttctytgggaaagtgggrcacagggagcaggcattattactctcatttttgctgcattcatctgttctccactcattcattcatcaatccagcatccgtccaaggaccaggcctaggccaggtgctctggagaccctgacaagaggctaggggcttctagttttgctcaggggcagaaagcccacaggccttcaggggctggggagtgagacccactccagtgggtggttgcctggcagggatrgggacccggtgagaccagctcttctgattcttcaagaaaagctttcaagaaaatagatctagatttttgtgtaaaatatcttgatcttttatcttttaaatgtttgcaaccaatttgataaaaacaaacaaatggccaggcaca

SEQ ID NO: 13458 - DNA, 18727 bp, Homo sapiens
  misc_feature (1)...(18727): n = A,T,C or G, or insertion/deletion polymorphism (see Tables 1-2)
cacagtatccgactatataaagtcgagtgctctcatgccaggaagctgatacagttcatgaaacctcagtcattctttcgtattactcctgtcttctctttggaaaacaatctcatgaatttggtcttgacgctgacttaacatcccaggaaacagatactcaattccactgtcttttttgagaaatgaacagttctcaaactttgtttaaatttccttttcacagatgagtaataaccaaagatatttctgaaagggctctgaaaacatgcaggcaattgatctttaaaaataagatagaaatagtaggttttataaaagaaggaaatagaaatacttcagaagaaataaagtgtgctgaatcatgttttaaacataattatatccggaatgcacttacccatttgaaaaaaaaaaaaagtcaccaagttgtttccaattgtttttgtarrtttgcttagtcattttcagagacaaaaatttgggaaaaggattgtagaatsactggcttcccaaaaccacttggtgtttacaaagttatcaaaaacgggctgggacyactgatggtaataacaaaacctggggccctgaatcgtgtattctacatccgttagcacactgaagccacaccgcaaacttgtgaggccagcgttgcttcccctaccccttccgtcaaaaaccgtctgaggctgatcattaacttgcataaggtcacatagctaatgagaagcaaacgcatcataatgacctgggacatatgacactgaagcctactctctttccacaaagcttgatgtactcagatagtaattagtamacattttcataaataatcttaaccttttcaagcatttttgtcgattggattgtagcactcaaaagtaaggtctgttttactaatataaaattgggcctgtggaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatggatccmccmccccagttaagatatagaacattccagggccaggttcagtggatcatgcttgtaatcgcagcatgttgggaggctgaggagggtggaccacttgaggccaggagtttgagatcagtytgggcaacagggtgaaaccccgcctccactaaaaatacaaaaaaaagaaaaaaaaaaagaaaaaaatagctggccattgtgacatatrcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaaaaccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatrgaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaaccccycgctagaagtgtgtaagagtttatgttgcttcacakcctcatcagcactttgtaatttcagtctttttaattatagcctttttgtgggtgagaaacgctatctcttgctagttttattttgcattttcctagtgactaatgcmtctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtrtcttttgaaaagcagaagttataaatactgatagtgtccaatttatctttttcatttgtktagtgctttcttgttctaagaacctttaccaatcaccaggtcacaaaaatattttcctatgttttcttctagacastccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttrtactccattgatctaattttttttcttatacttacygctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctsttgatcaatttgaggaggatcaaaatcctgaaagtgttragcgttaccatccatgagcatgcatctctccatttatttaaggcttstttatttataaacatttcagtgatatttgatgattttgaatgtggaggtcttatacttttttgttaaattaactcttacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaayatagttttacttcttctccaatttttatggcttttgtttctttttcttgttttaatgcactggctatagcctgtaggacagtgttgaacagaggttttgagacagacatmattgctttattcaggacttctctattatatgtgatsctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaaygggaacattggccrcatcygccattgtcaattttaaataaaagatatgatgactagttggtgagttgatcttgtaagacttttacagatacccagaacggctctacttcttcatattccactttttagttttaaaagtttaagkagatctctgtgatccctgaagaattgtgtgcaaagcagcattaagacgaaaatcttttatatttgtgttgtagcttggaaaactagcgcgtggtctgttttgttccactggctcctaaggttcaggtattaacataaatacagcccattaacacttgttcctctctgtcaggacataaattaagtctgcaggtgttccatgaagctgtacccttggtactaattaagccttgataattaggtttgttaaattcaggactttaagcttatattccctccttgggctaccaaaacggagatgtgcaatatacaagccctcctgacttttttttttttttttttttttyctgcagagagcgttgctgctccttctctattttatttctttattactgtttttttaaatgaaggagtcagtaacaaaccgttcatcattttgccagagtagggtgtaaaccttcatgcagacctgtacatttgtttatgacgagattaaagtcttttctcctcctgttttgtgtcagctcagacactgaaggggaaagtttccagcctggtttctccatacactgaacatgttgaaatctatgccttaagcccaaatgarctgtcactcaagtatgcacgctcatattattaaaaactgtgcatgtaatttgctgggcacccaaataatttgttttttatttttccttaaaaatgagactttctgttaggaaagtgattcatgaaacagtgaagatcctgcctcacaactttcaagaaaccsacagaggtccctattcacataagaattttctaagcagaggttccaatttggatatttcgtggccttcaggttatttgtaaccagtacacaaaccacaaagtcataatcagatagaktttctttccagcctgtctttcctctttggttgctttgtaaatctattactcatcagatcatatgtttggcaaatgccacttttcattttgaatcaatggaatcataaaaaacaattctactagtaccactttcaagaatattcatagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctctagaagggtaccacagtttccatgagcgttcatattttgaagtttccaagaacatgttctacagaatggaccactgctctcttttcagacccaacccttgtatcagagtttgcacacatctagaagttccggttctcccagtcattacctttctccttcaagctgggattcagagtccattttcatagggcaaaatgcagagttcgggttccttcctatccatgagartaggtgctgaaggagataaaggaatgaagacatagactttgaaagcaatagtctggcaatcatccaaaggtttgtgggaggacaaaagatcacaaagtatgtgtttgtgaaaataagactatgtcatgaaagctttagaatatccaacacattatagaatattttcacggaaatatttcggatggaattttggctttaattctttctcttyttttcctgttcttttccctctccccacaaccacttctstttcattttctgttttgctccttcttttcataagtagctggtagtcagtgttctctttttcttcctgtgagacaggatctccctctgttgcccaggctcgagtacattggtaggatcttggttcactgcagcctgtgcttcccagactcaagtcatcctcccacctcagcctcctgagtaactaggaccacaggcatgggccaccacgctgggttagtttttgtatttttttgtagtaacacggttttttcatgttgcccaggctggtcttgaactcctgtgcttaagcgatccacctgccatggtctcccaaagtgctgggattacaggcgtgagccactgcgcctagcgaggtagtcagtgttctaaacactggtgtacaatccaagtctgtcrctgcccaggatagaggagggatgacgtgaattcacacgggcctctcctacaaatctgagtgtacatcaagtgaggggcgtccctccgcacctcactgttgggctgatcaatcccattcccmctccattatgtgtgtatttctaagtggcagatttgccttaggaaatggaagaagggsatgaaatagtgaccaacacaaattactgggttggcgggagttgagagctggcaaaatcgtcttggagaaggaaatggtgcagatttcagagctggcagacagcatctacatccacctctgcaggaagcaagggaaacatttttcttctggagaatcgggcagcctgcagctgatccggtggtgtctgaaaccatcctgtgtgctgtagtgtcaacaacttagcctggttactttgccaccaaaccccaccaaatgcctttgtatctttttcagaactgcatctctgcagcataattgatattacaggaatgaaaagtgttctgaggcatattattcccagggtaaagagtcaccgctgattaattacctcaaggacaaggggacggtgactttttctcttgtatccagcagcgccacgcggggcgggcgggagasgcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaasgcttttaccatggsyaaaccattaggccggctctgcagggagggcaagaccacagcagctcagtatttcctgctcagggaaaaaggccaggtcttttgttggtggaaatscacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggasaggacacttcctcctagtgtcttgtaaagctgcaagggagtcgcggctgagtcgaggatccacattcctggatgagtccttttgttaccagcggagggtgtccgggttcttggcattttgaagaaatagttggacaaaatgcacaaacaaagcaagagaagaatgaagcaacaaaagctgaggtttattgaaagcaaaactacactccatagagtgggaacggcccaagcagccactcaggggccctggatagagaatcttctggagtctaaatactccctagakgtttcccattggccacttggggtacaccccttataaatgaagtggtggcctgcaatcagtcttaytggttgcagaaagcaaccratcagaggctgaagtgaagttacaaatatcacactcctatgcaaacatctgattggttttggaaagcaaccaatcagaggctaaagtgaaattacagagttgctcttttatgcaaacgaagactccgcctccagtcagtatgattggttgtgggcagcaacccatcagaggctgaagtraagttacaaagttacactcctatgcaaacgtctgattggttgcaaaaagcaaaaccactcagaggtactttcaatttcccatctgccctgcagaaaaggtaaggggttgcaaaagagtagcccctcctccttttgttacttaggcrtggaaagttaagggtttcctttcagtttggttctaagaagtcagagtgaaatggctttagattccctgcctgcagattctattccccagcctcactttgagaagcacctggacacttcgctctaggcacgtgtcttcttcaagctgccatccattatgcatagtacaggagctcagaaaagtcacccgtgggttcctttctagctcaatcatgctgagagtccagtccatttataacataattcataaaggaacattctatttagttctcagaactctgtggcaggggactgttgttattcctcctttacagaggtgggtctgaaggtacagagtggataagtcattttctccgggccagccacacagcgaatgaatggagaytccttgtgtgtagtaaatggctgcagccctataagctataatcatatatcatcaacacctttaccctgttattaacgtgtctgaaattagggaacaccacgtacaaaagggatcagggtccacctttctgaagaaaactgcagagcttttgcagttattaaactagcaacagatgtaaagtccaactgttagagtttttctttaaagcagaagttagcarttacaggtgcttgtgatgtcatcacttagatgatcttataaatgccttttttttttttttttttttttttagtcggagtctcactctgtcgccaggctggagtgcactggcatgatctcggctcactgcaacctctgcctcccgggttcaagcaattctcctgcctcagcgtcctgagtagctgggacaagaggagcacaccactgcgcccagctaatttttgtatttttagtagagatggggtttcagcatgttggccaggatggtcttcttctcttgaccttgtgatctgcctgccccagcctcccaaagtgctgggattacaggcatgagccaccggcctggccataaatgtcttttctgggtggggcatggtcactggaaatgtaaaccctcccttccccaggtcagcctgcctcccaggtgttggtgctatgattacagtgaccacataatttatcatccacactggcacctttttgagagaggwtggggagcaggtaattatgctgggacaataggcgtatgtcaagatatctggtyaccctatctatgatctgtcacacttagtactttctaaaattctcgggcctttgcaccttctttttatcaacrcttagttctatgttactgaatatttcttaattaagtgcaggaaagaaaataaccaytttttctccttttaaagaagcacacacacctttcttttattggtattacattccttttcccwgttggtgcccctgttggttttccaaattgtcttcccatccttrtcctacctcccaatagagtacctcatcctatagtgttattataactacagaaaatatattttcattccttccacttcatgctttcagctagaaatgtgagtctctgagacttgtattcttggggtcacttaaaacataytgcataatgaggccttcaatgactctgatttggaactgaccctctatgaggggttatacccctggacaccaagctgctggcctgagcatgaggttgatggccaatctcaggagaggaggaggaagaggaggaggcggagaagaaaattgcgtgctaatttcagttgtatattgagcccacacatatttacttccaatatgaagcaaatctaagaaaaattctgctttaaagaaagaaatgtaaatcaagtgactgttgatggacgcttggaagaattcttatttatttatttttttggacaggctttcactctgtcagccaggctggagtkcaagtggcccaatcatggcttactgcagactcaacctcctgggtgcaagtaatcctcccacctcagcctcctgtgtagtggagaccataggcatgttccaccacacctagttaattttttattttttgtagaaatggggtctcaccatattgaccaggccggactcaaactccgagatgcacgtgaatctccagctgtggccccttccaaartgctgggattagatgcatgagccacctggcccagccagaatccttccattaataaaaggatggaccatgaactcccttttatgatatgagccgatcaaatgtgagcagaatagtatcctatttatacaatgtagtttaaaaccarcttcttagaaccatgagctaagggggaatctggatttcaaatgctagttgcatcaaacacgtttccaccccctcaaaacgtggcccaaagtcattagtgtcggagcacccagccatccttggctccttcccacctatgttgattaattaaaggacccaagagctaaaagggagaagtagctgcatgcttgccacttagtaatattttgataagtatttttgggatgaatgcaatgaygsatgaatgaatgaatgaatgaataacataggctacagtattttgtcttcttggttagggaccttgagtaaactgaggagtctgaggggaatgccatggaagtctgtaaacccaaaatcctcagcgaaacctcagccatctagggacatctggggcagcagagagccactggtgtggtgagttatctccctgggccttgagatagccatgctgttttgtctccacaaggaagaagtaggaggcatagcccaaggcagcttgagaggaaagcctcttggccttgaataagatgactttgttactgggcaaagaaagcccggctggaagtgctctttgatatgcaaatatagcctgataaggatttcctctccttcctactttccctccccaaccctcccccaagctaaaattctcttcccaggagccctgtcatcagcagggagttttctgtctttgtccccatctcttcacttgtgctgtgcaaaatcaggccacgattgcagggtagtccacggcttccaaagagaactgcataaatatacatctttcaggggaagagggagaacctggagaagtcaggagagcaaaaccatgccagtcagcttcagtgatgataaaggttactgttggatgaaagtttgcattttgttgtggtgtgggaaggaccttatcctgtcagctctatggatgtgcccagtttaagctctgaaagttcctttaacttgaaattgtttttgatcatgtgacaaggtcttctgaccctttatcacccacagtgttttattcatttgctctaaaccagcagtaggtgaagttaggaayaatatgtcaagcttcctaactccatggtgctctcattgttgtgtgtgtgtgtctgtgaataaacacggaaataattacgcaaataagctattggcaggtggtgataacgtaaccgcccaatgggttcattctgcctgatgcccagataaagccgatttatctagacaggggaattgcaatagggaaagagtttaatgttggtagagccagctaaacgggagactggagctttattgttactcaaatcagctttcctgaaaattcagagactggggtttttttaaggatagttttgtggacaagagaatgggtactgctgatgggctgtggatgcaatcataggggtgtgtaaaacccttgtgccctgaatccgcttctgggtggggggcagggcacaggaccagttgaatggggatggggctaccagtcctcaaaaatgcaaaagccggaaaagacatttcagaaggccaaccttaggttctacaaagtgatgttatctgcaggaataattggggaaattgcaaatcttgtaacctctggaataatggctgctaatcgtttatgtccactctttagcagaattcaggctcctgtcctcctcctaacttggtggtcttttgctagctttacaaaggcagtttagtttgggggtagggccattatcatttaaattaagtactaaatatccccccaaagttagcttggcccaagcccaggaatgactaagggcggtctgaaggttaaaggcaagatggggctaggttagatcagatctctttcacggtcataattttcttactcttacaatttttgcaaaggcagttttaataactgctatttagcaaagacagttgggtaagttactagagggagtattaccttagatggggccaggagggtttctctgaggagatcccatttcaacagatctagaaatgtaatggagccagtcctagggaaacaggactaccaggaatcctcaccagcccsgcaaagacgagggagcagcaagttccaaagcccrtggcatgtcaagggtcgatgaattcaccaactgcaaggggctttggtgaccccagtgaacagatgagaaaggggaggaggctgggatcagtgcacagctttgcaggctttgggaaggaatttcgagtttatctcatttgtccaggtatttggatgaagccctggcatactaaccstatgaaagtttatagttcccaaattgcaggataacaaggctctgtaatcttcatttcctcaaagttttacaccaggattctatggccaagtgtgtggcagtgtcacaacttaagagccagtgtaattgcccaacgggttctccttgcccgctgcctaagcaaagccgatttatcaagacagggggattgccataaagaaagagtttaggtccaggcacggtggctcatgcctgtaatcccagcattttgggaggccaaggagggtggttcaactgmggtcaggagtttgagaccatcctggccaaggtggtgaaaccccatccctactaaagatactaatattagccaggcgtagtggtaggcgcctgtaatcctagctagtcgggaggcagaggcaggagaactgcttgaacctgggaggcagaggctgcagtgagtcgagatcacaccactgcactccagcctgggcgacagastgaaactctgtctcggaaaaaaaaaaaaaagagtttaattcatgcagagctggctgtgtgggagaccagagttttattattactcaaataagtctcccccaaaactcagggatagagatttttaaggagaatttagtgagaagrgggtcagggaatggggagtattgattggtcaggtttragatggaatcagggagttgaagctggcctcttgcactgagtcagttcctgggtgggagccacaagaccatatgagtcaatttattgacctgggtggtgccagctgatccatcaattgcagggtctgcaaagtatctaaagtactgatgttcggttttaccatagtgacattatcccctggagcaatttggggaggttcagaatcttgcrgcctccggcagcatgactcctaaaccctaatttctaatcttgtggctaatttgttagtcctgcaaaggcagtctagtccccaggcaggaaggttgtttattttgggaaagggctgttatcatcttttgtttcaaagttaaaccgtaaactaagttcctctcaaagttagttagtcctacaaccaaatcaactttgaacaagacagcctggaggttagaagcaagatagagtcagttacatcagatctccatcaccttcataattttctccgttataatttttgcaaaggctgttttaataacagccagtcgttcatgtttccttgtgccacgtgattattttgtacagtcaacattaagagacaggcacttgtaaatgttgagatgccaagggggaaagaattttagaatccagatccgctttggtaagagtggccttcgagcctcatgtattctctgttcagctgttaagattgttattaaactttatggaccataaaccccacagaaacaaggaggttgaacaaccatgctattacacaagtgtcaaaacaggagctgtatttcatgtcctgaaaagtgtgcacggttggcctcctctaggtcccacgtgccttctggatggttttaaccctcagcctctytttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcrtcaacttagtccaaawgtagagggtcaggaaaacartgatatgagaraagggccrgttactgtctgggaatccataaatactgcttggcaaatggcacattgcatgcttattccttaggcatccgtttagcaaaataagatgtcaagctaattgtaatgatatttctggggtttcatcttctctccctggtacataaaagaatgcaattccacctatattttgatttaagatcaaatttttgcaaagtataattacatttgatgtaattgcccatgcaacccagatgtcatatatttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctgctttctcctgacatcatgatcatggactcacatgacaaaatggatcctccatcttccagcatctctgattgagactaacaagggccctgacagccttttctggacttgtagtatgtgcaagaattaagctttttctgtatcaagtcaccgtgttatgggggttgttcctcactgcagsagaaccttgttcatccgtattagaacagtgtggtgtttcatgttagcagagtgtatcaggatcttttgttttttttttttaaattaaggatgctgtatgagtcttttctcatactactgagaaagwcatacccaagactgagtaatttataaaggaaagaggtttaatggactcacaattccacatggyggtggaggtgtcaccattatggcagaaggcaaacaaggagcaaagtcacatcttacatggtggcaggcaagagaacttgtgcaggggaactcccctttataaaaccatcagatctcgtgggacttactcactatcacagaaacaacatggcaaagacccatccccatgattcagttacctctcaccgggtccctcccatgacgtgggaattatgggagctataattcaagatgagatttgggtggggacacagccaaaccatatcagatgcaaagttatgcatatgttgatcagctcaatttagcctttccatcatgtttacatatttcaaaataatgtgttgtgcacaatatatatgtgcaatttttgtcaattaaaaataaattaaaaaaawtaaaaaatggctttcccacagcctgtcgacttccatccccatgtgtggctctccccagggcctcccttcttgttctccccagttgcagacctcagacaggagtctgcttgtcttcctaggcccttgtcagagtggaaggtggcyctccaccacaccagcccactttccagttatcaaaaaggatctttgatttaatatttccagagcaattttggtgatttccattcaaatctgttttttgtcataactaccttgcttgcctatgggacatgttcccatttcagtgcatacttgacctttaccataaatcacatatttgtaaactgtaccctcctgctgttttaytrggcatggagaagcagtcttttctttttcttgatggcctgggttgaccagatcctgacttttgtggagacattaaagtgctagaaatgataatggtgaaagattcagaagttgaaggagatataaggagagaaatggacaattcttttggtaattgaatgaaataagactcttaggaaaattctccccagtggcaatgttgtaagaaacaccaggccgggcacagtggctcacacctgtaatcccarcactttgggaagctgagacaggcagatcacttgaagtcaggagtttgagaccagcctggccaacatggttaaaccccatctctactraaagtacaaaaattagccagacgtgatggtgcgtacctgtaatctcagctactcaggaggctgaggcaggagaatcacttgaacccgggaagcggaggttgcagggagctgagatcacgctgatgcattccagcstgggtgacagagcaggactccatctcaaaaagaaaaactcaacgaaacaccccagcttctatcattctcaagcttagtgtgtgcaagactcatggatgctgcttgttataaaggaagataaattatgaacaggcagactggtctgtgaaccttacccagaaaaatacacagtagtccagtatattggcctccagggcaaagctacctaggttctgagtccaattatggccttcatgagtcttgtttctttggacaggttttccagtgtctctgngcctcaacttcctcatgtataaagtggagatgatgccattacaggttgctgctttatggcacataattaatactagctcttatttataggaactgaacaaagccccagttgttttgaagcatgtcctatcattaacacaggtaatcaggatatattcattgaagtctcactgtgtgccaggcactatgctatgcaccttaygtgtgttattttatttcatccttccagctctgggaggtgatgactgtcatctgcattttgcacatgacaaatctgagggtcagagaacttgcccagggtcacacaattagtagatggcagctcaaggggtttttgcctgcgtcttcacccaaagccactaacacgggatctgtcaattgcattgctggtgatcaagaaatgccagctcctccrctcttccctgagtgccttgttggagacaaaaccagcaggrttatatccccagcactgtaatttagtgtggcagtcaggggaaaacaccttgtagaatttcatttcttatcatttaatgtcccctttaattctcatttaagttcccctctgtaaaaggcagtcccttcagctctcataaaactttatggtctttacttgtgattaggcaatggtaaaattgattctctaaaaccaacttctagtcaagttatgtaattagccaataagggaggctgagagaggaagatatacaaggttctccctcaagaggtcagacgtattatcattggttagatgccgtatctttaaaacaccatcagcttggaaaacactatccattagcaagagatcagagcaagagaaacctcgaagggtcgaacggtccrttctgagggctccacaaagaactcggcatcccagaaggatgattagccttccatctctcgagttgtctcagagcacaacaggtctgagtgtttttttctttaatgaattaaccctttggatttcagccctagcttttgcttcccacatctgacatcctgccctacctcctgccagaaaagattttgatttcgatcatggcagttgctgtcgctgaggtaatatgaggagatccgagacctcatccttgcagggagtgggcttgagataattctcgttacaagtttgcctagtgcttcacataagcagaggccccaagacatcagcaagcccgttttttgcctcttcctggttcatggttagactgcatttttgagcctctgcctgttaggtgcagccatgtgcctgagtcttggccaatggactgttggaagacgagacgttggccccttctcaacctgacctgtaaaaacctgtcttgcaaaaccctcacggctctttcccctgcagtcttgatgtgaacaagcatgatgatgttggaagccatacrcaagctggatagagccagggtccctgagttcaccacccagagcaaagtcacttgtcgatcagaaatacagaactagttttggacttgatgtgagaaatcttttactgtatcatagtagcaagcattaccccaaccaatacctgtgctcatactgctacagttttttttttttctttttagtgactgggtcttgctatgttgcccagacttgggtgcaatggtgccatcatagctcactgcagcctccaactcctaggctgaagccatcctcccaccgtagcctcctgaatagctgggactaaagtgtgcaccacaatgcccagctaasttttgtattttttgtagatacggggtcttgctatgttgtccaggctggtctcaaagtcctggcctcaagtgatcctcctgccttggcctcccaaagtgcttggattatagacatgatccactgcacgtggcccatactgctattccagacaagaaattgtaccaggaaattcactgatattattggtccatctgaggatcatcagagatgaaaatgagatttgacaactgcatttggaaatggagtatgacagtatcattctgatgtagggaggatatcacctcacaggagtctttcctggctatcctgtccaaagtcactactcacaatttctctatcccataactctatyttatttctctgtctagcacttatcactatctgatattttctgtctatccatccgtctattcattcattcattgctaatttattagtattgccttcccatgaactattagctgccagagagcagggacctcatctgtcctgtccactcatgtcttcagcacttagaacagtacctggcatataggatgagcttcagaaatatttgcmggtgagtgaatgagggagtgaatgaatgagggatttgcagcttgaacgctgtactttgaaacagttccagattcatgaaatttctttttaatgcagaagatttcttatgtgattaactgaatgggaattgatgctttgtggaatgaaatggattg
